US011732269B2

(12) United States Patent
Kerstetter et al.

(10) Patent No.: US 11,732,269 B2
(45) Date of Patent: Aug. 22, 2023

(54) RECOMBINANT MAIZE B CHROMOSOME SEQUENCE AND USES THEREOF

(71) Applicant: MONSANTO TECHNOLOGY LLC, St. Louis, MO (US)

(72) Inventors: Randall Kerstetter, Wildwood, MO (US); Jonathan C. Lamb, Wildwood, MO (US); Thomas S. Ream, Wildwood, MO (US); Shiaw-Pyng Yang, St. Louis, MO (US); Xuefeng Zhou, St. Louis, MO (US)

(73) Assignee: MONSANTO TECHNOLOGY LLC, St. Louis, MO (US)

( * ) Notice: Subject to any disclaimer, the term of this patent is extended or adjusted under 35 U.S.C. 154(b) by 1 day.

(21) Appl. No.: 15/765,049

(22) PCT Filed: Sep. 30, 2016

(86) PCT No.: PCT/US2016/054968
§ 371 (c)(1),
(2) Date: Mar. 30, 2018

(87) PCT Pub. No.: WO2017/059341
PCT Pub. Date: Apr. 6, 2017

(65) Prior Publication Data
US 2018/0273962 A1 Sep. 27, 2018

Related U.S. Application Data

(60) Provisional application No. 62/240,770, filed on Oct. 13, 2015, provisional application No. 62/237,048, filed on Oct. 5, 2015, provisional application No. 62/236,709, filed on Oct. 2, 2015.

(51) Int. Cl.
*C12N 15/82* (2006.01)
*C12Q 1/6895* (2018.01)
*C12N 15/64* (2006.01)

(52) U.S. Cl.
CPC ......... *C12N 15/8213* (2013.01); *C12N 15/64* (2013.01); *C12Q 1/6895* (2013.01); *C12Q 2600/13* (2013.01)

(58) Field of Classification Search
None
See application file for complete search history.

(56) References Cited

U.S. PATENT DOCUMENTS

| | | |
|---|---|---|
| 4,761,373 A | 8/1988 | Anderson et al. |
| 4,810,648 A | 3/1989 | Stalker |
| 5,013,659 A | 5/1991 | Bedbrook et al. |
| 5,015,580 A | 5/1991 | Christou et al. |
| 5,094,945 A | 3/1992 | Comai |
| 5,106,739 A | 4/1992 | Comai et al. |
| 5,141,870 A | 8/1992 | Bedbrook et al. |
| 5,159,135 A | 10/1992 | Umbeck |
| 5,188,958 A | 2/1993 | Moloney et al. |
| 5,217,902 A | 6/1993 | Jones et al. |
| 5,229,114 A | 7/1993 | Cregan et al. |
| 5,273,894 A | 12/1993 | Strauch et al. |
| 5,276,268 A | 1/1994 | Strauch et al. |
| 5,322,938 A | 6/1994 | McPherson et al. |
| 5,352,605 A | 10/1994 | Fraley et al. |
| 5,359,142 A | 10/1994 | McPherson et al. |
| 5,362,865 A | 11/1994 | Austin |
| 5,378,619 A | 1/1995 | Rogers |
| 5,378,824 A | 1/1995 | Bedbrook et al. |
| 5,463,174 A | 10/1995 | Moloney et al. |
| 5,463,175 A | 10/1995 | Barry et al. |
| 5,512,466 A | 4/1996 | Klee et al. |
| 5,530,196 A | 6/1996 | Fraley et al. |
| 5,538,880 A | 7/1996 | Lundquist et al. |
| 5,543,576 A | 8/1996 | van Ooijen et al. |
| 5,550,318 A | 8/1996 | Adams et al. |
| 5,561,236 A | 10/1996 | Leemans et al. |
| 5,589,610 A * | 12/1996 | De Beuckeleer .... C07K 14/415 435/320.1 |
| 5,591,616 A | 1/1997 | Hiei et al. |
| 5,605,011 A | 2/1997 | Bedbrook et al. |
| 5,608,149 A | 3/1997 | Barry et al. |
| 5,627,061 A | 5/1997 | Barry et al. |
| 5,633,435 A | 5/1997 | Barry et al. |
| 5,633,437 A | 5/1997 | Bernasconi et al. |
| 5,637,489 A | 6/1997 | Strauch et al. |
| 5,641,876 A | 6/1997 | McElroy et al. |
| 5,646,024 A | 7/1997 | Leemans et al. |
| 5,659,122 A | 8/1997 | Austin |
| 5,689,041 A | 11/1997 | Mariani et al. |
| 5,731,179 A | 3/1998 | Komari et al. |
| 5,750,871 A | 5/1998 | Moloney et al. |
| 5,750,876 A | 5/1998 | Barry et al. |

(Continued)

FOREIGN PATENT DOCUMENTS

| | | |
|---|---|---|
| CN | 101484581 A | 7/2009 |
| CN | 103289959 A | 9/2013 |

(Continued)

OTHER PUBLICATIONS

Tröster et al. (1989) Mol Gen Genet 217:533-35.*
Lamperti et al. (1992) Nucl Acids Res 20(11):2741-4.*
Vainstein et al. (2011) Trends Biotech 29(8):363-69.*
Svitashev et al. (2002) Plant J 32:433-45.*
Naito et al. (2015) Bioinformatics 31:1120-23.*
AY426742 1 NCBI (2004).*
NCBI Blast Align (2020) Seq ID No. 158.pdf.*
U.S. Appl. No. 62/375,618, filed Aug. 16, 2016, Caldo et al.
Beurdeley et al., "Compact designer TALENs for efficient genome engineering," *Nature Communications*, 4:1762, 8 pages (2013).
Bevan et al., "Structure and transcription of the nopaline synthase gene region of T-DNA," *Nucleic Acids Research*, 11(2):369-385 (1983).

(Continued)

*Primary Examiner* — Russell T Boggs
(74) *Attorney, Agent, or Firm* — Morrison & Foerster LLP

(57) ABSTRACT

The present disclosure provides maize B chromosome genomic loci and methods of using for agronomic practices.

16 Claims, 2 Drawing Sheets
Specification includes a Sequence Listing.

(56) References Cited

U.S. PATENT DOCUMENTS

| | | | |
|---|---|---|---|
| 5,767,366 A | 6/1998 | Sathasivan et al. | |
| 5,824,877 A | 10/1998 | Hinchee et al. | |
| 5,837,848 A | 11/1998 | Ely et al. | |
| 5,850,019 A | 12/1998 | Maiti et al. | |
| 5,869,720 A | 2/1999 | John | |
| 5,914,451 A | 6/1999 | Martinell et al. | |
| 5,958,745 A | 9/1999 | Gruys et al. | |
| 5,981,834 A | 11/1999 | John et al. | |
| 5,985,605 A | 11/1999 | Cheng et al. | |
| 5,998,700 A | 12/1999 | Lightfoot et al. | |
| 6,002,070 A | 12/1999 | D'Halluin et al. | |
| 6,011,199 A | 1/2000 | Speirs et al. | |
| 6,040,497 A | 3/2000 | Spencer et al. | |
| 6,051,753 A | 4/2000 | Comai et al. | |
| 6,051,756 A | 4/2000 | Chen et al. | |
| 6,072,103 A | 6/2000 | Wu et al. | |
| 6,080,560 A | 6/2000 | Russell et al. | |
| 6,140,075 A | 10/2000 | Russell et al. | |
| 6,140,078 A | 10/2000 | Sanders et al. | |
| 6,153,812 A | 11/2000 | Fry et al. | |
| 6,160,208 A | 12/2000 | Lundquist et al. | |
| 6,166,292 A | 12/2000 | Osumi et al. | |
| 6,171,640 B1 | 1/2001 | Bringe | |
| 6,175,060 B1 | 1/2001 | Lefebvre et al. | |
| 6,177,611 B1 | 1/2001 | Rice | |
| 6,225,105 B1 | 5/2001 | Sathasivan et al. | |
| 6,228,623 B1 | 5/2001 | Asrar et al. | |
| 6,232,526 B1 | 5/2001 | McElroy et al. | |
| 6,252,138 B1 | 6/2001 | Karimi et al. | |
| 6,265,638 B1 | 7/2001 | Bidney et al. | |
| 6,271,443 B1 | 8/2001 | Stalker et al. | |
| 6,294,714 B1 | 9/2001 | Matsunaga et al. | |
| 6,297,056 B1 | 10/2001 | Tulsieram et al. | |
| RE37,543 E | 2/2002 | Kruger et al. | |
| 6,380,462 B1 | 4/2002 | Kridl | |
| 6,384,301 B1 | 5/2002 | Martinell et al. | |
| 6,399,861 B1 | 6/2002 | Anderson et al. | |
| 6,414,222 B1 | 7/2002 | Gengenbach et al. | |
| 6,426,446 B1 | 7/2002 | McElroy et al. | |
| 6,426,447 B1 | 7/2002 | Knauf et al. | |
| 6,429,357 B1 | 8/2002 | McElroy et al. | |
| 6,429,362 B1 | 8/2002 | Crane | |
| 6,433,252 B1 | 8/2002 | Kriz et al. | |
| 6,437,217 B1 | 8/2002 | McElroy et al. | |
| 6,444,876 B1 | 9/2002 | Lassner et al. | |
| 6,459,018 B1 | 10/2002 | Knutzon | |
| 6,476,295 B2 | 11/2002 | Barry et al. | |
| 6,483,008 B1 | 11/2002 | Dehesh et al. | |
| 6,489,461 B1 | 12/2002 | Dehesh et al. | |
| 6,495,739 B1 | 12/2002 | Lassner et al. | |
| 6,531,648 B1 | 3/2003 | Lanahan et al. | |
| 6,537,750 B1 | 3/2003 | Shorrosh | |
| 6,538,178 B1 | 3/2003 | Kishore | |
| 6,538,179 B1 | 3/2003 | Barry et al. | |
| 6,538,181 B1 | 3/2003 | Stalker et al. | |
| 6,541,259 B1 | 4/2003 | Lassner et al. | |
| 6,576,818 B1 | 6/2003 | Stalker et al. | |
| 6,589,767 B1 | 7/2003 | Knutzon et al. | |
| 6,596,538 B1 | 7/2003 | Lardizabal et al. | |
| 6,613,963 B1 | 9/2003 | Gingera et al. | |
| 6,635,806 B1 | 10/2003 | Kriz et al. | |
| 6,653,530 B1 | 11/2003 | Shewmaker et al. | |
| 6,660,849 B1 | 12/2003 | Dehesh | |
| 6,706,950 B2 | 3/2004 | Dehesh | |
| 6,723,837 B1 | 4/2004 | Karunanandaa et al. | |
| 6,770,465 B1 | 8/2004 | Dehesh et al. | |
| 6,774,283 B1 | 8/2004 | Goodman et al. | |
| 6,812,379 B2 | 11/2004 | Staub | |
| 6,822,141 B2 | 11/2004 | Lardizabal et al. | |
| 6,828,475 B1 | 12/2004 | Metz et al. | |
| 7,122,722 B2 | 10/2006 | Trolinder et al. | |
| 2003/0028917 A1 | 2/2003 | Gruys et al. | |
| 2003/0083480 A1 | 5/2003 | Castle et al. | |
| 2003/0110532 A1 | 6/2003 | ArmoStrong et al. | |
| 2003/0115626 A1 | 6/2003 | Weeks et al. | |
| 2003/0135879 A1 | 7/2003 | Weeks et al. | |
| 2004/0123342 A1 | 6/2004 | Elliott et al. | |
| 2004/0177399 A1 | 9/2004 | Hammer et al. | |
| 2004/0216189 A1 | 10/2004 | Houmard et al. | |
| 2004/0237142 A1 | 11/2004 | Gilbertson et al. | |
| 2005/0183170 A1 | 8/2005 | Fillatti et al. | |
| 2014/0283166 A1* | 9/2014 | Chomet et al. | C12N 15/8213 536/23.6 |
| 2015/0059010 A1* | 2/2015 | Cigan et al. | A01H 5/00 800/298 |
| 2015/0167010 A1 | 6/2015 | Lamb et al. | |

FOREIGN PATENT DOCUMENTS

| | | |
|---|---|---|
| EP | 0 275 957 | 7/1988 |
| EP | 0 385 962 A1 | 9/1990 |
| WO | WO 87/04181 | 7/1987 |
| WO | WO 89/00193 | 1/1989 |
| WO | WO 99/27116 | 6/1999 |
| WO | WO 2004/009761 A2 | 1/2004 |
| WO | WO 2004/074443 A2 | 9/2004 |
| WO | WO 2005/003362 A2 | 1/2005 |
| WO | WO 2007/134122 A2 | 11/2007 |
| WO | 2017059341 A1 | 4/2017 |

OTHER PUBLICATIONS

Callis et al., "Heat Inducible Expression of a Chimeric Maize hsp70CAT Gene in Maize Protoplasts," *Plant Physiol*, 88:965-968 (1988).

Carrington and Freed, "Cap-independent enhancement of translation by a plant polyvirus 5'nontranslated region," *Journal of Virology*, 64: 1590-1597 (1990).

Castle et al., "Discovery and directed evolution of a glyphosate tolerance gene," *Science*, 304: 1151-1154 (2004).

Cermak et al., "Efficient design and assembly of custom TALEN and other TAL effector-based constructs for DNA targeting," *Nucleic Acids Res.*, 39(12):e82, 11 pages (2011).

Chandler et al. "Two Regulatory Genes of the Maize Anthocyanin Pathway Are Homologous: Isolation of B Utilizing R Genomic Sequences," *The Plant Cell*, 1(12):1175-1183 (1989).

Cheng et al., "Evolution of the heterochromatic regions on maize B long arm based on the sequence structure of CL-repeat variants," *Chromosome Research*, 18:605-619 (2010).

Comeau et al., "Media for the in ovulo culture of proembryos of wheat and wheat-derived interspecific hybrids or haploids," *Plant Science*, 81(1):117-125 (1992).

Dekeyser et al., "Evaluation of selectable markers for rice transformation," *Plant Physiology*, 90: 217-223 (1989).

Della-Cioppa et al, "Translocation of the precursor of 5-enolpyruvylshikimate-3-phosphate synthase into chloroplasts of higher plants in vitro," *PNAS USA*. 83:6873-6877, (1986).

Depicker et al., "Nopaline synthase: transcript mapping and DNA sequence," *Journal of Molecular and Applied Genetics*, 1(6):561-573 (1982).

Doyle et al., "TAL Effector-Nucleotide Targeter (TALE-NT) 2.0: tools for TAL effector design and target prediction," *Nucleic Acids Res.*, 40(W1):W117-W122 (2012).

Ebert et al, "Identification of an essential upstream element in the nopaline synthase promoter by stable and transient assays," *PNAS USA*, 84:5745-5749 (1987).

Extended European Search Report dated Apr. 29, 2019, in European Patent Application No. 16852769.5.

Fraley et al., "Expression of bacterial genes in plant cells," *PNAS USA*, 80:4803-4807 (1983).

Gabsalilow et al., "Site- and strand-specific nicking of DNA by fusion proteins derived from MutH and I-SceI or TALE repeats," *Nucleaic Acids Research*, 41:e83, 11 pages (2013).

Gaeta et al., "Synthetic chromosome platforms in plants," *Annual Review of Plant Biology*, 63:307-330 (2012).

Gao et al., "DNA-guided genome editing using the *Natronobacterium gregoryi* Argonaute," *Nature Biotechnology*, 34:768-773 (2016).

GenBank Accession V00087.

(56) References Cited

OTHER PUBLICATIONS

Huang et al., "Application of a superword array in genome assembly," *Nucleic Acids Research*, 34.1: 201-205 (2006).
Hui, et al., "Strategies for cloning unknown cellular flanking DNA sequences from foreign integrants," *Cellular and Molecular Life Sciences CMLS*, 54(12):1403-1411 (1998).
Kato et al., "Chromosome Painting for Plant Biotechnology," *Plant Chromosome Engineering in Methods in Molecular Biology*, Humana Press, Totowa, NJ:67-96 (2011).
Kelliher at al., "Maternal Haploids Are Preferentially Induced by CENH3-tailswap Transgenic Complementation in Maize," *Frontiers in Plant Science*, 7:414 (2016).
Koo et al., "Distinct DNA methylation patterns associated with active and inactive centromeres of the maize B chromosome," *Genome Research*, 21(6):908-914 (2011).
Kuhlemeier et al., "The Pea rbcS-3A Promoter Mediates Light Responsiveness but Not Organ Specificity," *The Plant Cell*, 1(4):471-478 (1989).
Lamb et al., "Localization and transcription of a retrotransposon-derived element on the maize B chromosome," *Chromosome Research*, 15:383-398 (2007).
Lawton et al., "Expression of a soybean β-conclycinin gene under the control of the Cauliflower Mosaic $_{35}$S and $_{19}$S promoters in transformed petunia tissues," *Plant Molecular Biology*, 9(4):315-324 (1987).
Marcotte et al., "Abscisic Acid-Responsive Sequences from the Em Gene of Wheat," *The Plant Cell*, 1:969-976 (1989).
Odell et al., "Identification of DNA sequences required for activity of the cauliflower mosaic virus 35S promoter," *Nature*, 313:810-812 (1985).
Partial Supplementary European Search Report dated Jan. 30, 2019, in European Patent Application No. 16852769.5.
Schnable et al., "The B73 maize genome: complexity, diversity, and dynamics," *Science*, 326:1112-5 (2009).
Schnäffner et al., "Maize rbcS Promoter Activity Depends on Sequence Elements Not Found in Dicot rbcS Promoters," *The Plant Cell*, 3:997-1012 (1991).

Siebertz et al., "cis-Analysis of the Wound-Inducible Promoter wun1 in Transgenic Tobacco Plants and Histochemical Localization of Its Expression," *The Plant Cell*, 1:961-968 (1989).
Tonooka and Fujishima, "Comparison and critical evaluation of PCR-mediated methods to walk along the sequence of genomic DNA," *Applied Microbiology and Biotechnology*, 85.1: 37 (2009).
Yang et al., "Maize sucrose synthase-1 promoter directs phloem cell-specific expression of *Gus* gene in transgenic tobacco plants," *PNAS*, 8(11):4144-4148 (1990).
Yanik et al., "TALE-PvuII Fusion Proteins—Novel Tools for Gene Targeting," *PLoS One*. 8:e82539, 13 pages (2013).
Yu et al., "Construction and behavior of engineered mimichromosomes in maize," PNAS 104(21):8924-8929 2007.
EMBL-EBI sequence AE016822.1 (Aug. 5, 2004) nucleotides 400648-400794.
International Search Report dated Feb. 23, 2017 in International Application No. PCT/US2016/054968.
Frame et al., "Improved Agrobacterium-mediated transformation of three maize inbred lines using MS salts," Plant Cell Rep, 25:1024-1034 (2006).
Gao et al., "Complex Trait Loci in Maize Enabled by CRISPR-Cas9 Mediated Gene Insertion," *Front. Plant Sci.*, 11:535 (2020).
Kuscu et al., "Genome-wide analysis reveals characteristics of off-target sites bound by the Cas9 endonuclease," *Nature Biotechnology*, 32:677-683 (2014).
Takano et al., "The structures of integration sites in transgenic rice," Plant J., 11:353-361 (1997).
Cheng et al., "Cloning and Characterization of Maize B Chromosome Sequences Derived From Microdissection," *Genetics*, 299-310 (2003).
Blavet, N. et al. (Jun. 4, 2021). "Sequence of the Supernumerary B Chromosome of Maize Provides Insight into its Drive Mechanism and Evolution," PNAS 118(23):e2104254118, 11 pages.
Yu, W. et al. (Nov. 14, 2006). "Telomere-Mediated Chromosomal Truncation in Maize," PNAS 103(46):17331-17336.

* cited by examiner

RECOMBINANT MAIZE B CHROMOSOME SEQUENCE AND USES THEREOF

CROSS-REFERENCE TO RELATED APPLICATIONS AND INCORPORATION OF SEQUENCE LISTING

This application is a U.S. National Stage Application of International Application No. PCT/US2016/054968 filed Sep. 30, 2016, which claims the benefit of U.S. Provisional Patent Application No. 62/236,709 filed Oct. 2, 2015, U.S. Provisional Patent Application No. 62/237,048 filed Oct. 5, 2015, and U.S. Provisional Patent Application No. 62/240,770 filed Oct. 13, 2015, which are incorporated by reference in their entirety herein. The sequence listings contained in the files "P34350US00_SEQ.text" (3,202,544 bytes (measured in operating system MS Windows) created on Oct. 2, 2015, filed with U.S. Provisional Patent Application No. 62/236,709 on Oct. 2, 2015), "P34350US01_SEQ.txt" (3,202,584 bytes (measured in operating system MS Windows) created on Oct. 5, 2015, filed with U.S. Provisional Patent Application No. 62/237,048 on Oct. 5, 2015) and "P34350US02_SEQ.txt" (3,655,665 bytes (measured in operating system MS Windows) created on Oct. 13, 2015, filed with U.S. Provisional Patent Application No. 62/240,770 on Oct. 13, 2015) are incorporated by reference in their entirety herein. A computer readable form of a sequence listing is filed with this application by electronic submission and is incorporated into this application by reference in its entirety. The sequence listing is contained in the file named Sequence Listing-P34350US03.txt, which is 3,640,457 bytes in size (measured in operating system MS Windows) and was created on Mar. 29, 2018.

BACKGROUND

B chromosomes are supernumerary chromosomes that occur in many organisms and differ from the standard nuclear chromosomes (A chromosomes) in that they rarely carry active genes. These chromosomes are not essential for the life of a species.

The first transgenic plants were generated in the 1990s and were the result of random insertion of transgene DNA into nuclear A chromosomes (e.g., Roundup Ready® soybean). As more transgenic events conferring separate traits (e.g., insect resistance, drought tolerance, herbicide tolerance, quality traits) have been generated, there is a desire of plant breeders and farmers to have multiple traits in the crop plant. As the number of traits per plant increases, there is a corresponding increase in the resources and technical challenges needed to generate a breeding stack of multiple traits present on A chromosomes in elite germplasm. Additionally, with increased traits there exists a risk of linkage drag. In maize, trait stacking and reduction of the risk of A chromosome linkage drag may be solved by developing the next generation of transgenic traits on the B chromosome.

SUMMARY

Figure 1:
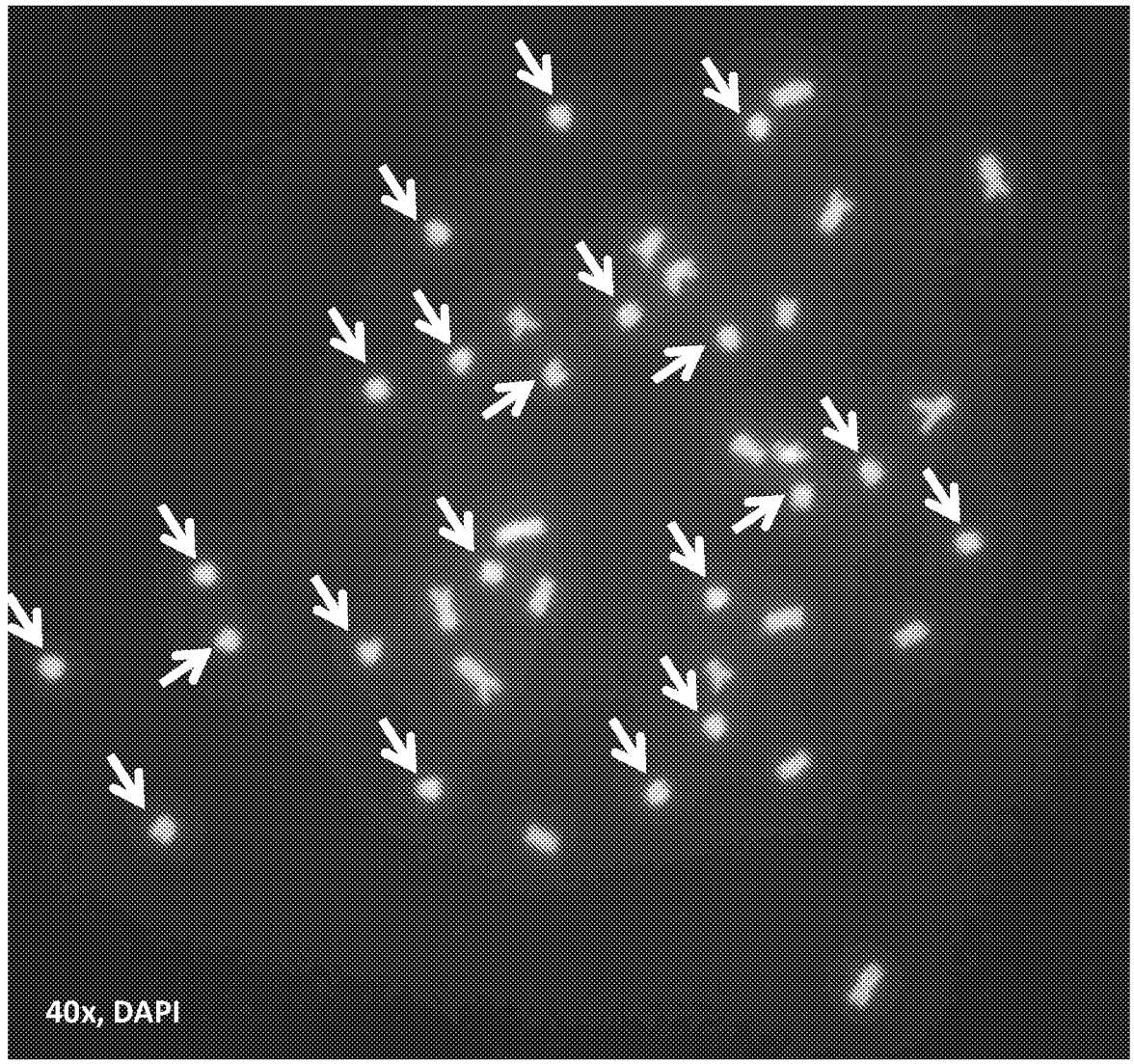
FIG. 1. Image of a maize root tip cell with the chromosomes stained with DAPI fluorescence stain. The arrows show the 20 B chromosomes in the nucleus of the cell from an individual plant. Magnification of the image is 40×.

Several embodiments relate to a recombinant nucleic acid comprising: a nucleic acid sequence of having at least 90%, at least 91%, at least 92%, at least 93%, 94%, at least 95%, at least 96%, at least 97%, at least 98%, at least 99%, or 100%, sequence identity to at least 0.25 Kb, 0.5 Kb, 0.75 Kb, 1 Kb, 1.25 Kb, 1.5 Kb, 1.75 Kb, 2 Kb, 2.25 Kb, 2.5 Kb, 2.75 Kb, 3 Kb, 3.25 Kb, 3.5 Kb, 3.75 Kb, 4 Kb, 4.25 Kb, 4.5 Kb, 4.75 Kb, or 5 Kb of a maize B chromosome sequence selected from the group consisting of SEQ ID NOs: 10-13, 16, 19, 21, 22, 24, 25, 32, 34, 38, 40-45, 17-49, 55, 56, 60, 62, 64, 65, 68, 70, 72, 73, 75-79, 81, 83-86, 88-92, 94, 95, 98, 100, 102, 103, 107, 108, 110-112, 114, 116-118, 121, 123, 124, 126, 129-133, 135, 137, 138, 140-150, 154-159, 162-166, 168, 171-180, 183-197, 200-212, 214, 215, 217, 218, 220, 222-225, 228-232, 234-236, 238-241, 243, 244, 247, 249, 251, 253, 254, 256-258, 260-266, 269, 270, 273, 275-279, 281-295, 299, 301, 302, 304-316, 318-320, 322, 323, 325, 327-329, 331-335, 338-344, 346, 347, 349-354, 357-360, 363, 365, 366-373, 375-379, 381, 383, 384, 386-388, 391, 392, 395-398, 400-404, 406-412, 415, 416, 418-420, 422, 423, 428-433, 435-441, 443-446, 448-450, 452, 456-459, 461-464, 466-475, 478, 479, 481-484, 486, 487, 490-495, 497-499, 501-503, 505-508, 510-513, 517-520, 524, 525, 527-529, 531-543, 545-547, 549-554, 556-560, 563-577, 579-584, 586-593, 595, 596, 598-609, 611-614, 616-619, 621-624, 626, 627, 629-636, 638-640, 643-652, 655, 657-661, 663, 664, 666-668, 670-674, 676-680, 683-688, 690-701, 703, 705-708, 711-717, 719-729, 731-734, 736-738, 740, 741, 743-748, 750, 752-764, 766, 767, 770, 771, 773, 774, 776-785, 787-791, and 793-888, and at least one DNA of interest, wherein at least one of the DNA of interest is integrated into the maize B chromosome sequence to produce the recombinant nucleic acid. In some embodiments, the DNA of interest is integrated at double-strand break generated by one or more site-specific genome modification enzymes. In some embodiments, the DNA of interest encodes site-specific genome modification enzyme. In some embodiments, the DNA of interest encodes one or more of an endonuclease, a recombinase, a transposase, a helicase or any combination thereof. In some embodiments, the DNA of interest comprises one or more gene expression cassettes, wherein the gene expression cassettes are selected from the group comprising: an insecticidal resistance gene expression cassette, herbicide tolerance gene expression cassette, nitrogen use efficiency gene expression cassette, a water use efficiency gene expression cassette, a nutritional quality gene expression cassette, a DNA binding gene expression cassette, a selectable marker gene expression cassette, an RNAi construct expression cassette, a site-specific genome modification enzyme gene expression cassette, or an expression cassette encoding one or more of a CRIPR associate protein, a tracr RNA and a guide RNA.

Several embodiments relate to a maize plant comprising a recombinant nucleic acid comprising: a nucleic acid sequence of having at least 90%, at least 91%, at least 92%, at least 93%, 94%, at least 95%, at least 96%, at least 97%, at least 98%, at least 99%, or 100%, sequence identity to at least 0.25 Kb, 0.5 Kb, 0.75 Kb, 1 Kb, 1.25 Kb, 1.5 Kb, 1.75 Kb, 2 Kb, 2.25 Kb, 2.5 Kb, 2.75 Kb, 3 Kb, 3.25 Kb, 3.5 Kb, 3.75 Kb, 4 Kb, 4.25 Kb, 4.5 Kb, 4.75 Kb, or 5 Kb of a maize B chromosome sequence selected from the group consisting of SEQ ID NOs: 10-13, 16, 19, 21, 22, 24, 25, 32, 34, 38, 40-45, 17-49, 55, 56, 60, 62, 64, 65, 68, 70, 72, 73, 75-79, 81, 83-86, 88-92, 94, 95, 98, 100, 102, 103, 107, 108, 110-112, 114, 116-118, 121, 123, 124, 126, 129-133, 135, 137, 138, 140-150, 154-159, 162-166, 168, 171-180, 183-197, 200-212, 214, 215, 217, 218, 220, 222-225, 228-232, 234-236, 238-241, 243, 244, 247, 249, 251, 253, 254, 256-258, 260-266, 269, 270, 273, 275-279, 281-295, 299, 301, 302, 304-316, 318-320, 322, 323, 325, 327-329, 331-335, 338-344, 346, 347, 349-354, 357-360, 363, 365, 366-373, 375-379, 381, 383, 384, 386-388, 391, 392, 395-398, 400-404, 406-412, 415, 416, 418-420, 422, 423, 428-433, 435-441, 443-446, 448-450, 452, 456-459, 461-464, 466-475, 478, 479, 481-484, 486, 487, 490-495, 497-499, 501-503, 505-508, 510-513, 517-520, 524, 525, 527-529, 531-543, 545-547, 549-554, 556-560, 563-577, 579-584, 586-593, 595, 596, 598-609, 611-614, 616-619, 621-624, 626, 627, 629-636, 638-640, 643-652, 655, 657-661, 663, 664, 666-668, 670-674, 676-680, 683-688, 690-701, 703, 705-708, 711-717, 719-729, 731-734, 736-738, 740, 741, 743-748, 750, 752-764, 766, 767, 770, 771, 773, 774, 776-785, 787-791, and 793-888, and at least one DNA of interest, wherein at least one of the DNA of interest is integrated into the maize B chromosome sequence to produce the recombinant nucleic acid. In some embodiments, the DNA of interest is integrated at double-strand break generated by one or more site-specific genome modification enzymes. In some embodiments, the DNA of interest encodes site-specific genome modification enzyme. In some embodiments, the DNA of interest encodes one or more of an endonuclease, a recombinase, a transposase, a helicase or any combination thereof. In some embodiments, the DNA of interest comprises one or more gene expression cassettes, wherein the gene expression cassettes are selected from the group comprising: an insecticidal resistance gene expression cassette, herbicide tolerance gene expression cassette, nitrogen use efficiency gene expression cassette, a water use efficiency gene expression cassette, a nutritional quality gene expression cassette, a DNA binding gene expression cassette, a selectable marker gene expression cassette, an RNAi construct expression cassette, a site-specific genome modification enzyme gene expression cassette, or an expression cassette encoding one or more of a CRIPR associate protein, a tracr RNA and a guide RNA.

Several embodiments relate to a recombinant B chromosome comprising: a nucleic acid sequence of having at least 90%, at least 91%, at least 92%, at least 93%, 94%, at least 95%, at least 96%, at least 97%, at least 98%, at least 99%, or 100%, sequence identity to at least 0.25 Kb, 0.5 Kb, 0.75 Kb, 1 Kb, 1.25 Kb, 1.5 Kb, 1.75 Kb, 2 Kb, 2.25 Kb, 2.5 Kb, 2.75 Kb, 3 Kb, 3.25 Kb, 3.5 Kb, 3.75 Kb, 4 Kb, 4.25 Kb, 4.5 Kb, 4.75 Kb, or 5 Kb of a maize B chromosome sequence selected from the group consisting of SEQ ID NOs: 10-13, 16, 19, 21, 22, 24, 25, 32, 34, 38, 40-45, 17-49, 55, 56, 60, 62, 64, 65, 68, 70, 72, 73, 75-79, 81, 83-86, 88-92, 94, 95, 98, 100, 102, 103, 107, 108, 110-112, 114, 116-118, 121, 123, 124, 126, 129-133, 135, 137, 138, 140-150, 154-159, 162-166, 168, 171-180, 183-197, 200-212, 214, 215, 217, 218, 220, 222-225, 228-232, 234-236, 238-241, 243, 244, 247, 249, 251, 253, 254, 256-258, 260-266, 269, 270, 273, 275-279, 281-295, 299, 301, 302, 304-316, 318-320, 322, 323, 325, 327-329, 331-335, 338-344, 346, 347, 349-354, 357-360, 363, 365, 366-373, 375-379, 381, 383, 384, 386-388, 391, 392, 395-398, 400-404, 406-412, 415, 416, 418-420, 422, 423, 428-433, 435-441, 443-446, 448-450, 452, 456-459, 461-464, 466-475, 478, 479, 481-484, 486, 487, 490-495, 497-499, 501-503, 505-508, 510-513, 517-520, 524, 525, 527-529, 531-543, 545-547, 549-554, 556-560, 563-577, 579-584, 586-593, 595, 596, 598-609, 611-614, 616-619, 621-624, 626, 627, 629-636, 638-640, 643-652, 655, 657-661, 663, 664, 666-668, 670-674, 676-680, 683-688, 690-701, 703, 705-708, 711-717, 719-729, 731-734, 736-738, 740, 741, 743-748, 750, 752-764, 766, 767, 770, 771, 773, 774, 776-785, 787-791, and 793-888, and at least one DNA of interest, wherein at least one of the DNA of interest is integrated into the maize B chromosome sequence to produce the recombinant nucleic acid. In some embodiments, the DNA of interest is integrated at double-strand break generated by one or more site-specific genome modification enzymes. In some embodiments, the DNA of interest encodes site-specific genome modification enzyme. In some embodiments, the DNA of interest encodes one or more of an endonuclease, a recombinase, a transposase, a helicase or any combination thereof. In some embodiments, the DNA of interest comprises one or more gene expression cassettes, wherein the gene expression cassettes are selected from the group comprising: an insecticidal resistance gene expression cassette, herbicide tolerance gene expression cassette, nitrogen use efficiency gene expression cassette, a water use efficiency gene expression cassette, a nutritional quality gene expression cassette, a DNA binding gene expression cassette, a selectable marker gene expression cassette, an RNAi construct expression cassette, a site-specific genome modification enzyme gene expression cassette, or an expression cassette encoding one or more of a CRIPR associate protein, a tracr RNA and a guide RNA.

Several embodiments relate to a method of making a maize cell comprising at least one DNA of interest integrated in a B chromosome by selecting at least one target having at least 90%, at least 91%, at least 92%, at least 93%, 94%, at least 95%, at least 96%, at least 97%, at least 98%, at least 99%, or 100%, sequence identity to at least 0.25 Kb, 0.5 Kb, 0.75 Kb, 1 Kb, 1.25 Kb, 1.5 Kb, 1.75 Kb, 2 Kb, 2.25 Kb, 2.5 Kb, 2.75 Kb, 3 Kb, 3.25 Kb, 3.5 Kb, 3.75 Kb, 4 Kb, 4.25 Kb, 4.5 Kb, 4.75 Kb, or 5 Kb of a maize B chromosome sequence selected from the group consisting of SEQ ID NOs: 10-13, 16, 19, 21, 22, 24, 25, 32, 34, 38, 40-45, 17-49, 55, 56, 60, 62, 64, 65, 68, 70, 72, 73, 75-79, 81, 83-86, 88-92, 94, 95, 98, 100, 102, 103, 107, 108, 110-112, 114, 116-118, 121, 123, 124, 126, 129-133, 135, 137, 138, 140-150, 154-159, 162-166, 168, 171-180, 183-197, 200-212, 214, 215, 217, 218, 220, 222-225, 228-232, 234-236, 238-241, 243, 244, 247, 249, 251, 253, 254, 256-258, 260-266, 269, 270, 273, 275-279, 281-295, 299, 301, 302, 304-316, 318-320, 322, 323, 325, 327-329, 331-335, 338-344, 346, 347, 349-354, 357-360, 363, 365, 366-373, 375-379, 381, 383, 384, 386-388, 391, 392, 395-398, 400-404, 406-412, 415, 416, 418-420, 422, 423, 428-433, 435-441, 443-446, 448-450, 452, 456-459, 461-464, 466-475, 478, 479, 481-484, 486, 487, 490-495, 497-499, 501-503, 505-508, 510-513, 517-520, 524, 525, 527-529, 531-543, 545-547, 549-554, 556-560, 563-577, 579-584, 586-593, 595, 596, 598-609, 611-614, 616-619, 621-624, 626, 627, 629-636, 638-640, 643-652, 655, 657-661, 663, 664, 666-668, 670-674, 676-680, 683-688, 690-701, 703, 705-708, 711-

717, 719-729, 731-734, 736-738, 740, 741, 743-748, 750, 752-764, 766, 767, 770, 771, 773, 774, 776-785, 787-791, and 793-888; selecting a site specific genome modification enzyme that specifically cleaves the target site; introducing the site specific genome modification enzyme into the maize cell; introducing the DNA of interest into the maize cell; integrating the DNA of interest into the target site; and selecting a transgenic maize cell comprising the at least one of the DNA of interest integrated into the B chromosome. In some embodiments, the DNA of interest is integrated at double-strand break generated by one or more site-specific genome modification enzymes. In some embodiments, the DNA of interest encodes site-specific genome modification enzyme. In some embodiments, the DNA of interest encodes one or more of an endonuclease, a recombinase, a transposase, a helicase or any combination thereof. In some embodiments, the DNA of interest comprises one or more gene expression cassettes, wherein the gene expression cassettes are selected from the group comprising: an insecticidal resistance gene expression cassette, herbicide tolerance gene expression cassette, nitrogen use efficiency gene expression cassette, a water use efficiency gene expression cassette, a nutritional quality gene expression cassette, a DNA binding gene expression cassette, a selectable marker gene expression cassette, an RNAi construct expression cassette, a site-specific genome modification enzyme gene expression cassette, or an expression cassette encoding one or more of a CRIPR associate protein, a tracr RNA and a guide RNA.

Several embodiments relate to a method of providing a site specific genome modification enzyme to a maize cell comprising integrating at least one site specific genome modification enzyme into a sequence having at least 90%, at least 91%, at least 92%, at least 93%, 94%, at least 95%, at least 96%, at least 97%, at least 98%, at least 99%, or 100%, sequence identity to at least 0.25 Kb, 0.5 Kb, 0.75 Kb, 1 Kb, 1.25 Kb, 1.5 Kb, 1.75 Kb, 2 Kb, 2.25 Kb, 2.5 Kb, 2.75 Kb, 3 Kb, 3.25 Kb, 3.5 Kb, 3.75 Kb, 4 Kb, 4.25 Kb, 4.5 Kb, 4.75 Kb, or 5 Kb of a maize B chromosome sequence selected from the group consisting of SEQ ID NOs: 10-13, 16, 19, 21, 22, 24, 25, 32, 34, 38, 40-45, 17-49, 55, 56, 60, 62, 64, 65, 68, 70, 72, 73, 75-79, 81, 83-86, 88-92, 94, 95, 98, 100, 102, 103, 107, 108, 110-112, 114, 116-118, 121, 123, 124, 126, 129-133, 135, 137, 138, 140-150, 154-159, 162-166, 168, 171-180, 183-197, 200-212, 214, 215, 217, 218, 220, 222-225, 228-232, 234-236, 238-241, 243, 244, 247, 249, 251, 253, 254, 256-258, 260-266, 269, 270, 273, 275-279, 281-295, 299, 301, 302, 304-316, 318-320, 322, 323, 325, 327-329, 331-335, 338-344, 346, 347, 349-354, 357-360, 363, 365, 366-373, 375-379, 381, 383, 384, 386-388, 391, 392, 395-398, 400-404, 406-412, 415, 416, 418-420, 422, 423, 428-433, 435-441, 443-446, 448-450, 452, 456-459, 461-464, 466-475, 478, 479, 481-484, 486, 487, 490-495, 497-499, 501-503, 505-508, 510-513, 517-520, 524, 525, 527-529, 531-543, 545-547, 549-554, 556-560, 563-577, 579-584, 586-593, 595, 596, 598-609, 611-614, 616-619, 621-624, 626, 627, 629-636, 638-640, 643-652, 655, 657-661, 663, 664, 666-668, 670-674, 676-680, 683-688, 690-701, 703, 705-708, 711-717, 719-729, 731-734, 736-738, 740, 741, 743-748, 750, 752-764, 766, 767, 770, 771, 773, 774, 776-785, 787-791, and 793-888; and selecting a maize cell comprising site specific genome modification enzyme integrated into the B chromosome. In some embodiments, the site-specific genome modification enzyme specifically cleaves a target site in one or more A Chromosomes into which a DNA of interest is integrated. In some embodiments, the DNA of interest comprises one or more gene expression cassettes, wherein the gene expression cassettes are selected from the group comprising: an insecticidal resistance gene expression cassette, herbicide tolerance gene expression cassette, nitrogen use efficiency gene expression cassette, a water use efficiency gene expression cassette, a nutritional quality gene expression cassette, a DNA binding gene expression cassette, a selectable marker gene expression cassette, and an RNAi construct expression cassette. In some embodiments, progeny are selected that comprise the DNA of interest but do not comprise the B chromosome comprising the site specific genome modification enzyme. In some embodiments, the B chromosome comprises a negative selection marker.

Several embodiments relate to a recombinant nucleic acid comprising a nucleic acid sequence of at least 1 Kb having at least 90% sequence identity with a maize B chromosome sequence selected from the group consisting of SEQ ID NOs: 10-13, 16, 19, 21, 22, 24, 25, 32, 34, 38, 40-45, 17-49, 55, 56, 60, 62, 64, 65, 68, 70, 72, 73, 75-79, 81, 83-86, 88-92, 94, 95, 98, 100, 102, 103, 107, 108, 110-112, 114, 116-118, 121, 123, 124, 126, 129-133, 135, 137, 138, 140-150, 154-159, 162-166, 168, 171-180, 183-197, 200-212, 214, 215, 217, 218, 220, 222-225, 228-232, 234-236, 238-241, 243, 244, 247, 249, 251, 253, 254, 256-258, 260-266, 269, 270, 273, 275-279, 281-295, 299, 301, 302, 304-316, 318-320, 322, 323, 325, 327-329, 331-335, 338-344, 346, 347, 349-354, 357-360, 363, 365, 366-373, 375-379, 381, 383, 384, 386-388, 391, 392, 395-398, 400-404, 406-412, 415, 416, 418-420, 422, 423, 428-433, 435-441, 443-446, 448-450, 452, 456-459, 461-464, 466-475, 478, 479, 481-484, 486, 487, 490-495, 497-499, 501-503, 505-508, 510-513, 517-520, 524, 525, 527-529, 531-543, 545-547, 549-554, 556-560, 563-577, 579-584, 586-593, 595, 596, 598-609, 611-614, 616-619, 621-624, 626, 627, 629-636, 638-640, 643-652, 655, 657-661, 663, 664, 666-668, 670-674, 676-680, 683-688, 690-701, 703, 705-708, 711-717, 719-729, 731-734, 736-738, 740, 741, 743-748, 750, 752-764, 766, 767, 770, 771, 773, 774, 776-785, 787-791, and 793-888, and a DNA of interest integrated into the maize B chromosome sequence to produce the recombinant nucleic acid. In some embodiments, the recombinant nucleic acid comprises a DNA of interest that is integrated proximal to a target site for a site-specific genome modification enzyme. In some embodiments, the site-specific genome modification enzyme is an endonuclease. In some embodiments, the site-specific genome modification enzyme is a recombinase. In some embodiments, the site-specific genome modification enzyme is a transposase. In some embodiments, the site-specific genome modification enzyme is a helicase. In some embodiments, the site-specific genome modification enzyme is any combination of an endonuclease, a recombinase, a transposase and a helicase. In some embodiments, the target site is specific for maize B chromosome sequence. In a further embodiment, the target site is specific for maize B chromosome sequence is selected from one or more of the group comprising SEQ ID NOs: 10-13, 16, 19, 21, 22, 24, 25, 32, 34, 38, 40-45, 17-49, 55, 56, 60, 62, 64, 65, 68, 70, 72, 73, 75-79, 81, 83-86, 88-92, 94, 95, 98, 100, 102, 103, 107, 108, 110-112, 114, 116-118, 121, 123, 124, 126, 129-133, 135, 137, 138, 140-150, 154-159, 162-166, 168, 171-180, 183-197, 200-212, 214, 215, 217, 218, 220, 222-225, 228-232, 234-236, 238-241, 243, 244, 247, 249, 251, 253, 254, 256-258, 260-266, 269, 270, 273, 275-279, 281-295, 299, 301, 302, 304-316, 318-320, 322, 323, 325, 327-329, 331-335, 338-344, 346, 347, 349-354, 357-360, 363, 365, 366-373, 375-379, 381, 383, 384, 386-388, 391, 392, 395-398, 400-404, 406-412, 415, 416, 418-420, 422, 423, 428-433, 435-441, 443-446, 448-450, 452, 456-459, 461-464, 466-475, 478, 479, 481-484, 486, 487, 490-495, 497-499, 501-503, 505-508, 510-513, 517-520, 524, 525, 527-529, 531-543, 545-547, 549-554, 556-560, 563-577, 579-584, 586-593, 595, 596, 598-609, 611-614, 616-619, 621-624, 626, 627, 629-636, 638-640, 643-652, 655, 657-661, 663, 664, 666-668, 670-674, 676-680, 683-688, 690-701, 703, 705-708, 711-717, 719-729, 731-734, 736-738, 740, 741, 743-748, 750, 752-764, 766, 767, 770, 771, 773, 774, 776-785, 787-791, and 793-888. In some embodiments, the site-specific genome modification enzyme is an endonuclease selected from a meganuclease, a zinc finger nuclease, a transcription activator-like effector nuclease (TALEN), an Argonaute, a DNA-guided recombinase, a DNA-guided endonuclease, an RNA-guided recombinase, an RNA-guided endonuclease, a type I CRISPR-Cas system, type II CRISPR-Cas system and a type III CRISPR-Cas system. In some embodiments, the endonuclease is selected from the group comprising Cpf1, Cas1, Cas1B, Cas2, Cas3, Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, and Csf4 nuclease. In some embodiments, the site-specific genome modification enzyme is an RNA-guided recombinase. In some embodiments, the site-specific genome modification enzyme is a fusion protein comprising a recombinase and a CRISPR associated protein. In some embodiments, the recombinase is a tyrosine recombinase attached to a DNA recognition motif, or a serine recombinase attached to a DNA recognition motif. In some embodiments, the recombinase is a Cre recombinase, a Flp recombinase, and a Tnp1 recombinase, a PhiC31 integrase, an R4 integrase, or a TP-901 integrase. In some embodiments, transposase is a DNA transposase attached to a DNA binding domain. In some embodiments, the DNA of interest does not encode a peptide. In some embodiments, the DNA of interest does encode a peptide. In some embodiments, the DNA of interest comprises one or more gene expression cassettes. In some embodiments, the gene expression cassette is selected from the group comprising an insecticidal resistance gene expression cassette, an herbicide tolerance gene expression cassette, a nitrogen use efficiency gene expression cassette, a water use efficiency gene expression cassette, a nutritional quality gene expression cassette, a DNA binding gene expression cassette, a selectable marker gene expression cassette, an RNAi construct expression cassette, a site-specific genome modification enzyme gene expression cassette, an expression cassette encoding a recombinant guide RNA of an RNA-guided endonuclease, or an expression cassette encoding a recombinant DNA guide. In some embodiments, the DNA of interest is integrated into the target site of the maize B chromosome via a homology directed repair integration method. In some embodiments, the DNA of interest is integrated into the target site of the maize B chromosome via a non-homologous end joining integration method. In some embodiments, the DNA of interest and/or the maize B chromosome target site sequences are modified during integration of the DNA of interest into the target site of the maize B chromosome sequence. In some embodiments, the recombinant nucleic acid is present in a maize plant, a maize plant part, a maize seed, or a maize plant cell.

Several embodiments relate to a recombinant nucleic acid comprising a nucleic acid sequence of at least 1 Kb having at least 90% sequence identity with a maize B chromosome sequence selected from the group consisting of SEQ ID NOs: 10-13, 16, 19, 21, 22, 24, 25, 32, 34, 38, 40-45, 17-49, 55, 56, 60, 62, 64, 65, 68, 70, 72, 73, 75-79, 81, 83-86, 88-92, 94, 95, 98, 100, 102, 103, 107, 108, 110-112, 114, 116-118, 121, 123, 124, 126, 129-133, 135, 137, 138, 140-150, 154-159, 162-166, 168, 171-180, 183-197, 200-212, 214, 215, 217, 218, 220, 222-225, 228-232, 234-236, 238-241, 243, 244, 247, 249, 251, 253, 254, 256-258, 260-266, 269, 270, 273, 275-279, 281-295, 299, 301, 302, 304-316, 318-320, 322, 323, 325, 327-329, 331-335, 338-344, 346, 347, 349-354, 357-360, 363, 365, 366-373, 375-379, 381, 383, 384, 386-388, 391, 392, 395-398, 400-404, 406-412, 415, 416, 418-420, 422, 423, 428-433, 435-441, 443-446, 448-450, 452, 456-459, 461-464, 466-475, 478, 479, 481-484, 486, 487, 490-495, 497-499, 501-503, 505-508, 510-513, 517-520, 524, 525, 527-529, 531-543, 545-547, 549-554, 556-560, 563-577, 579-584, 586-593, 595, 596, 598-609, 611-614, 616-619, 621-624, 626, 627, 629-636, 638-640, 643-652, 655, 657-661, 663, 664, 666-668, 670-674, 676-680, 683-688, 690-701, 703, 705-708, 711-717, 719-729, 731-734, 736-738, 740, 741, 743-748, 750, 752-764, 766, 767, 770, 771, 773, 774, 776-785, 787-791, and 793-888, and a DNA of interest integrated into the maize B chromosome sequence to produce the recombinant nucleic acid. In some embodiments, the recombinant nucleic acid comprises a DNA of interest integrated between a pair of target sites for a site-specific genome modification enzyme. In some embodiments, the site-specific genome modification enzyme is an endonuclease. In some embodiments, the site-specific genome modification enzyme is a recombinase. In some embodiments, the site-specific genome modification enzyme is a transposase. In some embodiments, the site-specific genome modification enzyme is a helicase. In some embodiments, the site-specific genome modification enzyme is any combination of an endonuclease, a recombinase, a transposase and a helicase. In some embodiments, the target site is specific for maize B chromosome sequence. In a further embodiment, the target site is specific for maize B chromosome sequence is selected from one or more of the group comprising SEQ ID NOs: 10-13, 16, 19, 21, 22, 24, 25, 32, 34, 38, 40-45, 17-49, 55, 56, 60, 62, 64, 65, 68, 70, 72, 73, 75-79, 81, 83-86, 88-92, 94, 95, 98, 100, 102, 103, 107, 108, 110-112, 114, 116-118, 121, 123, 124, 126, 129-133, 135, 137, 138, 140-150, 154-159, 162-166, 168, 171-180, 183-197, 200-212, 214, 215, 217, 218, 220, 222-225, 228-232, 234-236, 238-241, 243, 244, 247, 249, 251, 253, 254, 256-258, 260-266, 269, 270, 273, 275-279, 281-295, 299, 301, 302, 304-316, 318-320, 322, 323, 325, 327-329, 331-335, 338-344, 346, 347, 349-354, 357-360, 363, 365, 366-373, 375-379, 381, 383, 384, 386-388, 391, 392, 395-398, 400-404, 406-412, 415, 416, 418-420, 422, 423, 428-433, 435-441, 443-446, 448-450, 452, 456-459, 461-464, 466-475, 478, 479, 481-484, 486, 487, 490-495, 497-499, 501-503, 505-508, 510-513, 517-520, 524, 525, 527-529, 531-543, 545-547, 549-554, 556-560, 563-577, 579-584, 586-593, 595, 596, 598-609, 611-614, 616-619, 621-624, 626, 627, 629-636, 638-640, 643-652, 655, 657-661, 663, 664, 666-668, 670-674, 676-680, 683-688, 690-701, 703, 705-708, 711-717, 719-729, 731-734, 736-738, 740, 741, 743-748, 750, 752-764, 766, 767, 770, 771, 773, 774, 776-785, 787-791, and 793-888. In some embodiments, the site-specific genome modification enzyme is an endonuclease selected from a meganuclease, a zinc finger nuclease, a transcription activator-like effector nuclease (TALEN), an Argonaute, a DNA-guided recombinase, a DNA-guided endonuclease, an RNA-guided recombinase, an RNA-guided endonuclease, a type I CRISPR-Cas system, type II CRISPR-Cas system and a type III CRISPR-Cas system. In some embodiments, the endonuclease is selected from the group comprising Cpf1, Cas1, Cas1B, Cas2, Cas3, Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, and Csf4 nuclease. In some embodiments, the site-specific genome modification enzyme is an RNA-guided recombinase. In some embodiments, the site-specific genome modification enzyme is a fusion protein comprising a recombinase and a CRISPR associated protein. In some embodiments, the recombinase is a tyrosine recombinase attached to a DNA recognition motif, or a serine recombinase attached to a DNA recognition motif. In some embodiments, the recombinase is a Cre recombinase, a Flp recombinase, and a Tnp1 recombinase, a PhiC31 integrase, an R4 integrase, or a TP-901 integrase. In some embodiments, transposase is a DNA transposase attached to a DNA binding domain. In some embodiments, the DNA of interest does not encode a peptide. In some embodiments, the DNA of interest does encode a peptide. In some embodiments, the DNA of interest comprises one or more gene expression cassettes. In some embodiments, the gene expression cassette is selected from the group comprising an insecticidal resistance gene expression cassette, an herbicide tolerance gene expression cassette, a nitrogen use efficiency gene expression cassette, a water use efficiency gene expression cassette, a nutritional quality gene expression cassette, a DNA binding gene expression cassette, a selectable marker gene expression cassette, an RNAi construct expression cassette, a site-specific genome modification enzyme gene expression cassette, an expression cassette encoding a recombinant guide RNA of an RNA-guided endonuclease, or an expression cassette encoding a recombinant DNA guide. In some embodiments, the DNA of interest is integrated into the target site of the maize B chromosome via a homology directed repair integration method. In some embodiments, the DNA of interest is integrated into the target site of the maize B chromosome via a non-homologous end joining integration method. In some embodiments, the DNA of interest and/or the maize B chromosome target site sequences are modified during integration of the DNA of interest into the target site of the maize B chromosome sequence. In some embodiments, the recombinant nucleic acid is present in a maize plant, a maize plant part, a maize seed, or a maize plant cell.

Several embodiments relate to a recombinant nucleic acid comprising a nucleic acid sequence of at least 1 Kb having at least 90% sequence identity with a maize B chromosome sequence selected from the group consisting of SEQ ID NOs: 10-13, 16, 19, 21, 22, 24, 25, 32, 34, 38, 40-45, 17-49, 55, 56, 60, 62, 64, 65, 68, 70, 72, 73, 75-79, 81, 83-86, 88-92, 94, 95, 98, 100, 102, 103, 107, 108, 110-112, 114, 116-118, 121, 123, 124, 126, 129-133, 135, 137, 138, 140-150, 154-159, 162-166, 168, 171-180, 183-197, 200-212, 214, 215, 217, 218, 220, 222-225, 228-232, 234-236, 238-241, 243, 244, 247, 249, 251, 253, 254, 256-258, 260-266, 269, 270, 273, 275-279, 281-295, 299, 301, 302, 304-316, 318-320, 322, 323, 325, 327-329, 331-335, 338-344, 346, 347, 349-354, 357-360, 363, 365, 366-373, 375-379, 381, 383, 384, 386-388, 391, 392, 395-398, 400-404, 406-412, 415, 416, 418-420, 422, 423, 428-433, 435-441, 443-446, 448-450, 452, 456-459, 461-464, 466-475, 478, 479, 481-484, 486, 487, 490-495, 497-499, 501-503, 505-508, 510-513, 517-520, 524, 525, 527-529, 531-543, 545-547, 549-554, 556-560, 563-577, 579-584, 586-593, 595, 596, 598-609, 611-614, 616-619, 621-624, 626, 627, 629-636, 638-640, 643-652, 655, 657-661, 663, 664, 666-668, 670-674, 676-680, 683-688, 690-701, 703, 705-708, 711-717, 719-729, 731-734, 736-738, 740, 741, 743-748, 750, 752-764, 766, 767, 770, 771, 773, 774, 776-785, 787-791, and 793-888, and a DNA of interest integrated into the maize B chromosome sequence to produce the recombinant nucleic acid. In some embodiments, the recombinant nucleic acid comprises one or more of the DNA of interest inserted proximal to two or more target sites for a site-specific genome modification enzyme. In some embodiments, the site-specific genome modification enzyme is an endonuclease. In some embodiments, the site-specific genome modification enzyme is a recombinase. In some embodiments, the site-specific genome modification enzyme is a transposase. In some embodiments, the site-specific genome modification enzyme is a helicase. In some embodiments, the site-specific genome modification enzyme is any combination of an endonuclease, a recombinase, a transposase and a helicase. In some embodiments, the target site is specific for maize B chromosome sequence. In a further embodiment, the target site is specific for maize B chromosome sequence is selected from one or more of the group comprising SEQ ID NOs: 10-13, 16, 19, 21, 22, 24, 25, 32, 34, 38, 40-45, 17-49, 55, 56, 60, 62, 64, 65, 68, 70, 72, 73, 75-79, 81, 83-86, 88-92, 94, 95, 98, 100, 102, 103, 107, 108, 110-112, 114, 116-118, 121, 123, 124, 126, 129-133, 135, 137, 138, 140-150, 154-159, 162-166, 168, 171-180, 183-197, 200-212, 214, 215, 217, 218, 220, 222-225, 228-232, 234-236, 238-241, 243, 244, 247, 249, 251, 253, 254, 256-258, 260-266, 269, 270, 273, 275-279, 281-295, 299, 301, 302, 304-316, 318-320, 322, 323, 325, 327-329, 331-335, 338-344, 346, 347, 349-354, 357-360, 363, 365, 366-373, 375-379, 381, 383, 384, 386-388, 391, 392, 395-398, 400-404, 406-412, 415, 416, 418-420, 422, 423, 428-433, 435-441, 443-446, 448-450, 452, 456-459, 461-464, 466-475, 478, 479, 481-484, 486, 487, 490-495, 497-499, 501-503, 505-508, 510-513, 517-520, 524, 525, 527-529, 531-543, 545-547, 549-554, 556-560, 563-577, 579-584, 586-593, 595, 596, 598-609, 611-614, 616-619, 621-624, 626, 627, 629-636, 638-640, 643-652, 655, 657-661, 663, 664, 666-668, 670-674, 676-680, 683-688, 690-701, 703, 705-708, 711-717, 719-729, 731-734, 736-738, 740, 741, 743-748, 750, 752-764, 766, 767, 770, 771, 773, 774, 776-785, 787-791, and 793-888. In some embodiments, the site-specific genome modification enzyme is an endonuclease selected from a meganuclease, a zinc finger nuclease, a transcription activator-like effector nuclease (TALEN), an Argonaute, a DNA-guided recombinase, a DNA-guided endonuclease, an RNA-guided recombinase, an RNA-guided endonuclease, a type I CRISPR-Cas system, type II CRISPR-Cas system and a type III CRISPR-Cas system. In some embodiments, the endonuclease is selected from the group comprising Cpf1, Cas1, Cas1B, Cas2, Cas3, Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, and Csf4 nuclease. In some embodiments, the site-specific genome modification enzyme is an RNA-guided recombinase. In some embodiments, the site-specific genome modification enzyme is a fusion protein comprising a recombinase and a CRISPR associated protein. In some embodiments, the recombinase is a tyrosine recombinase attached to a DNA recognition motif, or a serine recombinase attached to a DNA recognition motif. In some embodiments, the recombinase is a Cre recombinase, a Flp recombinase, and a Tnp1 recombinase, a PhiC31 integrase, an R4 integrase, or a TP-901 integrase. In some embodiments, transposase is a DNA transposase attached to a DNA binding domain. In some embodiments, two or more of the DNA of interest are the same. In some embodiments, two or more of the DNA of interest are not the same. In some embodiments, the DNA of interest does not encode a peptide. In some embodiments, the DNA of interest does encode a peptide. In some embodiments, the DNA of interest comprises one or more gene expression cassettes. In some embodiments, the gene expression cassette is selected from the group comprising an insecticidal resistance gene expression cassette, an herbicide tolerance gene expression cassette, a nitrogen use efficiency gene expression cassette, a water use efficiency gene expression cassette, a nutritional quality gene expression cassette, a DNA binding gene expression cassette, a selectable marker gene expression cassette, an RNAi construct expression cassette, a site-specific genome modification enzyme gene expression cassette, an expression cassette encoding a recombinant guide RNA of an RNA-guided endonuclease, or an expression cassette encoding a recombinant DNA guide. In some embodiments, the DNA of interest is integrated into the target site of the maize B chromosome via a homology directed repair integration method. In some embodiments, the DNA of interest is integrated into the target site of the maize B chromosome via a non-homologous end joining integration method. In some embodiments, two or more of the maize B chromosome target site sequences each comprise an integrated DNA of interest to produce two or more recombinant sequences. In some embodiments, the two or more recombinant sequences are located on the same B chromosome. In some embodiments, the two or more recombinant sequences are located on different B chromosomes. In some embodiments, the two or more recombinant sequences are located on different B chromosomes which, during cell division, recombine to generate a new megalocus on a new B chromosome. In some embodiments, the DNA of interest and/or the maize B chromosome target site sequences are modified during integration of the DNA of interest into the target site of the maize B chromosome sequence. In some embodiments, the recombinant nucleic acid is present in a maize plant, a maize plant part, a maize seed, or a maize plant cell.

Several embodiments relate to a recombinant nucleic acid comprising a nucleic acid sequence of at least 1 Kb having at least 90% sequence identity with a maize B chromosome sequence selected from the group consisting of SEQ ID NOs: 10-13, 16, 19, 21, 22, 24, 25, 32, 34, 38, 40-45, 17-49, 55, 56, 60, 62, 64, 65, 68, 70, 72, 73, 75-79, 81, 83-86, 88-92, 94, 95, 98, 100, 102, 103, 107, 108, 110-112, 114, 116-118, 121, 123, 124, 126, 129-133, 135, 137, 138, 140-150, 154-159, 162-166, 168, 171-180, 183-197, 200-212, 214, 215, 217, 218, 220, 222-225, 228-232, 234-236, 238-241, 243, 244, 247, 249, 251, 253, 254, 256-258, 260-266, 269, 270, 273, 275-279, 281-295, 299, 301, 302, 304-316, 318-320, 322, 323, 325, 327-329, 331-335, 338-344, 346, 347, 349-354, 357-360, 363, 365, 366-373, 375-379, 381, 383, 384, 386-388, 391, 392, 395-398, 400-404, 406-412, 415, 416, 418-420, 422, 423, 428-433, 435-441, 443-446, 448-450, 452, 456-459, 461-464, 466-475, 478, 479, 481-484, 486, 487, 490-495, 497-499, 501-503, 505-508, 510-513, 517-520, 524, 525, 527-529, 531-543, 545-547, 549-554, 556-560, 563-577, 579-584, 586-593, 595, 596, 598-609, 611-614, 616-619, 621-624, 626, 627, 629-636, 638-640, 643-652, 655, 657-661, 663, 664, 666-668, 670-674, 676-680, 683-688, 690-701, 703, 705-708, 711-717, 719-729, 731-734, 736-738, 740, 741, 743-748, 750, 752-764, 766, 767, 770, 771, 773, 774, 776-785, 787-791, and 793-888, and a DNA of interest integrated into the maize B chromosome sequence to produce the recombinant nucleic acid. In some embodiments, the recombinant nucleic acid comprises one or more of the DNA of interest inserted proximal to two or more target sites for a site-specific genome modification enzyme. In some embodiments, the site-specific genome modification enzyme is an endonuclease. In some embodiments, the site-specific genome modification enzyme is a recombinase. In some embodiments, the site-specific genome modification enzyme is a transposase. In some embodiments, the site-specific genome modification enzyme is a helicase. In some embodiments, the site-specific genome modification enzyme is any combination of an endonuclease, a recombinase, a transposase and a helicase. In some embodiments, the target site is specific for maize B chromosome sequence. In a further embodiment, the target site is specific for maize B chromosome sequence is selected from one or more of the group comprising SEQ ID NOs:10-13, 16, 19, 21, 22, 24, 25, 32, 34, 38, 40-45, 17-49, 55, 56, 60, 62, 64, 65, 68, 70, 72, 73, 75-79, 81, 83-86, 88-92, 94, 95, 98, 100, 102, 103, 107, 108, 110-112, 114, 116-118, 121, 123, 124, 126, 129-133, 135, 137, 138, 140-150, 154-159, 162-166, 168, 171-180, 183-197, 200-212, 214, 215, 217, 218, 220, 222-225, 228-232, 234-236, 238-241, 243, 244, 247, 249, 251, 253, 254, 256-258, 260-266, 269, 270, 273, 275-279, 281-295, 299, 301, 302, 304-316, 318-320, 322, 323, 325, 327-329, 331-335, 338-344, 346, 347, 349-354, 357-360, 363, 365, 366-373, 375-379, 381, 383, 384, 386-388, 391, 392, 395-398, 400-404, 406-412, 415, 416, 418-420, 422, 423, 428-433, 435-441, 443-446, 448-450, 452, 456-459, 461-464, 466-475, 478, 479, 481-484, 486, 487, 490-495, 497-499, 501-503, 505-508, 510-513, 517-520, 524, 525, 527-529, 531-543, 545-547, 549-554, 556-560, 563-577, 579-584, 586-593, 595, 596, 598-609, 611-614, 616-619, 621-624, 626, 627, 629-636, 638-640, 643-652, 655, 657-661, 663, 664, 666-668, 670-674, 676-680, 683-688, 690-701, 703, 705-708, 711-717, 719-729, 731-734, 736-738, 740, 741, 743-748, 750, 752-764, 766, 767, 770, 771, 773, 774, 776-785, 787-791, and 793-888. In some embodiments, the site-specific genome modification enzyme is an endonuclease selected from a meganuclease, a zinc finger nuclease, a transcription activator-like effector nuclease (TALEN), an Argonaute, a DNA-guided recombinase, a DNA-guided endonuclease, an RNA-guided recombinase, an RNA-guided endonuclease, a type I CRISPR-Cas system, type II CRISPR-Cas system and a type III CRISPR-Cas system. In some embodiments, the endonuclease is selected from the group comprising Cpf1, Cas1, Cas1B, Cas2, Cas3, Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, and Csf4 nuclease. In some embodiments, the site-specific genome modification enzyme is an RNA-guided recombinase. In some embodiments, the site-specific genome modification enzyme is a fusion protein comprising a recombinase and a CRISPR associated protein. In some embodiments, the recombinase is a tyrosine recombinase attached to a DNA recognition motif, or a serine recombinase attached to a DNA recognition motif. In some embodiments, the recombinase is a Cre recombinase, a Flp recombinase, and a Tnp1 recombinase, a PhiC31 integrase, an R4 integrase, or a TP-901 integrase. In some embodiments, transposase is a DNA transposase attached to a DNA binding domain. In some embodiments, two or more of the DNA of interest are the same. In some embodiments, two or more of the DNA of interest are not the same. In some embodiments, the DNA of interest does not encode a peptide. In some embodiments, the DNA of interest does encode a peptide. In some embodiments, the DNA of interest comprises one or more gene expression cassettes. In some embodiments, the gene expression cassette is selected from the group comprising an insecticidal resistance gene expression cassette, an herbicide tolerance gene expression cassette, a nitrogen use efficiency gene expression cassette, a water use efficiency gene expression cassette, a nutritional quality gene expression cassette, a DNA binding gene expression cassette, a selectable marker gene expression cassette, an RNAi construct expression cassette, a site-specific genome modification enzyme gene expression cassette, an expression cassette encoding a recombinant guide RNA of an RNA-guided endonuclease, or an expression cassette encoding a recombinant DNA guide. In some embodiments, the DNA of interest is integrated into the target site of the maize B chromosome via a homology directed repair integration method. In some embodiments, the DNA of interest is integrated into the target site of the maize B chromosome via a non-homologous end joining integration method. In some embodiments, two or more of the maize B chromosome target site sequences each comprise an integrated DNA of interest to produce two or more recombinant sequences. In some embodiments, the two or more recombinant sequences are located on the same B chromosome. In some embodiments, the two or more recombinant sequences are located on different B chromosomes. In some embodiments, the two or more recombinant sequences are located on different B chromosomes which, during cell division, recombine to generate a new megalocus on a new B chromosome. In some embodiments, the DNA of interest and/or the maize B chromosome target site sequences are modified during integration of the DNA of interest into the target site of the maize B chromosome sequence. In some embodiments, the recombinant nucleic acid is present in a maize plant, a maize plant part, a maize seed, or a maize plant cell.

Several embodiments relate to a method of making a maize plant cell comprising a recombinant nucleic acid with a DNA of interest integrated in a B chromosome, the method comprising: (a) selecting a target site in a maize B chromosome genomic locus having at least 90% sequence identity from the group consisting of SEQ ID NOs: 10-13, 16, 19, 21, 22, 24, 25, 32, 34, 38, 40-45, 17-49, 55, 56, 60, 62, 64, 65, 68, 70, 72, 73, 75-79, 81, 83-86, 88-92, 94, 95, 98, 100, 102, 103, 107, 108, 110-112, 114, 116-118, 121, 123, 124, 126, 129-133, 135, 137, 138, 140-150, 154-159, 162-166, 168, 171-180, 183-197, 200-212, 214, 215, 217, 218, 220, 222-225, 228-232, 234-236, 238-241, 243, 244, 247, 249, 251, 253, 254, 256-258, 260-266, 269, 270, 273, 275-279, 281-295, 299, 301, 302, 304-316, 318-320, 322, 323, 325, 327-329, 331-335, 338-344, 346, 347, 349-354, 357-360, 363, 365, 366-373, 375-379, 381, 383, 384, 386-388, 391, 392, 395-398, 400-404, 406-412, 415, 416, 418-420, 422, 423, 428-433, 435-441, 443-446, 448-450, 452, 456-459, 461-464, 466-475, 478, 479, 481-484, 486, 487, 490-495, 497-499, 501-503, 505-508, 510-513, 517-520, 524, 525, 527-529, 531-543, 545-547, 549-554, 556-560, 563-577, 579-584, 586-593, 595, 596, 598-609, 611-614, 616-619, 621-624, 626, 627, 629-636, 638-640, 643-652, 655, 657-661, 663, 664, 666-668, 670-674, 676-680, 683-688, 690-701, 703, 705-708, 711-717, 719-729, 731-734, 736-738, 740, 741, 743-748, 750, 752-764, 766, 767, 770, 771, 773, 774, 776-785, 787-791, and 793-888; (b) selecting a site specific genome modification enzyme that specifically binds and cleaves the target site in the maize B chromosome genomic locus; (c) introducing the site specific genome modification enzyme into a maize plant cell; (d) optionally, when the site-specific genome modification enzyme of step (c) is an RNA-guided endonuclease, introducing a guide RNA into a maize plant cell; or (e) optionally, when the site-specific genome modification enzyme of step (c) is an DNA-guided endonuclease, introducing a guide DNA into a maize plant cell; (e) introducing the DNA of interest into the maize plant cell; (f) integrating the DNA of interest proximal to the target site in the maize B chromosome genomic locus; and (g) selecting transgenic plant cells comprising the DNA of interest integrated into the target site of the maize B chromosome genomic locus. Several embodiments relate to a method of making a maize plant cell comprising a recombinant nucleic acid with a DNA of interest integrated in a B chromosome, the method comprising: (a) selecting a pair of target sites in a maize B chromosome genomic locus having at least 90% sequence identity from the group consisting of SEQ ID NOs: 10-13, 16, 19, 21, 22, 24, 25, 32, 34, 38, 40-45, 17-49, 55, 56, 60, 62, 64, 65, 68, 70, 72, 73, 75-79, 81, 83-86, 88-92, 94, 95, 98, 100, 102, 103, 107, 108, 110-112, 114, 116-118, 121, 123, 124, 126, 129-133, 135, 137, 138, 140-150, 154-159, 162-166, 168, 171-180, 183-197, 200-212, 214, 215, 217, 218, 220, 222-225, 228-232, 234-236, 238-241, 243, 244, 247, 249, 251, 253, 254, 256-258, 260-266, 269, 270, 273, 275-279, 281-295, 299, 301, 302, 304-316, 318-320, 322, 323, 325, 327-329, 331-335, 338-344, 346, 347, 349-354, 357-360, 363, 365, 366-373, 375-379, 381, 383, 384, 386-388, 391, 392, 395-398, 400-404, 406-412, 415, 416, 418-420, 422, 423, 428-433, 435-441, 443-446, 448-450, 452, 456-459, 461-464, 466-475, 478, 479, 481-484, 486, 487, 490-495, 497-499, 501-503, 505-508, 510-513, 517-520, 524, 525, 527-529, 531-543, 545-547, 549-554, 556-560, 563-577, 579-584, 586-593, 595, 596, 598-609, 611-614, 616-619, 621-624, 626, 627, 629-636, 638-640, 643-652, 655, 657-661, 663, 664, 666-668, 670-674, 676-680, 683-688, 690-701, 703, 705-708, 711-717, 719-729, 731-734, 736-738, 740, 741, 743-748, 750, 752-764, 766, 767, 770, 771, 773, 774, 776-785, 787-791, and 793-888; (b) selecting one or more site specific genome modification enzymes that specifically bind and cleave the pair of target sites in the maize B chromosome genomic locus; (c) introducing the site specific genome modification enzymes into a maize plant cell; (d) optionally, when one of the site-specific genome modification enzymes of step (c) is an RNA-guided endonuclease, introducing a guide RNA into a maize plant cell; or (e) optionally, when one of the site-specific genome modification enzymes of step (c) is an DNA-guided endonuclease, introducing a guide DNA into a maize plant cell; (e) introducing the DNA of interest into the maize plant cell; (f) integrating the DNA of interest between the pair of target sites for the site-specific genome modification enzymes in a maize B chromosome genomic locus; and (g) selecting transgenic plant cells comprising at least one of the DNA of interest integrated into at least one of the target sites of the maize B chromosome genomic locus. Several embodiments relate to a method of making a maize plant cell comprising a recombinant nucleic acid with at least one DNA of interest integrated in a B chromosome, the method comprising: (a) selecting two or more target sites in a maize B chromosome genomic locus having at least 90% sequence identity from the group consisting of SEQ ID NOs: 10-13, 16, 19, 21, 22, 24, 25, 32, 34, 38, 40-45, 17-49, 55, 56, 60, 62, 64, 65, 68, 70, 72, 73, 75-79, 81, 83-86, 88-92, 94, 95, 98, 100, 102, 103, 107, 108, 110-112, 114, 116-118, 121, 123, 124, 126, 129-133, 135, 137, 138, 140-150, 154-159, 162-166, 168, 171-180, 183-197, 200-212, 214, 215, 217, 218, 220, 222-225, 228-232, 234-236, 238-241, 243, 244, 247, 249, 251, 253, 254, 256-258, 260-266, 269, 270, 273, 275-279, 281-295, 299, 301, 302, 304-316, 318-320, 322, 323, 325, 327-329, 331-335, 338-344, 346, 347, 349-354, 357-360, 363, 365, 366-373, 375-379, 381, 383, 384, 386-388, 391, 392, 395-398, 400-404, 406-412, 415, 416, 418-420, 422, 423, 428-433, 435-441, 443-446, 448-450, 452, 456-459, 461-464, 466-475, 478, 479, 481-484, 486, 487, 490-495, 497-499, 501-503, 505-508, 510-513, 517-520, 524, 525, 527-529, 531-543, 545-547, 549-554, 556-560, 563-577, 579-584, 586-593, 595, 596, 598-609, 611-614, 616-619, 621-624, 626, 627, 629-636, 638-640, 643-652, 655, 657-661, 663, 664, 666-668, 670-674, 676-680, 683-688, 690-701, 703, 705-708, 711-717, 719-729, 731-734, 736-738, 740, 741, 743-748, 750, 752-764, 766, 767, 770, 771, 773, 774, 776-785, 787-791, and 793-888; (b) selecting one or more site specific genome modification enzymes that specifically bind and cleave the two or more target sites in the maize B chromosome genomic locus; (c) introducing the site specific genome modification enzymes into a maize plant cell; (d) optionally, when one of the site-specific genome modification enzymes of step (c) is an RNA-guided endonuclease, introducing a guide RNA into a maize plant cell; or (e) optionally, when one of the site-specific genome modification enzymes of step (c) is an DNA-guided endonuclease, introducing a guide DNA into a maize plant cell; (e) introducing the at least one DNA of interest into the maize plant cell; (f) integrating the at least one DNA of interest proximal to two or more target sites for the site-specific genome modification enzymes in a maize B chromosome genomic locus; and (g) selecting transgenic plant cells comprising at least one of the DNA of interest integrated into at least one of the target sites of the maize B chromosome genomic locus. Several embodiments relate to a method of making a maize plant cell comprising a recombinant nucleic acid with two or more DNA of interest integrated in a B chromosome, the method comprising: (a) selecting two or more target sites in a maize B chromosome genomic locus having at least 90% sequence identity from the group consisting of SEQ ID NOs: 10-13, 16, 19, 21, 22, 24, 25, 32, 34, 38, 40-45, 17-49, 55, 56, 60, 62, 64, 65, 68, 70, 72, 73, 75-79, 81, 83-86, 88-92, 94, 95, 98, 100, 102, 103, 107, 108, 110-112, 114, 116-118, 121, 123, 124, 126, 129-133, 135, 137, 138, 140-150, 154-159, 162-166, 168, 171-180, 183-197, 200-212, 214, 215, 217, 218, 220, 222-225, 228-232, 234-236, 238-241, 243, 244, 247, 249, 251, 253, 254, 256-258, 260-266, 269, 270, 273, 275-279, 281-295, 299, 301, 302, 304-316, 318-320, 322, 323, 325, 327-329, 331-335, 338-344, 346, 347, 349-354, 357-360, 363, 365, 366-373, 375-379, 381, 383, 384, 386-388, 391, 392, 395-398, 400-404, 406-412, 415, 416, 418-420, 422, 423, 428-433, 435-441, 443-446, 448-450, 452, 456-459, 461-464, 466-475, 478, 479, 481-484, 486, 487, 490-495, 497-499, 501-503, 505-508, 510-513, 517-520, 524, 525, 527-529, 531-543, 545-547, 549-554, 556-560, 563-577, 579-584, 586-593, 595, 596, 598-609, 611-614, 616-619, 621-624, 626, 627, 629-636, 638-640, 643-652, 655, 657-661, 663, 664, 666-668, 670-674, 676-680, 683-688, 690-701, 703, 705-708, 711-717, 719-729, 731-734, 736-738, 740, 741, 743-748, 750, 752-764, 766, 767, 770, 771, 773, 774, 776-785, 787-791, and 793-888; (b) selecting one or more site specific genome modification enzymes that specifically bind and cleave the two or more target sites in the maize B chromosome genomic locus; (c) introducing the site specific genome modification enzymes into a maize plant cell; (d) optionally, when one of the site-specific genome modification enzymes of step (c) is an RNA-guided endonuclease, introducing a guide RNA into a maize plant cell; or (e) optionally, when one of the site-specific genome modification enzymes of step (c) is an DNA-guided endonuclease, introducing a guide DNA into a maize plant cell; (e) introducing the two or more DNA of interest into the maize plant cell; (f) integrating the two or more DNA of interest proximal to two or more target sites for the site-specific genome modification enzymes in a maize B chromosome genomic locus; and (g) selecting transgenic plant cells comprising at least one of the DNA of interest integrated into at least one of the target sites of the maize B chromosome genomic locus. In some embodiments, the site-specific genome modification enzyme is an endonuclease. In some embodiments, the site-specific genome modification enzyme is a recombinase. In some embodiments, the site-specific genome modification enzyme is a transposase. In some embodiments, the site-specific genome modification enzyme is a helicase. In some embodiments, the site-specific genome modification enzyme is any combination of an endonuclease, a recombinase, a transposase and a helicase. In some embodiments, the target site is specific for maize B chromosome sequence. In a further embodiment, the target site is specific for maize B chromosome sequence is selected from one or more of the group comprising SEQ ID NOs: 10-13, 16, 19, 21, 22, 24, 25, 32, 34, 38, 40-45, 17-49, 55, 56, 60, 62, 64, 65, 68, 70, 72, 73, 75-79, 81, 83-86, 88-92, 94, 95, 98, 100, 102, 103, 107, 108, 110-112, 114, 116-118, 121, 123, 124, 126, 129-133, 135, 137, 138, 140-150, 154-159, 162-166, 168, 171-180, 183-197, 200-212, 214, 215, 217, 218, 220, 222-225, 228-232, 234-236, 238-241, 243, 244, 247, 249, 251, 253, 254, 256-258, 260-266, 269, 270, 273, 275-279, 281-295, 299, 301, 302, 304-316, 318-320, 322, 323, 325, 327-329, 331-335, 338-344, 346, 347, 349-354, 357-360, 363, 365, 366-373, 375-379, 381, 383, 384, 386-388, 391, 392, 395-398, 400-404, 406-412, 415, 416, 418-420, 422, 423, 428-433, 435-441, 443-446, 448-450, 452, 456-459, 461-464, 466-475, 478, 479, 481-484, 486, 487, 490-495, 497-499, 501-503, 505-508, 510-513, 517-520, 524, 525, 527-529, 531-543, 545-547, 549-554, 556-560, 563-577, 579-584, 586-593, 595, 596, 598-609, 611-614, 616-619, 621-624, 626, 627, 629-636, 638-640, 643-652, 655, 657-661, 663, 664, 666-668, 670-674, 676-680, 683-688, 690-701, 703, 705-708, 711-717, 719-729, 731-734, 736-738, 740, 741, 743-748, 750, 752-764, 766, 767, 770, 771, 773, 774, 776-785, 787-791, and 793-888. In some embodiments, the site-specific genome modification enzyme is an endonuclease selected from a meganuclease, a zinc finger nuclease, a transcription activator-like effector nuclease (TALEN), an Argonaute, a DNA-guided recombinase, a DNA-guided endonuclease, an RNA-guided recombinase, an RNA-guided endonuclease, a type I CRISPR-Cas system, type II CRISPR-Cas system and a type III CRISPR-Cas system. In some embodiments, the endonuclease is selected from the group comprising Cpf1, Cas1, Cas1B, Cas2, Cas3, Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, and Csf4 nuclease. In some embodiments, the site-specific genome modification enzyme is an RNA-guided recombinase. In some embodiments, the site-specific genome modification enzyme is a fusion protein comprising a recombinase and a CRISPR associated protein. In some embodiments, the recombinase is a tyrosine recombinase attached to a DNA recognition motif, or a serine recombinase attached to a DNA recognition motif. In some embodiments, the recombinase is a Cre recombinase, a Flp recombinase, and a Tnp1 recombinase, a PhiC31 integrase, an R4 integrase, or a TP-901 integrase. In some embodiments, transposase is a DNA transposase attached to a DNA binding domain. In some embodiments, two or more of the DNA of interest are the same. In some embodiments, two or more of the DNA of interest are not the same. In some embodiments, the DNA of interest does not encode a peptide. In some embodiments, the DNA of interest does encode a peptide. In some embodiments, the DNA of interest comprises one or more gene expression cassettes. In some embodiments, the gene expression cassette is selected from the group comprising an insecticidal resistance gene expression cassette, an herbicide tolerance gene expression cassette, a nitrogen use efficiency gene expression cassette, a water use efficiency gene expression cassette, a nutritional quality gene expression cassette, a DNA binding gene expression cassette, a selectable marker gene expression cassette, an RNAi construct expression cassette, a site-specific genome modification enzyme gene expression cassette, an expression cassette encoding a recombinant guide RNA of an RNA-guided endonuclease, or an expression cassette encoding a recombinant DNA guide. In some embodiments, the site-specific genome modification enzyme is stably transformed into the maize plant cell. In some embodiments, the site-specific genome modification enzyme is transiently transformed into the maize plant cell. In some embodiments, the site-specific genome modification enzyme is constitutively expressed in the maize plant cell. In some embodiments, the site-specific genome modification enzyme is expressed in the maize plant cell under the control of a regulatable promoter. In some embodiments, the regulatable promoter is a heat shock promoter, a tissue specific promoter, or a chemically inducible promoter. In some embodiments, the DNA of interest is integrated into the target site of the maize B chromosome via a homology directed repair integration method. In some embodiments, the DNA of interest is integrated into the target site of the maize B chromosome via a non-homologous end joining integration method. In some embodiments, two or more of the maize B chromosome target site sequences each comprise an integrated DNA of interest to produce two or more recombinant sequences. In some embodiments, the two or more recombinant sequences are located on the same B chromosome. In some embodiments, the two or more recombinant sequences are located on different B chromosomes. In some embodiments, the two or more recombinant sequences are located on different B chromosomes which, during cell division, recombine to generate a new megalocus on a new B chromosome. In some embodiments, the DNA of interest and/or the maize B chromosome target site sequences are modified during integration of the DNA of interest into the target site of the maize B chromosome sequence. In some embodiments, the recombinant nucleic acid is present in a maize plant, a maize plant part, a maize seed, or a maize plant cell.

In some embodiments, probes specific for the maize B chromosome sequence selected from the group consisting of SEQ ID NOs: 10-13, 16, 19, 21, 22, 24, 25, 32, 34, 38, 40-45, 17-49, 55, 56, 60, 62, 64, 65, 68, 70, 72, 73, 75-79, 81, 83-86, 88-92, 94, 95, 98, 100, 102, 103, 107, 108, 110-112, 114, 116-118, 121, 123, 124, 126, 129-133, 135, 137, 138, 140-150, 154-159, 162-166, 168, 171-180, 183-197, 200-212, 214, 215, 217, 218, 220, 222-225, 228-232, 234-236, 238-241, 243, 244, 247, 249, 251, 253, 254, 256-258, 260-266, 269, 270, 273, 275-279, 281-295, 299, 301, 302, 304-316, 318-320, 322, 323, 325, 327-329, 331-335, 338-344, 346, 347, 349-354, 357-360, 363, 365, 366-373, 375-379, 381, 383, 384, 386-388, 391, 392, 395-398, 400-404, 406-412, 415, 416, 418-420, 422, 423, 428-433, 435-441, 443-446, 448-450, 452, 456-459, 461-464, 466-475, 478, 479, 481-484, 486, 487, 490-495, 497-499, 501-503, 505-508, 510-513, 517-520, 524, 525, 527-529, 531-543, 545-547, 549-554, 556-560, 563-577, 579-584, 586-593, 595, 596, 598-609, 611-614, 616-619, 621-624, 626, 627, 629-636, 638-640, 643-652, 655, 657-661, 663, 664, 666-668, 670-674, 676-680, 683-688, 690-701, 703, 705-708, 711-717, 719-729, 731-734, 736-738, 740, 741, 743-748, 750, 752-764, 766, 767, 770, 771, 773, 774, 776-785, 787-791, and 793-888 are developed. In some embodiments, the probes are generated by PCR amplification. In some embodiments, the PCR primers are selected from the group consisting of SEQ ID NO:889-894. In some embodiments, the PCR primers are used for mapping of maize B Chromosome/A Chromosome translocations. In some embodiments, the maize B chromosome sequence is used to develop maize B chromosome markers. In some embodiments, the maize B chromosome sequence is used to identify flanking sequence of transgenes integrated into a B chromosome.

Several embodiments relate to a method of identifying a sequence unique to corn B chromosome including one or more of the steps: (1) identifying a corn plant with a high copy number of B chromosome; (2) preparing DNA from tissue collected from the plant of step 1; (3) preparing a fosmid library with the DNA from step 2 and aliquot into pools; (3) sequencing the pooled fosmid library; (4) using bioinformatic analysis to extract sequence unique to corn B chromosome. In some embodiments, the corn plant with a high copy number of B chromosome is selected from a plant with 1, 2, 3, 4, 5, 6, 7, 8, 8, 10, 11, 12, 13, 14, 15, 16, 17, 18, 19, 20, or more B chromosomes. In some embodiments, bioinformatic analysis is includes: (1) extracting good quality, usable sequence of the fosmid pooled library; (2) assembling the sequence reads from step 1 into individual pool contigs; (3) analyzing and masking the individual pool contigs from step 2 for (a) known corn A chromosome non-repeat sequence from a reference corn genome assembly, (b) for known corn mitochondrial DNA sequence in a reference corn genome assembly, (c) for known corn chloroplast DNA sequence in a reference corn genome assembly; and (d) for *E. coli* and/or fosmid vector sequences; (4) analyzing the pooled sequence from step (3) against one-another to identify B chromosome repeat sequence or to filter out corn A chromosome sequence which is not in the corn reference genome assembly; and (4) comparing the resulting sequences to identify the longest representative sequence for each contig, and assembling longest contig from overlapping contigs. In further embodiments, long-read sequence is generated from the corn B chromosome DNA using single molecule, real-time sequencing technology to generate a high-quality, contiguous assembly of the genomic sequence. In further embodiments, the corn B chromosome contig assembly from the fosmid library analysis and the long-read sequence are combined to generate an assembly of unique B chromosome sequence.

DETAILED DESCRIPTION

While maize B chromosomes have been studied for many decades, a comprehensive assembly of unique maize B chromosome sequence has not been available. The present disclosure provides unique maize B chromosome sequences useful for the development of probes for B chromosome mapping, the development of B chromosome genomic markers, and identification of loci for site specific integration of a DNA of interest into B chromosomes.

Several embodiments described herein relate to methods for identifying unique maize B chromosome sequences. Such unique maize B chromosome sequences are useful for developing site-specific targeted integration of a DNA of interest at a single locus, integration two or more DNA of interest at separate loci, integration of two or more DNA of interest at a single locus, or integration of two or more DNA of interest at two or more loci. The integration of two or more DNA of interest at separate but linked loci is also known as "stacking".

Unless defined otherwise, all technical and scientific terms used have the same meaning as commonly understood by one of ordinary skill in the art to which this disclosure belongs. Where a term is provided in the singular, the inventors also contemplate aspects of the disclosure described by the plural of that term. Where there are discrepancies in terms and definitions used in references that are incorporated by reference, the terms used in this application shall have the definitions given herein. Other technical terms used have their ordinary meaning in the art in which they are used, as exemplified by various art-specific dictionaries, for example, "The American Heritage® Science Dictionary" (Editors of the American Heritage Dictionaries, 2011, Houghton Mifflin Harcourt, Boston and New York), the "McGraw-Hill Dictionary of Scientific and Technical Terms" (6th edition, 2002, McGraw-Hill, New York), or the "Oxford Dictionary of Biology" (6th edition, 2008, Oxford University Press, Oxford and New York). The inventors do not intend to be limited to a mechanism or mode of action. Reference thereto is provided for illustrative purposes only.

The practice of the present disclosure employs, unless otherwise indicated, conventional techniques of biochemistry, chemistry, molecular biology, microbiology, cell biology, genomics and biotechnology, which are within the skill of the art. See Green and Sambrook, MOLECULAR CLONING: A LABORATORY MANUAL, 4th edition (2012); CURRENT PROTOCOLS IN MOLECULAR BIOLOGY (F. M. Ausubel, et al. eds., (1987)); the series METHODS IN ENZYMOLOGY (Academic Press, Inc.); PCR 2: A PRACTICAL APPROACH (M. J. MacPherson, B. D. Hames and G. R. Taylor eds. (1995)); Harlow and Lane, eds. (1988) ANTIBODIES, A LABORATORY MANUAL; ANIMAL CELL CULTURE (R. I. Freshney, ed. (1987)); RECOMBINANT PROTEIN PURIFICATION: PRINCIPLES AND METHODS, 18-1142-75, GE Healthcare Life Sciences; C. N. Stewart, A. Touraev, V. Citovsky, T. Tzfira eds. (2011) PLANT TRANSFORMATION TECHNOLOGIES (Wiley-Blackwell); and R. H. Smith (2013) PLANT TISSUE CULTURE. TECHNIQUES AND EXPERIMENTS (Academic Press, Inc.).

Any references cited herein are incorporated by reference in their entireties.

As used herein, the singular form "a," "an," and "the" include plural references unless the context clearly dictates otherwise. Thus, for example, reference to "plant," "the plant," or "a plant" also includes a plurality of plants; also, depending on the context, use of the term "plant" can also include genetically similar or identical progeny of that plant; use of the term "a nucleic acid" optionally includes, as a practical matter, many copies of that nucleic acid molecule; similarly, the term "probe" optionally (and typically) encompasses many similar or identical probe molecules.

As used herein, "plant" refers to a whole plant or a cell or tissue culture derived from a plant, comprising any of: whole plants, plant components or organs (e.g., leaves, stems, roots, etc.), plant tissues, seeds, plant cells, and/or progeny of the same. A progeny plant can be from any filial generation, e.g., $F_1$, $F_2$, $F_3$, $F_4$, $F_5$, $F_6$, $F_7$, etc. A plant cell is a biological cell of a plant, taken from a plant or derived through culture from a cell taken from a plant. Plant parts include harvestable parts and parts useful for propagation of progeny plants. Plant parts useful for propagation include, for example and without limitation: seed; fruit; a cutting; a seedling; a tuber; and a rootstock. A harvestable part of a plant may be any useful part of a plant, including, for example and without limitation: flower; pollen; seedling; tuber; leaf; stem; fruit; seed; and root. Plant cells, as used herein, includes protoplasts and protoplasts with a cell wall. A plant cell may be a protoplast, a gamete producing cell, or a cell or collection of cells that can regenerate into a whole plant.

As used herein, the term "about" indicates that a value includes the inherent variation of error for the method being employed to determine a value, or the variation that exists among experiments.

As used herein, "corn" and "maize" interchangeably refer to *Zea mays* L and includes all plant varieties that can be bred with corn, including wild maize species. As used herein, "corn" and "maize" can be used interchangeably.

As used herein, rye refers to *Secale cereale*.

In an aspect, a maize plant or seed provided in this disclosure is *Zea mays* L. In another aspect, a maize plant or seed provided in this disclosure is *Zea mays* ssp. mays. In yet another aspect, a maize plant or seed provided herein is a domesticated line or variety.

As used herein, the term "B chromosome" refers to an extra, or supernumerary chromosome. B chromosomes are found in addition to the normal diploid complement of chromosomes in a cell. In maize, the normal diploid complement of chromosomes is 20. The normal chromosomes can be called "A chromosomes." B chromosomes are dispensable and not required for normal development. When two B chromosomes are present in a single plant, the two B chromosomes will pair with each other at meiotic prophase and recombination can occur. B chromosomes do not pair with the A chromosomes.

In one aspect, methods of this disclosure incorporate DNAs of interest into a supernumerary chromosome. In some embodiments, methods of this disclosure incorporate DNAs of interest into a maize B chromosome sequence selected from the group consisting of SEQ ID NOs: 10-13, 16, 19, 21, 22, 24, 25, 32, 34, 38, 40-45, 17-49, 55, 56, 60, 62, 64, 65, 68, 70, 72, 73, 75-79, 81, 83-86, 88-92, 94, 95, 98, 100, 102, 103, 107, 108, 110-112, 114, 116-118, 121, 123, 124, 126, 129-133, 135, 137, 138, 140-150, 154-159, 162-166, 168, 171-180, 183-197, 200-212, 214, 215, 217, 218, 220, 222-225, 228-232, 234-236, 238-241, 243, 244, 247, 249, 251, 253, 254, 256-258, 260-266, 269, 270, 273, 275-279, 281-295, 299, 301, 302, 304-316, 318-320, 322, 323, 325, 327-329, 331-335, 338-344, 346, 347, 349-354, 357-360, 363, 365, 366-373, 375-379, 381, 383, 384, 386-388, 391, 392, 395-398, 400-404, 406-412, 415, 416, 418-420, 422, 423, 428-433, 435-441, 443-446, 448-450, 452, 456-459, 461-464, 466-475, 478, 479, 481-484, 486, 487, 490-495, 497-499, 501-503, 505-508, 510-513, 517-520, 524, 525, 527-529, 531-543, 545-547, 549-554, 556-560, 563-577, 579-584, 586-593, 595, 596, 598-609, 611-614, 616-619, 621-624, 626, 627, 629-636, 638-640, 643-652, 655, 657-661, 663, 664, 666-668, 670-674, 676-680, 683-688, 690-701, 703, 705-708, 711-717, 719-729, 731-734, 736-738, 740, 741, 743-748, 750, 752-764, 766, 767, 770, 771, 773, 774, 776-785, 787-791, and 793-888.

One or more B chromosomes, according to certain aspects of the present disclosure, can be delivered to a progeny plant without the rest of the genome (e.g., via a haploid induction cross that retains the B chromosome), allowing complete conversion to a new variety in a single cross. In other aspects, a B chromosome may be transferred to other species, allowing testing of the DNA of interest or DNAs of interest in other crops. For example, transmission of a B chromosome to oat has been demonstrated (Koo et al., Genome Research 21(6):908-914, 2011), as well as transmission of a corn chromosome to wheat (Comeau et al., Plant Science 81(1):117-125, 1992).

In certain cases, such as in corn and rye, B chromosomes have "accumulation mechanisms" that allow them to transmit at greater than Mendelian frequencies. For example, in corn, the sister chromatids of the B chromosome fail to separate during the second pollen (first generative) division. As a result, both sister chromatids are delivered to one of the pollen cells, while the other pollen cell receives neither. This effect, called non-disjunction, means that a plant with only a single B chromosome can deliver two B chromosomes to the next generation when used as a male. Such an effect may be desirable during the trait introgression process, since it allows individuals that are homozygous (as opposed to hemizygous) for a megalocus carried on a B chromosome to be recovered in a backcross, as long as the B chromosome is delivered from the pollen.

The non-disjunction effect requires that specific portions of the B chromosome be present. A trans-acting piece at the tip of the long arm and a cis-acting piece near the centromere are required. Very small deletions at the tip of the long arm of the B chromosome are recoverable and the resulting B chromosomes do not exhibit non-disjunction. In certain embodiments of the disclosure, such a deletion variant of the B chromosome may be desired, for instance, for the purpose of delivering a megalocus for commercial traits. In other embodiments, non-disjunction may be desired, for instance, for the purpose of transiently delivering one or more site-specific genome modification enzymes that modify one or more target sequences in the A genome to produce one or more gene edits or transgene insertions and where the B chromosomes comprising the one or more site-specific genome modification enzymes are lost in subsequent generations.

Several embodiments relate to the use of B chromosomes to rapidly transfer the haploid induction effect to new lines. Because the B chromosome can be retained at a low percentage, a line where the haploid induction effect is caused by the B chromosome may allow the effect to be moved to additional lines by a single cross. This simplifies creation of new haploid induction lines with desired agronomic or genetic properties. Genetic elements disclosed in U.S. Patent Application 62/375,618 (titled Compositions and Methods for Plant Haploid Induction, filed Aug. 16, 2016) can be incorporated into a the unique B chromosome sequences described herein to produce plants containing the haploid inducing B chromosome (HI-B chromosome). The disclosure of U.S. Patent Application 62/375,618 is incorporated by reference herein in its entirety. Other haploid induction genes, e.g. the CENH3-based transgenes (Kelliher, T et al., "Maternal Haploids Are Preferentially Induced by CENH3-tailswap Transgenic Complementation in Maize", Frontiers in Plant Science 7: 414 (2016)) can also be incorporated into the unique B chromosome sequences as described herein to produce plants containing HI-B chromosome. To move the haploid induction effect to new lines, a line containing HI-B chromosome is crossed to the desired line and progeny are screened for cases that are haploid and that have retained the HI-B chromosome.

In an aspect, a B chromosome provided herein is a maize B chromosome. In an aspect, a maize B chromosome sequence or maize B chromosome genomic loci provided herein is selected from the group consisting of SEQ ID NOs: 10-13, 16, 19, 21, 22, 24, 25, 32, 34, 38, 40-45, 17-49, 55, 56, 60, 62, 64, 65, 68, 70, 72, 73, 75-79, 81, 83-86, 88-92, 94, 95, 98, 100, 102, 103, 107, 108, 110-112, 114, 116-118, 121, 123, 124, 126, 129-133, 135, 137, 138, 140-150, 154-159, 162-166, 168, 171-180, 183-197, 200-212, 214, 215, 217, 218, 220, 222-225, 228-232, 234-236, 238-241, 243, 244, 247, 249, 251, 253, 254, 256-258, 260-266, 269, 270, 273, 275-279, 281-295, 299, 301, 302, 304-316, 318-320, 322, 323, 325, 327-329, 331-335, 338-344, 346, 347, 349-354, 357-360, 363, 365, 366-373, 375-379, 381, 383, 384, 386-388, 391, 392, 395-398, 400-404, 406-412, 415, 416, 418-420, 422, 423, 428-433, 435-441, 443-446, 448-450, 452, 456-459, 461-464, 466-475, 478, 479, 481-484, 486, 487, 490-495, 497-499, 501-503, 505-508, 510-513, 517-520, 524, 525, 527-529, 531-543, 545-547, 549-554, 556-560, 563-577, 579-584, 586-593, 595, 596, 598-609, 611-614, 616-619, 621-624, 626, 627, 629-636, 638-640, 643-652, 655, 657-661, 663, 664, 666-668, 670-674, 676-680, 683-688, 690-701, 703, 705-708, 711-717, 719-729, 731-734, 736-738, 740, 741, 743-748, 750, 752-764, 766, 767, 770, 771, 773, 774, 776-785, 787-791, and 793-888. In an aspect, a B chromosome provided herein undergoes non-disjunction. In an aspect, a B chromosome provided herein undergoes non-disjunction in a pollen cell. In another aspect, a B chromosome provided herein accumulates in a non-Mendelian manner. In an aspect, a B chromosome provided herein is truncated. In an aspect, a B chromosome provided herein can comprise one or more DNA of interest. In another aspect, a B chromosome provided herein can be used in any method provided herein. In an aspect, a B chromosome provided herein is heterogeneous. In an aspect, a B chromosome provided herein is a univalent during meiosis. In an aspect, a B chromosome provided herein pairs with a second B chromosome during meiosis. In an aspect, a B chromosome provided herein pairs with a second B chromosome during meiosis, and the first and second B chromosomes recombine creating a new B chromosome. In an aspect, a B chromosome provided herein comprises at least one, at least two, at least three, at least four, at least five, at least six, at least seven, at least eight, at least nine, or at least ten target sites for site-specific genome modification enzymes. In an aspect, a B chromosome provided herein comprises a translocation between a B chromosome and an A chromosome, where the B chromosome comprises a B chromosome centromere. In an aspect, a first B chromosome provided herein has at least 50%, at least 60%, at least 70%, at least 80%, at least 90%, at least 91%, at least 92%, at least 93%, at least 94%, at least 95%, at least 96%, at least 97%, at least 98%, at least 99%, at least 99.5%, or 100% sequence identity with a second B chromosome.

In an aspect, a plant cell provided herein can comprise one or more, two or more, three or more, four or more, five or more, six or more, seven or more, eight or more, nine or more, ten or more, fifteen or more, twenty or more, or twenty-five or more B chromosomes.

The methods described herein can be applied to extract unique B chromosome sequences of sufficient length to provide gene targeting to multiple sites, and to enable B chromosome marker development. For example, unique sequences can be used for site directed genome modification applications, including site-specific integration of a DNA of interest. The methods described herein can be applied to any genome with B chromosomes that uses a pooled bacterial artificial chromosome (BAC), a fosmid sequencing strategy, or a single molecule real time sequencing strategy.

Sequences disclosed herein can also be used to create gene editing tools to make truncated B chromosomes with altered transmission properties, which would be useful in a 1-cross trait integration strategy. Sequences disclosed herein can also be used to identify polymorphisms among different B chromosome sources, and such polymorphisms can be used to construct a genetic recombination map of the B chromosome. Sequences disclosed herein can also be used as FISH probes or in other physical mapping strategies (B-A translocation mapping) to localize sequence contigs relative to each other and other landmarks on the B chromosome (centromere, telomere, published B repeats, etc).

As used herein, "recombinant sequence" and "recombinant nucleic acid sequence" are used interchangeably.

As used herein, "inserted" and "integrated" are used interchangeably.

In some embodiments, a DNA of interest may be a transgene. In some embodiments, a DNA of interest may be a DNA molecule that is "cis-genic", which refers to a DNA sequence from the crop plant itself or from a sexually compatible donor plant. In some embodiments, a DNA of interest may comprise one or more "transgenes", where a transgene is a DNA sequence not naturally found in the maize B chromosome.

In an aspect, this disclosure provides one or more, two or more, three or more, four or more, five or more, six or more, seven or more, eight or more, nine or more, ten or more, fifteen or more, twenty or more, or twenty-five or more recombinant nucleic acid sequences comprising a nucleic acid sequence of at least 25 base pairs, at least 50 base pairs, at least 100 base pairs, at least 250 base pairs, at least 500 base pairs, at least 1000 base pairs (1 Kb), at least 1500 base pairs (1.5 Kb), at least 2000 base pairs (2 Kb), at least 2500 base pairs (2.5 Kb), at least 3000 base pairs (3 Kb), at least 3500 base pairs (3.5 Kb), at least 4000 base pairs (4 Kb), at least 4500 base pairs (4.5 Kb), at least 5000 base pairs (5 Kb), at least 5500 base pairs (5.5 Kb), at least 6000 base pairs (6 Kb), at least 6500 base pairs (6.5 Kb), at least 7000 base pairs (7 Kb), at least 7500 base pairs (7.5 Kb), at least 8000 base pairs (8 Kb), at least 8500 base pairs (8.5 Kb), at least 9000 base pairs (9 Kb), at least 9500 base pairs (9.5 Kb), or at least 10,000 base pairs (10 Kb) that has at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, or 100% sequence identity with a sequence selected from the group consisting of SEQ ID NOs: 10-13, 16, 19, 21, 22, 24, 25, 32, 34, 38, 40-45, 17-49, 55, 56, 60, 62, 64, 65, 68, 70, 72, 73, 75-79, 81, 83-86, 88-92, 94, 95, 98, 100, 102, 103, 107, 108, 110-112, 114, 116-118, 121, 123, 124, 126, 129-133, 135, 137, 138, 140-150, 154-159, 162-166, 168, 171-180, 183-197, 200-212, 214, 215, 217, 218, 220, 222-225, 228-232, 234-236, 238-241, 243, 244, 247, 249, 251, 253, 254, 256-258, 260-266, 269, 270, 273, 275-279, 281-295, 299, 301, 302, 304-316, 318-320, 322, 323, 325, 327-329, 331-335, 338-344, 346, 347, 349-354, 357-360, 363, 365, 366-373, 375-379, 381, 383, 384, 386-388, 391, 392, 395-398, 400-404, 406-412, 415, 416, 418-420, 422, 423, 428-433, 435-441, 443-446, 448-450, 452, 456-459, 461-464, 466-475, 478, 479, 481-484, 486, 487, 490-495, 497-499, 501-503, 505-508, 510-513, 517-520, 524, 525, 527-529, 531-543, 545-547, 549-554, 556-560, 563-577, 579-584, 586-593, 595, 596, 598-609, 611-614, 616-619, 621-624, 626, 627, 629-636, 638-640, 643-652, 655, 657-661, 663, 664, 666-668, 670-674, 676-680, 683-688, 690-701, 703, 705-708, 711-717, 719-729, 731-734, 736-738, 740, 741, 743-748, 750, 752-764, 766, 767, 770, 771, 773, 774, 776-785, 787-791, and 793-888, and one or more, two or more, three or more, four or more, five or more, six or more, seven or more, eight or more, nine or more, ten or more, fifteen or more, twenty or more, or twenty-five or more DNAs of interest that can be integrated into a maize B chromosome nucleic acid sequence to produce the recombinant nucleic acid sequence. In another aspect, a recombinant nucleic acid sequence provided herein is integrated into a target site for a site-specific genome modification enzyme where the target site is specific for the maize B chromosome DNA sequence. In yet another aspect, a recombinant nucleic acid sequence provided herein is integrated between two target sites for a site-specific genome modification enzyme, where the target site is specific for the maize B chromosome DNA sequence. In another aspect, one or more, two or more, three or more, four or more, five or more, six or more, seven or more, eight or more, nine or more, ten or more, fifteen or more, or twenty or more DNAs of interest are integrated into one or more, two or more, three or more, four or more, five or more, six or more, seven or more, eight or more, nine or more, ten or more, fifteen or more, or twenty or more target sites for a site-specific genome modification enzyme, where the target site is specific for the maize B chromosome DNA sequence. In an aspect, a recombinant nucleic acid provided herein comprises a DNA of interest that encodes a peptide. In another aspect, recombinant nucleic acid provided herein comprises a DNA of interest that does not encode a peptide. In some embodiments, a recombinant nucleic acid provided herein comprises a DNA of interest that encodes one or more site specific DNA modification enzyme. In some embodiments, a recombinant nucleic acid provided herein comprises a DNA of interest that encodes one or more guide RNAs and/or a tracr RNAs. In some embodiments, a recombinant nucleic acid provided herein comprises a DNA of interest that encodes an siRNA. In some embodiments, a recombinant nucleic acid provided herein comprises a DNA of interest that encodes a microRNA.

In an aspect, this disclosure provides one or more, two or more, three or more, four or more, five or more, six or more, seven or more, eight or more, nine or more, ten or more, fifteen or more, twenty or more, or twenty-five or more recombinant nucleic acid sequences comprising one or more, two or more, three or more, four or more, five or more, six or more, seven or more, eight or more, nine or more, ten or more, fifteen or more, twenty or more, or twenty-five or more DNAs of interest integrated into one B chromosome. In another aspect, this disclosure provides one or more, two or more, three or more, four or more, five or more, six or more, seven or more, eight or more, nine or more, ten or more, fifteen or more, twenty or more, or twenty-five or more recombinant nucleic acid sequences comprising one or more, two or more, three or more, four or more, five or more, six or more, seven or more, eight or more, nine or more, ten or more, fifteen or more, twenty or more, or twenty-five or more DNAs of interest integrated into two or more, three or more, four or more, five or more, six or more, seven or more, eight or more, nine or more, or ten or more B chromosomes.

In an aspect, a DNA of interest provided herein is modified during integration into a B chromosome sequence. In another aspect, a DNA of interest provided herein is not modified during integration into a B chromosome. In an aspect, a B chromosome sequence provided herein is modified when a DNA of interest provided herein integrates into it. In another aspect, a B chromosome sequence provided herein is not modified when a DNA of interest provided herein integrates into it. In some embodiments, the DNA of interest comprises a nucleic acid sequence of at least 5 base pairs, at least 10 base pairs, at least 15 base pairs, at least 20 base pairs, at least 25 base pairs, at least 50 base pairs, at least 100 base pairs, at least 125 base pairs, at least 150 base pairs, at least 200 base pairs, at least 250 base pairs, at least 500 base pairs, at least 1000 base pairs (1 Kb), at least 1500 base pairs (1.5 Kb), at least 2000 base pairs (2 Kb), at least 2500 base pairs (2.5 Kb), at least 3000 base pairs (3 Kb), at least 3500 base pairs (3.5 Kb), that has at least 90%, at least 91%, at least 92%, at least 93%, at least 94%, at least 95%, at least 96%, at least 97%, at least 98%, at least 99%, at least 99.5%, or 100% sequence identity with a portion of sequence selected from the group consisting of SEQ ID NOs: 10-13, 16, 19, 21, 22, 24, 25, 32, 34, 38, 40-45, 17-49, 55, 56, 60, 62, 64, 65, 68, 70, 72, 73, 75-79, 81, 83-86, 88-92, 94, 95, 98, 100, 102, 103, 107, 108, 110-112, 114, 116-118, 121, 123, 124, 126, 129-133, 135, 137, 138, 140-150, 154-159, 162-166, 168, 171-180, 183-197, 200-212, 214, 215, 217, 218, 220, 222-225, 228-232, 234-236, 238-241, 243, 244, 247, 249, 251, 253, 254, 256-258, 260-266, 269, 270, 273, 275-279, 281-295, 299, 301, 302, 304-316, 318-320, 322, 323, 325, 327-329, 331-335, 338-344, 346, 347, 349-354, 357-360, 363, 365, 366-373, 375-379, 381, 383, 384, 386-388, 391, 392, 395-398, 400-404, 406-412, 415, 416, 418-420, 422, 423, 428-433, 435-441, 443-446, 448-450, 452, 456-459, 461-464, 466-475, 478, 479, 481-484, 486, 487, 490-495, 497-499, 501-503, 505-508, 510-513, 517-520, 524, 525, 527-529, 531-543, 545-547, 549-554, 556-560, 563-577, 579-584, 586-593, 595, 596, 598-609, 611-614, 616-619, 621-624, 626, 627, 629-636, 638-640, 643-652, 655, 657-661, 663, 664, 666-668, 670-674, 676-680, 683-688, 690-701, 703, 705-708, 711-717, 719-729, 731-734, 736-738, 740, 741, 743-748, 750, 752-764, 766, 767, 770, 771, 773, 774, 776-785, 787-791, and 793-888 to promote homologous recombination between the B chromosome and the DNA of interest.

In some embodiments, the DNA of interest may comprise a modified nucleic acid sequence. As used herein, a "modified" nucleic acid sequence comprises one or more nucleotide insertions, substitutions, deletions, duplications, or inversions.

As used herein a "nucleic acid of interest", "DNA of interest", or "donor" is defined as a nucleic acid/DNA sequence that has been selected for site directed, targeted insertion into the maize genome. A nucleic acid of interest can be of any length, for example between 2 and 50,000 nucleotides in length (or any integer value therebetween or thereabove), or between about 1,000 and 5,000 nucleotides in length (or any integer value therebetween). A DNA of interest may comprise one or more gene expression cassettes that encode actively transcribed and/or translated gene sequences. In some embodiments, the DNA of interest may comprise a polynucleotide sequence which does not comprise a functional gene expression cassette or an entire gene (e.g., may simply comprise regulatory sequences such as a promoter), or may not contain any identifiable gene expression elements or any actively transcribed gene sequence. The DNA of interest may optionally contain an analytical domain. Upon integration of the DNA of interest into the maize genome, the integrated sequences are referred to as the "integrated DNA of interest" or "inserted DNA of interest". Further, the DNA of interest can be can be linear or circular, and can be single-stranded or double-stranded. It can be delivered to the cell as naked nucleic acid, as a complex with one or more delivery agents (e.g., liposomes, poloxamers, T-strand encapsulated with proteins, etc.) or contained in a bacterial or viral delivery vehicle, such as, for example, *Agrobacterium tumefaciens* or a geminivirus, respectively.

In an aspect, a DNA of interest provided herein can comprise at least one, at least two, at least three, at least four, at least five, at least six, at least seven, at least eight, at least nine, or at least ten genes. In an aspect, a DNA of interest provided herein comprises no genes. Without being limiting, a gene provided herein can include an insecticidal resistance gene, an herbicide tolerance gene, a nitrogen use efficiency gene, a water use efficiency gene, a nutritional quality gene, a DNA binding gene, a selectable marker gene, an RNAi construct, a site-specific genome modification enzyme gene, a recombinant guide RNA of a CRISPR/Cas9 system, a geminivirus based expression cassette, or a plant viral expression vector system. In an aspect, a gene provided herein comprises a promoter nucleic acid sequence. In another aspect, a structural gene provided herein does not comprise a promoter nucleic acid sequence.

Examples of suitable genes of agronomic interest envisioned by the present disclosure would include but are not limited to genes for disease, insect, or pest tolerance; herbicide tolerance; genes for quality improvements such as yield, nutritional enhancements, environmental or stress tolerances; or any desirable changes in plant physiology, growth, development, morphology or plant product(s) including starch production (U.S. Pat. Nos. 6,538,181; 6,538,179; 6,538,178; 5,750,876; 6,476,295); modified oils production (U.S. Pat. Nos. 6,444,876; 6,426,447; 6,380,462); high oil production (U.S. Pat. Nos. 6,495,739; 5,608,149; 6,483,008; 6,476,295); modified fatty acid content (U.S. Pat. Nos. 6,828,475; 6,822,141; 6,770,465; 6,706,950; 6,660,849; 6,596,538; 6,589,767; 6,537,750; 6,489,461; 6,459,018); high protein production (U.S. Pat. No. 6,380,466); fruit ripening (U.S. Pat. No. 5,512,466); enhanced animal and human nutrition (U.S. Pat. Nos. 6,723,837; 6,653,530; 6,541,259; 5,985,605; 6,171,640); or biopolymers (U.S. Pat. Nos. RE37,543; 6,228,623; 5,958,745 and U.S. Patent Publication No. US20030028917). Also environmental stress resistance (U.S. Pat. No. 6,072,103); pharmaceutical peptides and secretable peptides (U.S. Pat. Nos. 6,812,379; 6,774,283; 6,140,075; 6,080,560); improved processing traits (U.S. Pat. No. 6,476,295); improved digestibility (U.S. Pat. No. 6,531,648); low raffinose (U.S. Pat. No. 6,166,292); industrial enzyme production (U.S. Pat. No. 5,543,576); improved flavor (U.S. Pat. No. 6,011,199); nitrogen fixation (U.S. Pat. No. 5,229,114); hybrid seed production (U.S. Pat. No. 5,689,041); fiber production (U.S. Pat. Nos. 6,576,818; 6,271,443; 5,981,834; 5,869,720); and biofuel production (U.S. Pat. No. 5,998,700). Any of these or other genetic elements, methods, and transgenes can be used with the disclosure as will be appreciated by those of skill in the art in view of the instant disclosure.

A DNA of interest provided herein can also include sequences that encode for other sequences such as a messenger RNA (mRNA). An mRNA produced from a nucleic acid molecule of the present disclosure can contain a 5' untranslated (5'-UTR) leader sequence. This sequence can be derived from the promoter selected to express the gene and can be specifically modified so as to increase or decrease translation of the mRNA. A 5'-UTR can also be obtained from viral RNAs, from suitable eukaryotic genes, or from a synthetic gene sequence. Such "enhancer" sequences can be desirable to increase or alter the translational efficiency of the resultant mRNA. The present disclosure is not limited to constructs where the non-translated region is derived from both the 5'-UTR that accompanies the promoter sequence. Rather, the 5'-UTR sequence can be derived from unrelated promoters or genes (see, for example U.S. Pat. No. 5,362,865). Examples of non-translation leader sequences include maize and petunia heat shock protein leaders (U.S. Pat. No. 5,362,865), plant virus coat protein leaders, plant rubisco leaders, GmHsp (U.S. Pat. No. 5,659,122), PhDnaK (U.S. Pat. No. 5,362,865), AtAnt1, TEV (Carrington and Freed, *Journal of Virology*, (1990) 64: 1590-1597), and AGRtu.nos (GenBank Accession V00087; Bevan et al., *Nucleic Acids Research* (1983) 11:369-385). Other genetic components that serve to enhance expression or affect transcription or translational of a gene are also envisioned as genetic components.

A DNA of interest provided herein can further comprise a 3' untranslated region (3'-UTR) of a gene. The provided 3'-UTRs can contain a transcriptional terminator, or an element having equivalent function, and a polyadenylation signal that functions in plants to cause the addition of polyadenylated nucleotides to the 3' end of an RNA molecule. The DNA sequences are referred to herein as transcription-termination regions. The regions are required for efficient polyadenylation of mRNA. An RNA polymerase transcribes a coding DNA sequence through a site where polyadenylation occurs. Examples of suitable 3' regions are (1) the 3' transcribed, non-translated regions containing the polyadenylation signal of *Agrobacterium* Ti plasmid genes, such as the nopaline synthase (NOS; Fraley et al., *Proceedings of the National Academy of Sciences, USA* (1983) 80: 4803-4807) gene, and (2) plant genes such as the soybean storage protein genes and the small subunit of the ribulose-1,5-bisphosphate carboxylase (ssRUBISCO) gene. An example of a preferred 3' region is that from the ssRUBISCO E9 gene from pea (European Patent Application 0385 962).

In a DNA of interest provided herein can encode one or more site-specific genome modification enzymes. In some embodiments, one or more site-specific genome modification enzymes are selected from an endonuclease, a recombinase, a transposase, a helicase or any combination thereof. In a DNA of interest provided herein can encode one or more of a meganuclease, a zinc finger nuclease, a transcription activator-like effector nuclease (TALEN), an Argonaute, a DNA-guided recombinase, a DNA-guided endonuclease, an RNA-guided recombinase, an RNA-guided endonuclease, a type I CRISPR-Cas system, type II CRISPR-Cas system and a type III CRISPR-Cas system. In a DNA of interest provided herein can encode one or more of Cpf1, Cas1, Cas1B, Cas2, Cas3, Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, and Csf4 nuclease. In a DNA of interest provided herein can encode a dCas9-recombinase fusion protein. In a DNA of interest provided herein can encode one or more of a tyrosine recombinase, a serine recombinase, a Cre recombinase, a Flp recombinase, a Tnp1 recombinase, a PhiC31 integrase, an R4 integrase, or a TP-901 integrase. In a DNA of interest provided herein can encode one or more of a tracr RNA and/or a guide RNA.

In one aspect, a DNA of interest provided herein can encode a selectable, screenable, or scoreable marker gene. These genetic components are also referred to herein as functional genetic components, as they produce a product that serves a function in the identification of a transformed plant, or a product of agronomic utility. The DNA that serves as a selection or screening device can function in a regenerable plant tissue to produce a compound that would confer upon the plant tissue resistance to an otherwise toxic compound. A number of screenable or selectable marker genes are known in the art and can be used in the present disclosure. Genes of interest for use as a selectable, screenable, or scoreable marker would include, but are not limited, to β-glucuronidase (GUS), green fluorescent protein (GFP), luciferase (LUC), genes conferring tolerance to antibiotics like kanamycin (Dekeyser et al., *Plant Physiology* (1989) 90: 217-223) or spectinomycin (e.g. spectinomycin aminoglycoside adenyltransferase (aadA); U.S. Pat. No. 5,217,902), genes that encode enzymes that give tolerance to herbicides like glyphosate (e.g. 5-enolpyruvylshikimate-3-phosphate synthase (EPSPS): Della-Cioppa et al., *Bio/Technology* (1987) 5: 579-584); U.S. Pat. Nos. 5,627,061; 5,633,435; 6,040,497; 5,094,945; WO04074443, and WO04009761; glyphosate oxidoreductase (GOX; U.S. Pat. No. 5,463,175); glyphosate decarboxylase (WO05003362 and US Patent Application 20040177399; or glyphosate N-acetyltransferase (GAT): Castle et al., Science (2004) 304: 1151-1154) U.S. Patent Publication 20030083480), dalapon (e.g. dehI encoding 2,2-dichloropropionic acid dehalogenase conferring tolerance to 2,2-dichloropropionic acid (Dalapon; WO9927116)), bromoxynil (haloarylnitrilase (Bxn) for conferring tolerance to bromoxynil (WO8704181A1; U.S. Pat. No. 4,810,648; WO8900193A), sulfonyl herbicides (e.g. acetohydroxyacid synthase or acetolactate synthase conferring tolerance to acetolactate synthase inhibitors such as sulfonylurea, imidazolinone, triazolopyrimidine, pyrimidyloxybenzoates and phthalide; (U.S. Pat. Nos. 6,225,105; 5,767,366; 4,761,373; 5,633,437; 6,613,963; 5,013,659; 5,141,870; 5,378,824; 5,605,011); encoding ALS, GST-II), bialaphos or phosphinothricin or derivatives (e.g. phosphinothricin acetyltransferase (bar) conferring tolerance to phosphinothricin or glufosinate (U.S. Pat. Nos. 5,646,024, 5,561,236, 5,276,268; 5,637,489; 5,273,894; and EP 275,957), atrazine (encoding GST-III), dicamba (dicamba monooxygenase; U.S. Patent Application Publications 20030115626, 20030135879), or sethoxydim (modified acetyl-coenzyme A carboxylase for conferring tolerance to cyclohexanedione (sethoxydim) and aryloxyphenoxypropionate (haloxyfop) (U.S. Pat. No. 6,414,222), among others. Other selection procedures can also be implemented including positive selection mechanisms (e.g. use of the manA gene of *Escherichia coli*, allowing growth in the presence of mannose), and dual selection (e.g. simultaneously using spectinomycin and glufosinate, or spectinomycin and dicamba) and would still fall within the scope of the present disclosure.

In one aspect, a selectable marker provided herein is a positive selection marker. A positive selection marker confers an advantage to a transformed cell. In an aspect, a DNA of interest provided herein comprises a selectable marker gene that confers antibiotic resistance or herbicide resistance. In another aspect, a selectable marker provided herein is a negative selection marker. In another aspect, a selectable marker provided herein is both a positive selection marker and a negative selection marker. A negative selectable marker provided herein can be a lethal or non-lethal negative selectable marker. A non-lethal negative selectable marker gene can be one of any listed in U.S. Publication No. 2004-0237142, such as GGPP synthases, GA 2-oxidase gene sequences, isopentenyltransferase (IPT), CKI1 (cytokinin-independent 1), ESR-2, ESR1-A, auxin-producing genes, such as indole-3-acetic acid (IAA), iaaM, iaah, roLABC, genes that result in overexpression of ethylene biosynthetic enzymes, VP1 genes, AB13 genes, LEC1 genes, and Bas1 genes for example. A non-lethal negative selectable marker gene can be included on any nucleic acid molecule provided herein. A non-lethal negative selectable marker gene provided herein is a gene resulting in the overexpression of a class of enzymes that use substrates of the gibberellic acid (GA) biosynthetic pathway, but that do not result in the production of bioactive GA. In another aspect, a nucleic acid molecule provided herein comprises a non-lethal negative selectable marker gene such as a phytoene synthase gene from *Erwinia herbicola* (crtB).

In an aspect, a DNA of interest provided herein comprises a promoter. A promoter contains a sequence of nucleotide bases that signals RNA polymerase to associate with the DNA and to initiate transcription into mRNA using one of the DNA strands as a template to make a corresponding complementary strand of RNA. In an aspect, a promoter provided herein is a constitutive promoter. In another aspect, a promoter provided herein is a regulatable promoter. In yet another aspect, a regulatable promoter provided herein is a heat shock promoter, a tissue specific promoter, or a chemically inducible promoter.

A number of promoters that are active in plant cells have been described in the literature. Such promoters would include but are not limited to the nopaline synthase (NOS) and octopine synthase (OCS) promoters that are carried on Ti plasmids of *Agrobacterium tumefaciens*, the caulimovirus promoters such as the cauliflower mosaic virus (CaMV) 19S and 35S promoters and the Figwort mosaic virus (FMV) 35S promoter, and the enhanced CaMV35S promoter (e35S). A variety of other plant gene promoters that are regulated in response to environmental, hormonal, chemical, and/or developmental signals, also can be used for expression of heterologous genes in plant cells, including, for instance, promoters regulated by (1) heat (Callis et al., *Plant Physiology*, (1988) 88: 965-968), (2) light (e.g., pea RbcS-3A promoter, Kuhlemeier et al., *Plant Cell*, (1989) 1: 471-478; maize RbcS promoter, Schaffner et al., *Plant Cell* (1991) 3: 997-1012); (3) hormones, such as abscisic acid (Marcotte et al., *Plant Cell*, (1989) 1: 969-976), (4) wounding (e.g., Siebertz et al., *Plant Cell*, (1989) 961-968); or other signals or chemicals. Tissue specific promoters are also known.

In an aspect, a DNA of interest provided herein comprises at least one, at least two, at least three, at least four, at least five, or at least six, at least seven, at least eight, at least nine, or at least ten promoters. In an aspect, a DNA of interest provided herein does not comprise a promoter. In an aspect, a promoter provided herein can be part of a gene.

As described below, it is preferred that the particular promoter selected should be capable of causing sufficient expression to result in the production of an effective amount of the gene product of interest. Examples describing such promoters include without limitation U.S. Pat. No. 6,437, 217 (maize RS81 promoter), U.S. Pat. No. 5,641,876 (rice actin promoter), U.S. Pat. No. 6,426,446 (maize RS324 promoter), U.S. Pat. No. 6,429,362 (maize PR-1 promoter), U.S. Pat. No. 6,232,526 (maize A3 promoter), U.S. Pat. No. 6,177,611 (constitutive maize promoters), U.S. Pat. Nos. 5,322,938, 5,352,605, 5,359,142 and 5,530,196 (35S promoter), U.S. Pat. No. 6,433,252 (maize L3 oleosin promoter), U.S. Pat. No. 6,429,357 (rice actin 2 promoter as well as a rice actin 2 intron), U.S. Pat. No. 5,837,848 (root specific promoter), U.S. Pat. No. 6,294,714 (light inducible promoters), U.S. Pat. No. 6,140,078 (salt inducible promoters), U.S. Pat. No. 6,252,138 (pathogen inducible promoters), U.S. Pat. No. 6,175,060 (phosphorus deficiency inducible promoters), U.S. Pat. No. 6,635,806 (gamma-coixin promoter), and U.S. patent application Ser. No. 09/757,089 (maize chloroplast aldolase promoter). Additional promoters that can find use are a nopaline synthase (NOS) promoter (Ebert et al., 1987), the octopine synthase (OCS) promoter (which is carried on tumor-inducing plasmids of *Agrobacterium tumefaciens*), the caulimovirus promoters such as the cauliflower mosaic virus (CaMV) 19S promoter (Lawton et al., *Plant Molecular Biology* (1987) 9: 315-324), the CaMV 35S promoter (Odell et al., *Nature* (1985) 313: 810-812), the figwort mosaic virus 35S-promoter (U.S. Pat. Nos. 6,051, 753; 5,378,619), the sucrose synthase promoter (Yang and Russell, *Proceedings of the National Academy of Sciences, USA* (1990) 87: 4144-4148), the R gene complex promoter (Chandler et al., *Plant Cell* (1989) 1: 1175-1183), and the chlorophyll a/b binding protein gene promoter, PC1SV (U.S. Pat. No. 5,850,019), and AGRtu.nos (GenBank Accession V00087; Depicker et al., *Journal of Molecular and Applied Genetics* (1982) 1: 561-573; Bevan et al., 1983) promoters.

Promoter hybrids can be constructed to enhance transcriptional activity (U.S. Pat. No. 5,106,739), or to combine desired transcriptional activity, inducibility and tissue specificity or developmental specificity. Promoters that function in plants include but are not limited to promoters that are inducible, viral, synthetic, constitutive, temporally regulated, spatially regulated, and spatio-temporally regulated. Other promoters that are tissue-enhanced, tissue-specific, or developmentally regulated are also known in the art and envisioned to have utility in the practice of this disclosure.

Promoters used in the provided nucleic acid molecules and transformation vectors of the present disclosure can be modified, if desired, to affect their control characteristics. Promoters can be derived by means of ligation with operator regions, random or controlled mutagenesis, etc. Furthermore, the promoters can be altered to contain multiple "enhancer sequences" to assist in elevating gene expression.

The present nucleic acid molecules can be incorporated into any suitable plant transformation plasmid or vector containing a selectable or screenable marker and associated regulatory elements as described, along with one or more nucleic acids encoded by a structural gene.

Site-Specific Genome Modification Enzymes

As used herein, the term "double-strand break inducing agent" refers to any agent that can induce a double-strand break (DSB) on a DNA molecule. In some embodiments, the double-strand break inducing agent is a site-specific genome modification enzyme.

As used herein, the term "site-specific genome modification enzyme" refers to any enzyme that can modify a nucleotide sequence in a site-specific manner. In the present disclosure, site-specific genome modification enzymes include endonucleases, recombinases, transposases, helicases and any combination thereof.

Several embodiments relate to promoting recombination by providing a site-specific genome modification enzyme. As used herein, the term "site-specific enzyme" refers to any enzyme that can modify a nucleotide sequence in a sequence-specific manner. In some embodiments, recombination is promoted by providing a single-strand break inducing agent. In some embodiments, recombination is promoted by providing a double-strand break inducing agent. In some embodiments, recombination is promoted by providing a strand separation inducing reagent. In one aspect, the site-specific genome modification enzyme is selected from an endonuclease, a recombinase, a transposase, a helicase or any combination thereof. In some embodiments, recombination occurs between B chromosomes. In some embodiments, recombination occurs between a B chromosome and an A chromosome. In some embodiments, recombination occurs between a DNA of interest and a unique B chromosome sequence as described herein.

Several embodiments relate to promoting integration of one or more DNAs of interest by providing a site-specific genome modification enzyme. As used herein, the term "site-specific enzyme" refers to any enzyme that can modify a nucleotide sequence in a sequence-specific manner. In some embodiments, integration of one or more DNAs of interest is promoted by providing a single-strand break inducing agent. In some embodiments, integration of one or more DNAs of interest is promoted by providing a double-strand break inducing agent. In some embodiments, integration of one or more DNAs of interest is promoted by providing a strand separation inducing reagent. In one aspect, the site-specific genome modification enzyme is selected from an endonuclease, a recombinase, a transposase, a helicase or any combination thereof.

In one aspect, the endonuclease is selected from a meganuclease, a zinc-finger nuclease (ZFN), a transcription activator-like effector nucleases (TALEN), an Argonaute (non-limiting examples of Argonaute proteins include *Thermus thermophilus* Argonaute (TtAgo), *Pyrococcus furiosus* Argonaute (PfAgo), *Natronobacterium gregoryi* Argonaute (NgAgo), an RNA-guided nuclease, such as a CRISPR associated nuclease (non-limiting examples of CRISPR associated nucleases include Cas1, Cas1B, Cas2, Cas3, Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, Cpf1, homologs thereof, or modified versions thereof).

In some embodiments, the site-specific genome modification enzyme is a dCas9-Fok1 fusion protein. In another aspect, the site-specific genome modification enzyme is a dCas9-recombinase fusion protein. As used herein, a "dCas9" refers to a Cas9 endonuclease protein with one or more amino acid mutations that result in a Cas9 protein without endonuclease activity, but retaining RNA-guided site-specific DNA binding. As used herein, a "dCas9-recombinase fusion protein" is a dCas9 with a protein fused to the dCas9 in such a manner that the recombinase is catalytically active on the DNA.

In some embodiments, the site-specific genome modification enzyme is a recombinase. Non-limiting examples of recombinase include a tyrosine recombinase attached to a DNA recognition motif provided herein is selected from the group consisting of a Cre recombinase, a Gin recombinase a Flp recombinase, and a Tnp1 recombinase. In an aspect, a Cre recombinase or a Gin recombinase provided herein is tethered to a zinc-finger DNA-binding domain, or a TALE DNA-binding domain, or a Cas9 nuclease. In another aspect, a serine recombinase attached to a DNA recognition motif provided herein is selected from the group consisting of a PhiC31 integrase, an R4 integrase, and a TP-901 integrase. In another aspect, a DNA transposase attached to a DNA binding domain provided herein is selected from the group consisting of a TALE-piggyBac and TALE-Mutator.

Site-specific genome modification enzymes, such as meganucleases, ZFNs, TALENs, Argonaute proteins (non-limiting examples of Argonaute proteins include *Thermus thermophilus* Argonaute (TtAgo), *Pyrococcus furiosus* Argonaute (PfAgo), *Natronobacterium gregoryi* Argonaute (NgAgo), homologs thereof, or modified versions thereof), RNA-guided nucleases (non-limiting examples of RNA-guided nucleases include the CRISPR associated nucleases, such as Cas1, Cas1B, Cas2, Cas3, Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, Cpf1, homologs thereof, or modified versions thereof) and engineered RNA-guided nucleases (RGNs), induce a genome modification such as a double-stranded DNA break (DSB) or single-strand DNA break at the target site of a genomic sequence that is then repaired by the natural processes of homologous recombination (HR) or non-homologous end-joining (NHEJ). Sequence modifications then occur at the cleaved sites, which can include deletions or insertions that result in gene disruption in the case of NHEJ, or integration of exogenous sequences by homologous recombination.

In one aspect of the present disclosure, site-specific genome modification enzymes are selected to induce a genome modification in one, a few, or many individual target sequences of the maize B chromosome sequences provided herein. After exposure to the site-specific genome modification enzyme, the resulting recombinant nucleic acid can be identified in various ways including sequencing, PCR amplification, Southern analysis, or other molecular methods used to detect recombinant nucleic acid sequence. Site-specific genome modification enzymes may be expressed in plants such that one or more genome modifications occur within a genomic locus, and resulting progeny screened for molecular changes.

Any of the DNA of interest provided herein can be integrated into a target site of a B chromosome sequence by introducing the DNA of interest and the provided site-specific genome modification enzymes. Any method provided herein can utilize any site-specific genome modification enzyme provided herein.

ZFNs

Zinc finger nucleases (ZFNs) are synthetic proteins characterized by an engineered zinc finger DNA-binding domain fused to the cleavage domain of the FokI restriction endonuclease. ZFNs can be designed to cleave almost any long stretch of double-stranded DNA for modification of the zinc finger DNA-binding domain. ZFNs form dimers from monomers composed of a non-specific DNA cleavage domain of FokI endonuclease fused to a zinc finger array engineered to bind a target DNA sequence.

The DNA-binding domain of a ZFN is typically composed of 3-4 zinc-finger arrays. The amino acids at positions −1, +2, +3, and +6 relative to the start of the zinc finger Gα-helix, which contribute to site-specific binding to the target DNA, can be changed and customized to fit specific target sequences. The other amino acids form the consensus backbone to generate ZFNs with different sequence specificities. Rules for selecting target sequences for ZFNs are known in the art.

The FokI nuclease domain requires dimerization to cleave DNA and therefore two ZFNs with their C-terminal regions are needed to bind opposite DNA strands of the cleavage site (separated by 5-7 bp). The ZFN monomer can cute the target site if the two-ZF-binding sites are palindromic. The term ZFN, as used herein, is broad and includes a monomeric ZFN that can cleave double stranded DNA without assistance from another ZFN. The term ZFN is also used to refer to one or both members of a pair of ZFNs that are engineered to work together to cleave DNA at the same site.

Because the DNA-binding specificities of zinc finger domains can in principle be re-engineered using one of various methods, customized ZFNs can theoretically be constructed to target nearly any gene sequence. Publicly available methods for engineering zinc finger domains include Context-dependent Assembly (CoDA), Oligomerized Pool Engineering (OPEN), and Modular Assembly.

TALENs

Transcription activator-like effectors (TALEs) can be engineered to bind practically any DNA sequence. TALE proteins are DNA-binding domains derived from various plant bacterial pathogens of the genus *Xanthomonas*. The X pathogens secrete TALEs into the host plant cell during infection. The TALE moves to the nucleus, where it recognizes and binds to a specific DNA sequence in the promoter region of a specific DNA sequence in the promoter region of a specific gene in the host genome. TALE has a central DNA-binding domain composed of 13-28 repeat monomers of 33-34 amino acids. The amino acids of each monomer are highly conserved, except for hypervariable amino acid residues at positions 12 and 13. The two variable amino acids are called repeat-variable diresidues (RVDs). The amino acid pairs NI, NG, HD, and NN of RVDs preferentially recognize adenine, thymine, cytosine, and guanine/adenine, respectively, and modulation of RVDs can recognize consecutive DNA bases. This simple relationship between amino acid sequence and DNA recognition has allowed for the engineering of specific DNA binding domains by selecting a combination of repeat segments containing the appropriate RVDs. The transcription activator-like effector (TALE) DNA binding domain can be fused to a functional domain, such as a recombinase, a nuclease, a transposase or a helicase, thus conferring sequence specificity to the functional domain.

Transcription activator-like effector nucleases (TALENs) are artificial restriction enzymes generated by fusing the transcription activator-like effector (TALE) DNA binding domain to a nuclease domain. The term TALEN, as used herein, is broad and includes a monomeric TALEN that can cleave double stranded DNA without assistance from another TALEN. The term TALEN is also used to refer to one or both members of a pair of TALENs that work together to cleave DNA at the same site. In some embodiments, the nuclease is selected from a group consisting of PvuII, MutH, TevI, FokI, AlwI, MlyI, SbfI, SdaI, StsI, CleDORF, Clo051, and Pept071. When FokI is fused to a TALE domain each member of the TALEN pair binds to the DNA sites flanking a target site, the FokI monomers dimerize and cause a DSB at the target site.

Besides the wild-type FokI cleavage domain, variants of the FokI cleavage domain with mutations have been designed to improve cleavage specificity and cleavage activity. The FokI domain functions as a dimer, requiring two constructs with unique DNA binding domains for sites in the target genome with proper orientation and spacing. Both the number of amino acid residues between the TALEN DNA binding domain and the FokI cleavage domain, and the number of bases between the two individual TALEN binding sites are parameters for achieving high levels of activity. PvuII, MutH, and TevI cleavage domains are useful alternatives to FokI and FokI variants for use with TALEs. PvuII functions as a highly specific cleavage domain when coupled to a TALE (see Yank et al. 2013. *PLoS One.* 8: e82539). MutH is capable of introducing strand-specific nicks in DNA (see Gabsalilow et al. 2013. *Nucleic Acids Research.* 41: e83). TevI introduces double-stranded breaks in DNA at targeted sites (see Beurdeley et al., 2013. *Nature Communications.* 4: 1762).

The relationship between amino acid sequence and DNA recognition of the TALE binding domain allows for designable proteins. Software programs such as DNA Works can be used to design TALE constructs. Other methods of designing TALE constructs are known to those of skill in the art. Doyle et al. (2012) TAL Effector-Nucleotide Targeter (TALE-NT) 2.0: tools for TAL effector design and target prediction. *Nucleic Acids Res.* 40(W1):W117-W122; Cermak (2011). Efficient design and assembly of custom TALEN and other TAL effector-based constructs for DNA targeting. *Nucleic Acids Res.* 39(12):e82.

Meganucleases

Meganucleases, which are commonly identified in microbes, are unique enzymes with high activity and long recognition sequences (>14 bp) resulting in site-specific digestion of target DNA. Engineered versions of naturally occurring meganucleases typically have extended DNA recognition sequences (for example, 14-40 bp).

The engineering of meganucleases is more challenging than that of ZFNs and TALENs because the DNA recognition and cleavage functions of meganucleases are intertwined in a single domain. Specialized methods of mutagenesis and high-throughput screening have been used to create novel meganuclease variants that recognize unique sequences and possess improved nuclease activity.

Argonaute

The Argonaute protein family is a DNA-guided endonuclease. The Argonaute isolated from *Natronobacterium gregoryi* has been reported to be suitable for DNA-guided genome editing in human cells (Gao, et al. DNA-guided genome editing using the *Natronobacterium gregoryi* Argonaute. *Nature Biotechnology* 34:768-773 (2016). Argonaute endonucleases from other species have been identified, (non-limiting examples of Argonaute proteins include *Thermus thermophilus* Argonaute (TtAgo), *Pyrococcus furiosus* Argonaute (PfAgo), *Natronobacterium gregoryi* Argonaute (NgAgo), homologs thereof, or modified versions thereof). Each of these unique Argonaute endonucleases have associated a sequence encoding DNA guide.

CRISPR

The CRISPR (clustered regularly interspaced short palindromic repeats)/Cas (CRISPR-associated) system is an alternative to synthetic proteins whose DNA-binding domains enable them to modify genomic DNA at specific sequences (e.g., ZFN and TALEN). Specificity of the CRISPR/Cas system is based on an RNA-guide that use complementary base pairing to recognize target DNA sequences. In some embodiments, the site-specific genome modification enzyme is a CRISPR/Cas system. In an aspect, a site-specific genome modification enzyme provided herein can comprise any RNA-guided Cas nuclease (non-limiting examples of RNA-guided nucleases include Cas1, Cas1B, Cas2, Cas3, Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, Cpf1, homologs thereof, or modified versions thereof); and, optionally, the guide RNA necessary for targeting the respective nucleases.

CRISPR/Cas systems are part of the adaptive immune system of bacteria and archaea, protecting them against invading nucleic acids such as viruses by cleaving the foreign DNA in a sequence-dependent manner. The immunity is acquired by the integration of short fragments of the invading DNA known as spacers between two adjacent repeats at the proximal end of a CRISPR locus. The CRISPR arrays, including the spacers, are transcribed during subsequent encounters with invasive DNA and are processed into small interfering CRISPR RNAs (crRNAs) approximately 40 nt in length, which combine with the trans-activating CRISPR RNA (tracrRNA) to activate and guide the Cas9 nuclease. This cleaves homologous double-stranded DNA sequences known as protospacers in the invading DNA. A prerequisite for cleavage is the presence of a conserved protospacer-adjacent motif (PAM) downstream of the target DNA, which usually has the sequence 5'-NGG-3' but less frequently NAG. Specificity is provided by the so-called "seed sequence" approximately 12 bases upstream of the PAM, which must match between the RNA and target DNA. Cpf1 acts in a similar manner to Cas9, but Cpf1 does not require a tracrRNA.

As used herein, the term "target site" broadly refers to a genomic sequence selected for integration of a DNA of interest. In some aspects, the target site is in a genic region. In other aspects, the target site is in an intergenic region. In yet another aspect, the target site can include both a genic region and an intergenic region. In one aspect, a target site provided herein is recognized and cleaved by a double-strand break inducing agent, such as a site-specific genome modification enzyme, a site specific recombinase, or a site specific transposase. In some embodiments, a target site comprises a nucleic acid sequence of having at least 90%, at least 91%, at least 92%, at least 93%, at least 94%, at least 95%, at least 96%, at least 97%, at least 98%, at least 99%, or 100%, sequence identity to a portion of a maize B chromosome sequence selected from the group consisting of SEQ ID NOs:10-13, 16, 19, 21, 22, 24, 25, 32, 34, 38, 40-45, 17-49, 55, 56, 60, 62, 64, 65, 68, 70, 72, 73, 75-79, 81, 83-86, 88-92, 94, 95, 98, 100, 102, 103, 107, 108, 110-112, 114, 116-118, 121, 123, 124, 126, 129-133, 135, 137, 138, 140-150, 154-159, 162-166, 168, 171-180, 183-197, 200-212, 214, 215, 217, 218, 220, 222-225, 228-232, 234-236, 238-241, 243, 244, 247, 249, 251, 253, 254, 256-258, 260-266, 269, 270, 273, 275-279, 281-295, 299, 301, 302, 304-316, 318-320, 322, 323, 325, 327-329, 331-335, 338-344, 346, 347, 349-354, 357-360, 363, 365, 366-373, 375-379, 381, 383, 384, 386-388, 391, 392, 395-398, 400-404, 406-412, 415, 416, 418-420, 422, 423, 428-433, 435-441, 443-446, 448-450, 452, 456-459, 461-464, 466-475, 478, 479, 481-484, 486, 487, 490-495, 497-499, 501-503, 505-508, 510-513, 517-520, 524, 525, 527-529, 531-543, 545-547, 549-554, 556-560, 563-577, 579-584, 586-593, 595, 596, 598-609, 611-614, 616-619, 621-624, 626, 627, 629-636, 638-640, 643-652, 655, 657-661, 663, 664, 666-668, 670-674, 676-680, 683-688, 690-701, 703, 705-708, 711-717, 719-729, 731-734, 736-738, 740, 741, 743-748, 750, 752-764, 766, 767, 770, 771, 773, 774, 776-785, 787-791, and 793-888.

As used herein, the term "recombination" refers to the exchange of nucleotide sequences between two DNA molecules.

As used herein, the term "homologous recombination" refers to the exchange of nucleotide sequences at a conserved region shared by two genomic loci. Homologous recombination includes symmetric homologous recombination and asymmetric homologous recombination. Asymmetric homologous recombination may also be referred to as unequal recombination.

Methods for detecting recombination include, but are not limited to, 1) phenotypic screening, 2) molecular marker technologies such as single nucleotide polymorphism (SNP) analysis by TaqMan® or Illumina/Infinium PCR technology, 3) Southern blot analysis, and 4) sequencing (e.g., Sanger, Illumina, 454, Pac-Bio, Ion Torrent). One example of a method for identifying integration of a DNA of interest in a chromosome is inverse PCR (iPCR).

In an aspect, integration of a DNA of interest provided herein occurs via homologous recombination (HR). In another aspect, integration of a DNA of interest provided herein occurs via non-homologous end joining (NHEJ).

As used herein, "transgenic" means a plant or seed whose genome has been altered by the stable integration of recombinant DNA. A transgenic line includes a plant regenerated from an originally-transformed plant cell and progeny transgenic plants from later generations or crosses of a transformed plant. As used herein, "exogenous" is intended to refer to genes that are not normally present in the cell being transformed, or not present in the form, structure, etc., as found in the transforming DNA segment or gene. Thus, the term "exogenous" gene or DNA is intended to refer to any gene or DNA segment that is introduced into a recipient cell, regardless of whether a similar gene can already be present in such a cell. The type of DNA included in the exogenous DNA can include DNA that is already present in the plant cell, DNA from another plant, DNA from a different organism, or a DNA generated externally, such as a DNA sequence containing an antisense message of a gene, or a DNA sequence encoding a synthetic or modified version of a gene.

Methods of transforming plant cells are well known by persons of ordinary skill in the art. For instance, specific instructions for transforming plant cells by microprojectile bombardment with particles coated with recombinant DNA are found in U.S. Pat. No. 5,015,580 (soybean); U.S. Pat. No. 5,550,318 (corn); U.S. Pat. No. 5,538,880 (corn); U.S. Pat. No. 5,914,451 (soybean); U.S. Pat. No. 6,160,208 (corn); U.S. Pat. No. 6,399,861 (corn) and U.S. Pat. No. 6,153,812 (wheat); U.S. Pat. No. 6,002,070 (rice); U.S. Pat. No. 7,122,722 (cotton); U.S. Pat. No. 6,051,756 (*Brassica*); U.S. Pat. No. 6,297,056 (*Brassica*); US Patent Publication 20040123342 (sugarcane) and *Agrobacterium*-mediated transformation is described in U.S. Pat. No. 5,159,135 (cotton); U.S. Pat. No. 5,824,877 (soybean); U.S. Pat. No. 5,591,616 (corn); U.S. Pat. No. 6,384,301 (soybean); U.S. Pat. No. 5,750,871 (*Brassica*); U.S. Pat. No. 5,463,174 (*Brassica*) 5,188,958 (*Brassica*), all of which are incorporated herein by reference. Methods for transforming other plants can be found in, for example, Compendium of Transgenic Crop Plants (2009) Blackwell Publishing. Any appropriate method known to those skilled in the art can be used to transform a plant cell with any of the provided nucleic acid molecules. As used herein, "stably transformed" is defined as a transfer of DNA into genomic DNA of a targeted cell that allows the targeted cell to regenerate into a whole organism and pass the transferred DNA to the next generation of the transformed organism. Stable transformation requires the integration of transferred DNA within the reproductive cell(s) of the transformed organism. As used herein, "transiently transformed" is defined as a transfer of DNA into a cell that is not transferred to the next generation of the transformed organism. Transient transformations are often transformations of leaf or root (e.g., non-reproductive)

tissue in plants. The transformed DNA does not typically integrate into the transformed cell's genomic DNA during a transient transformation. In one aspect, a method provided herein stably transforms a plant cell. In another aspect, a method provided herein transiently transforms a plant cell.

In an aspect, this disclosure provides methods for transforming a plant cell with a nucleic acid sequence encoding a site-specific genome modification enzyme. In an aspect, a method provided herein comprises the stable transformation of a nucleic acid sequence encoding a site-specific genome modification enzyme. In another aspect, a method provided herein comprises the transient transformation of a nucleic acid sequence encoding a site-specific genome modification enzyme. In an aspect, a method provided herein comprises a constitutively expressed nucleic acid encoding a site-specific genome modification enzyme. In another aspect, a method provided herein comprises a nucleic acid sequence encoding a site-specific genome modification enzyme under the control of a regulatable promoter.

In an aspect of the present disclosure, a recombinant nucleic acid sequence provided herein is capable of being fully integrated into a chromosome.

In one aspect, transformation of a plant cell is performed by an *Agrobacterium*-mediated method, and the nucleic acid molecules of interest are present on one or more Integrated DNA sequences (U.S. Pat. Nos. 6,265,638, 5,731,179; U.S. Patent Application Publications US2005/0183170; 2003110532) or other nucleic acid sequence (e.g., vector backbone) that is transferred into a plant cell. The sequences that can be transferred into a plant cell can be present on one transformation vector in a bacterial strain being utilized for transformation. In another aspect, the sequences can be present on separate transformation vectors in the bacterial strain. In yet another aspect, the sequences can be found in separate bacterial cells or strains used together for transformation.

A "transformation vector," as used herein, is plasmid DNA that is capable of transforming a plant cell. In an aspect, a transformation vector provided herein can comprise any DNA of interest provided herein. In another aspect, a transformation vector provided herein can comprise any nucleic acid molecule provided herein.

The DNA constructs used for transformation in the methods of present disclosure generally also contain the plasmid backbone DNA segments that provide replication function and antibiotic selection in bacterial cells, for example, an *Escherichia coli* origin of replication such as ori322, an *Agrobacterium* origin of replication such as oriV or oriRi, and a coding region for a selectable marker such as Spec/Strp that encodes for Tn7 aminoglycoside adenyltransferase (aadA) conferring resistance to spectinomycin or streptomycin, or a gentamicin (Gm, Gent) selectable marker gene. For plant transformation, the host bacterial strain is often *Agrobacterium tumefaciens* ABI, C58, LBA4404, AGLO, AGL1, EHA101, or EHA105 carrying a plasmid having a transfer function for the expression unit. Other strains known to those skilled in the art of plant transformation can function in the present disclosure.

To confirm the presence of exogenous DNA or a "transgene(s)" in a transgenic cell a variety of assays can be performed. Such assays include, for example, "molecular biological" assays, such as Southern and northern blotting and PCR, "biochemical" assays, such as detecting the presence of a protein product, e.g., by immunological means (ELISAs and western blots) or by enzymatic function (e.g. GUS assay); pollen histochemistry; plant part assays, such as leaf or root assays; and also, by analyzing the phenotype of the whole regenerated plant.

This disclosure provides a method of making a transgenic plant cell comprising a DNA of interest, where the method comprises selecting a target B chromosome genomic locus having at least 70%, at least 75%, at least 80%, at least 85%, at least 90%, at least 91%, at least 92%, at least 93%, at least 94%, at least 95%, at least 96%, at least 97%, at least 98%, at least 99%, at least 99% or 100% sequence identity to any sequence selected from SEQ ID NOs:10-13, 16, 19, 21, 22, 24, 25, 32, 34, 38, 40-45, 17-49, 55, 56, 60, 62, 64, 65, 68, 70, 72, 73, 75-79, 81, 83-86, 88-92, 94, 95, 98, 100, 102, 103, 107, 108, 110-112, 114, 116-118, 121, 123, 124, 126, 129-133, 135, 137, 138, 140-150, 154-159, 162-166, 168, 171-180, 183-197, 200-212, 214, 215, 217, 218, 220, 222-225, 228-232, 234-236, 238-241, 243, 244, 247, 249, 251, 253, 254, 256-258, 260-266, 269, 270, 273, 275-279, 281-295, 299, 301, 302, 304-316, 318-320, 322, 323, 325, 327-329, 331-335, 338-344, 346, 347, 349-354, 357-360, 363, 365, 366-373, 375-379, 381, 383, 384, 386-388, 391, 392, 395-398, 400-404, 406-412, 415, 416, 418-420, 422, 423, 428-433, 435-441, 443-446, 448-450, 452, 456-459, 461-464, 466-475, 478, 479, 481-484, 486, 487, 490-495, 497-499, 501-503, 505-508, 510-513, 517-520, 524, 525, 527-529, 531-543, 545-547, 549-554, 556-560, 563-577, 579-584, 586-593, 595, 596, 598-609, 611-614, 616-619, 621-624, 626, 627, 629-636, 638-640, 643-652, 655, 657-661, 663, 664, 666-668, 670-674, 676-680, 683-688, 690-701, 703, 705-708, 711-717, 719-729, 731-734, 736-738, 740, 741, 743-748, 750, 752-764, 766, 767, 770, 771, 773, 774, 776-785, 787-791, and 793-888, selecting a site-specific genome modification enzyme that specifically binds and cleaves the target B chromosome genomic locus; introducing the site-specific genome modification enzyme into a plant cell; introducing a DNA of interest into a plant cell; and inserting the DNA of interest into the target B chromosome genomic locus; and selecting plant cells comprising the DNA of interest integrated into the target site of the B chromosome locus. In an aspect, a method provided herein uses homology directed repair integration to integrate a DNA of interest into a B chromosome genomic locus. In another aspect, a method provided herein uses non-homologous end joining integration to integrate a DNA of interest into a B chromosome genomic locus.

In an aspect, a method provided herein integrates one or more, two or more, three or more, four or more, five or more, six or more, seven or more, eight or more, nine or more, ten or more, fifteen or more, twenty or more, or twenty-five or more DNAs of interest into one or more, two or more, three or more, four or more, five or more, six or more, seven or more, eight or more, nine or more, ten or more, fifteen or more, twenty or more, or twenty-five or more B chromosome genomic loci located on one B chromosome. In another aspect, a method provided herein integrates one or more, two or more, three or more, four or more, five or more, six or more, seven or more, eight or more, nine or more, ten or more, fifteen or more, twenty or more, or twenty-five or more DNAs of interest into one or more, two or more, three or more, four or more, five or more, six or more, seven or more, eight or more, nine or more, ten or more, fifteen or more, twenty or more, or twenty-five or more B chromosome genomic loci located on two ore more, three or more, four or more, five or more, six or more, seven or more, eight or more, nine or more, or ten or more B chromosomes.

In an aspect, a method of making a transgenic plant cell provided herein comprises a DNA of interest that is modified during integration into a B chromosome sequence. In another aspect, a method of making a transgenic plant cell provided herein comprises a B chromosome sequence that is modified when a DNA of interest provided herein integrates into it.

In an aspect, this disclosure provides a method of making a transgenic plant cell where two or more, three or more, four or more, five or more, six or more, seven or more, eight or more, nine or more, ten or more, fifteen or more, twenty or more, or twenty-five or more DNAs of interest are integrated into two or more, three or more, four or more, five or more, six or more, seven or more, eight or more, nine or more, ten or more, fifteen or more, twenty or more, or twenty-five or more target B chromosome genomic loci on separate B chromosomes; and where the B chromosomes recombine such that the two or more, three or more, four or more, five or more, six or more, seven or more, eight or more, nine or more, ten or more, fifteen or more, twenty or more, or twenty-five or more target B chromosome genomic loci generate a megalocus comprising the two or more, three or more, four or more, five or more, six or more, seven or more, eight or more, nine or more, ten or more, fifteen or more, twenty or more, or twenty-five or more DNAs of interest.

As used herein, a "megalocus" refers to a block of genetically linked transgenic traits that are normally inherited as a single unit. A megalocus according to the disclosure may provide to a plant one or more desired traits, which may include, but are not limited to, enhanced growth, drought tolerance, salt tolerance, herbicide tolerance, insect resistance, pest resistance, disease resistance, and the like. In specific embodiments, a megalocus comprises at least about 2, 3, 4, 5, 6, 7, 8, 9, 10, 11, 13 or 15 transgenic loci (events) that are physically separated but genetically linked such that they can are inherited as a single unit. Each transgenic locus in the megalocus can be 0.1, 0.2, 0.3, 0.4, 0.5, 0.6, 0.7, 0.8, 0.9, 1, 1.5, 2, 2.5, 3, 5, 10, 15, or 20 al apart from one another. In some embodiments, a megalocus comprises at least about 2, 3, 4, 5, 6, 7, 8, 9, 10, 11, 13 or 15 transgenic loci (events) that are not genetically linked but are located on the same B chromosome.

As used herein, a centimorgan ("cM") is a unit of measure of recombination frequency and genetic distance between two loci. One cM is equal to a 1% chance that a marker at one genetic locus will be separated from a marker at, a second locus due to crossing over in a single generation.

As used herein, "closely linked" means that the marker or locus is within about 20 cM, 15 cM, 10 cM, 5 cM, 4 cM, 3 cM, 2 cM, 1 cM, 0.5 cM or less than 0.5 cM of another marker or locus. For example, 20 cM means that recombination occurs between the marker and the locus with a frequency of equal to or less than about 20%.

As used herein, "proximal" refers to relative location of two nucleic acid sequences. In one aspect, a first nucleic acid sequence is proximal to a second nucleic acid sequence if the two nucleic acid sequences are separated by less than 50,000 base pairs, less than 25,000 base pairs, less than 15,000 base pairs, less than 10,000 base pairs, less than 7500 base pairs, less than 5000 base pairs, less than 4000 base pairs, less than 3000 base pairs, less than 2500 base pairs, less than 2000 base pairs, less than 1500 base pairs, less than 1000 base pairs, less than 750 base pairs, less than 500 base pairs, less than 250 base pairs, less than 100 base pairs, less than 75 base pairs, less than 50 base pairs, less than 40 base pairs, less than 30 base pairs, less than 20 base pairs, less than 10 base pairs, less than 5 base pairs, less than 3 base pairs, or 1 base pair.

In one aspect, this disclosure provides plant cells that are not reproductive material and do not mediate the natural reproduction of the plant. In another aspect, this disclosure also provides plant cells that are reproductive material and mediate the natural reproduction of the plant. In another aspect, this disclosure provides plant cells that cannot maintain themselves via photosynthesis. In another aspect, this disclosure provides somatic plant cells. Somatic cells, contrary to germline cells, do not mediate plant reproduction.

Provided plant cells or plant parts can be from seed, fruit, leaf, cotyledon, hypocotyl, meristem, embryos, endosperm, root, shoot, stem, pod, flower, inflorescence, stalk, pedicel, style, stigma, receptacle, petal, sepal, pollen, anther, filament, ovary, ovule, pericarp, phloem, bud, or vascular tissue. In another aspect, this disclosure provides a plant chloroplast. In a further aspect, this disclosure provides an epidermal cell, a stomata cell, a trichrome cell, a root hair cell, a storage root cell, or a tuber cell. In another aspect, this disclosure provides a protoplast cell. In another aspect, this disclosure provides a plant callus cell. In an aspect, any plant, plant part, or plant cell provided herein can comprise any recombinant sequence provided herein.

Nucleic acid molecules provided herein include deoxynucleic acids (DNA) and ribonucleic acids (RNA) and functional analogues thereof, such as complementary DNA (cDNA). Nucleic acid molecules provided herein can be single stranded or double stranded. Nucleic acid molecules comprise the nucleotide bases adenine (A), guanine (G), thymine (T), cytosine (C). Uracil (U) replaces thymine in RNA molecules. The symbol "N" can be used to represent any nucleotide base (e.g., A, G, C, T, or U). As used herein, "complementary" in reference to a nucleic acid molecule or nucleotide bases refers to A being complementary to T (or U), and G being complementary to C. Two complementary nucleic acid molecules are capable of hybridizing with each other. As an example, the two strands of double stranded DNA are complementary to each other. In an aspect of the present disclosure, two nucleic acid sequences are homologous, or essentially homologous, if they have at least 70%, at least 75%, at least 80%, at least 85%, at least 90%, at least 95%, at least 96%, at least 97%, at least 98%, at least 99% or 100% sequence identity with each other. A polynucleotide molecule of the present disclosure comprises at least 2, at least 5, at least 10, at least 20, at least 30, at least 40, at least 50, at least 100, at least 250, at least 500, at least 1000, at least 1500, at least 2000, at least 2500, or at least 3000 nucleotide bases. As used herein, "encoding" refers to a polynucleotide encoding for the amino acids of a polypeptide. A series of three nucleotide bases encodes one amino acid. As used herein, "expressed," "expression," or "expressing" refers to transcription of RNA from a DNA molecule. In an aspect, expression of a DNA of interest provided herein requires a promoter. In another aspect, expression of a DNA of interest provided herein does not require a promoter. In an aspect, an expressed transcript provided herein is spliced. In another aspect, an expressed transcript provided herein is not spliced.

As used herein, terms "polypeptide", "peptide" and "protein" are used interchangeably to refer to a polymer of amino acid residues. The term also applies to amino acid polymers in which one or more amino acids are chemical analogues or modified derivatives of a corresponding naturally-occurring amino acids.

In an aspect of the present disclosure, a nucleic acid sequence can be physically linked to another nucleic acid sequence, operably linked to another nucleic acid sequence or both physically and operably linked to another nucleic acid sequence. As used herein, physically linked means that the physically linked nucleic acid sequences are located on the same nucleic acid molecule. A physical linkage can be adjacent or proximal. A nucleic acid sequence provided herein can be adjacent to another nucleic acid sequence. As used herein, operably linked means that the operably linked nucleic acid sequences exhibit their desired function. For example, in an aspect of this disclosure, a provided DNA promoter sequence can initiate transcription of an operably linked DNA sequence into RNA. A nucleic acid sequence provided herein can be upstream or downstream of a physically or operably linked nucleic acid sequence. As used herein, upstream means the nucleic acid sequence is positioned before the 5' end of a linked nucleic acid sequence. As used herein, downstream means the nucleic acid sequence is positioned after the 3' end of a linked nucleic acid sequence. As used herein, 5' means the start of a coding DNA sequence or the beginning of an RNA molecule. As used herein, 3' means the end of a coding DNA sequence or the end of an RNA molecule. As used herein, "opposing side" refers to the 5' or 3' side of a nucleic acid molecule. For example, a first nucleic acid molecule sequence on the 5' side of a second nucleic acid molecule is on the opposing side of a third nucleic acid molecule sequence on the 3' end of the second nucleic acid molecule.

In an aspect, a nucleic acid molecule provided herein is a transformation vector. In an aspect, a transformation vector is a bacterial plasmid. As used herein, a "plasmid" is a DNA molecule that is physically separate from chromosomal DNA and has the ability to replicate. In another aspect, the bacterial plasmid is an *Agrobacterium* tumor-inducing (Ti) plasmid. In another aspect, a transformation vector is a synthetic plasmid. As used herein, a "synthetic plasmid" is an artificially created plasmid that is capable of the same functions (e.g. replication) as a natural plasmid (e.g. Ti plasmid). Without being limited, one skilled in the art can create a synthetic plasmid de novo via synthesizing a plasmid by individual nucleotides, or by splicing together nucleic acid molecules from different pre-existing plasmids.

EXAMPLES

Example 1: Obtaining Unique Maize B Chromosome Sequence

To identify sequences unique to the maize B chromosome, the following approach was undertaken. A line backcrossed multiple times to B73 maize containing multiple B chromosomes (referred to as B73 plus) was obtained from the University of Missouri and grown from seed in a greenhouse using standard potting and growth conditions. Due to the non-Mendelian segregation of B chromosomes, root tip tissue was collected from each individual plant grown from the B73 plus seed. The root tip tissue sample was used to create a chromosomal smear for karyotyping essentially as described by Kato et al (2011) Chromosome Painting for Plant Biotechnology, *Plant Chromosome Engineering in Methods in Molecular Biology*, ed. J. A. Birchler 701, 67-96. These chromosomal smears, stained with the chromosomal counterstain 4',6-diamidino-2-phenylindole (DAPI), were scored visually to determine the number of B chromosomes per individual nucleus. See, e.g., FIG. 1. From this data, at least one plant was identified as containing 20 individual B chromosomes per nucleus.

Leaf tissue was also collected from each plant and genomic DNA extracted. The genomic DNA was used in a Taqman® PCR copy number assay to confirm the B chromosome number in each individual plant. For this assay, a B chromosome specific marker and an A chromosome specific gene (alcohol dehydrogenase (ADH)) were amplified in the same PCR reaction. Controls included a B73 plant without B chromosomes, and 4 plants of a non-B73 germplasm with 1, 2, 3, or 4 copies of B chromosome. The ratio of signal for the B chromosome specific probe to the A chromosome specific ADH probe gave a nearly linear result when graphed. The individual plant identified by karyotyping as having 20 copies of B chromosome was consistent with the Taqman PCR copy number assay to have 20 copies of B chromosome. See Table 1.

By leveraging the 20× representation of the B chromosome to A chromosome in the DNA extracted from the identified plant with 20 copies of B chromosomes, it was recognized that a fosmid sequencing strategy could be used to identify unique B chromosome sequence by sequencing maize chromosomal DNA fragments and extracting high confidence non-repetitive unique B sequences from the data.

TABLE 1

Correlation of B chromosome copy number as determined by karyotyping to relative B marker value determined by Taqman PCR assay

| # of B chromosomes confirmed by karyotype | relative B marker value (B marker normalized to ADH control marker) |
| --- | --- |
| 0 | 0.0 |
| 0 | 0.0 |
| 0 | 0.1 |
| 0 | 0.0 |
| 0 | 0.0 |
| 0 | 0.0 |
| 0 | 0.0 |
| 0 | 0.0 |
| 0 | 0.2 |
| 0 | 0.0 |
| 0 | 0.0 |
| 0 | 2.9 |
| 1 | 25.8 |
| 1 | 47.3 |
| 1 | 36.2 |
| 1 | 34.8 |
| 1 | 42.0 |
| 2 | 87.0 |
| 3 | 112.5 |
| 4 | 128.6 |
| 4 | 138.8 |
| 4 | 150.0 |
| 6 | 175.4 |
| 6 | 97.6 |
| 6 | 231.4 |
| 6 | 84.3 |
| 7 | 311.8 |
| 7 | 252.2 |
| 7 | 66.0 |
| 7 | 242.4 |
| 7 | 224.4 |
| 8 | 262.6 |
| 8 | 326.8 |
| 8 | 347.3 |
| 8 | 328.3 |
| 9 | 326.9 |
| 9 | 306.7 |
| 9 | 305.2 |
| 10 | 390.2 |
| 11 | 406.5 |
| 13 | 482.2 |
| 14 | 496.4 |
| 14 | 576.9 |
| 16 | 661.5 |
| 20 | 744.6 |

Leaf tissue was collected from the individual plant with 20 B chromosome copies and genomic DNA was extracted using a modified CTAB method where 0.8 g of plant tissue was ground by mechanical milling, the powder was transferred to a 50 ml tube with 20 ml of extraction buffer (1.5% cetyltrimethylammonium bromide (CTAB) (Sigma-Aldrich, Saint Louis, Mo.); 75 mM Tris-HCl (pH8.0); 15 mM EDTA (pH8.0) and 1M NaCl) and the mixture was incubated in a water bath shaker at 56° C. for 20 minutes. Following incubation, the tube was centrifuged and the upper, DNA-containing, layer was transferred to a new tube. Extraction was accomplished by adding 1/10 volume of 10% CTAB (10% Cetyltrimethylammonium bromide (CTAB) and 0.7 M NaCl) and an equal volume of chloroform/iso-amyl alcohol (24:1), and this was mixed by rotating and inverting for 20 minutes, followed by centrifugation. The upper layer was transferred to a new tube and an equal volume of isopropyl alcohol was added. This was centrifuged to pellet the DNA, and the supernatant was discarded. The DNA pellet was resuspended in 5 ml 1M NaCl and 5 ul 10 mg/ml RNase, and then the DNA reprecipitated by addition of 2 volumes of ethanol. The DNA pellet was washed twice with 5 ml per wash of 70% ethanol and the final DNA pellet was resuspended in 1 mM Tris-HCl+0.1 mM EDTA (pH8.0).

The genomic DNA isolated from the plant with 20 B chromosome copies was then used to prepare a fosmid library using the CopyRight® v2.0 Fosmid Cloning Kit (Lucigen Corporation, Middleton, Wis.). The fosmid constructs contained inserts of up to about 40 kb of maize genomic sequence per construct. The fosmid constructs were pooled into 192 pools, each with approximately 1000 fosmid clones per pool. Fosmid DNA was extracted from each pool and subjected to Illumnia® sequencing following the manufacturer's protocol. Based on this sequencing, 162 of the 192 pools contained usable sequence or 'reads'. The reads from each of the 162 pools were assembled separately using assembly software tools PCAP ("Application of a superword array in genome assembly" Xiaoqiu Huang et. al Nucleic Acids Research, 2006, Vol. 34, No. 1 201-205) and CLCbio assembly cell (www.cicbio.com/products/clc-assembly-cell; Qiagen, Waltham, Mass.), and the sequence repeats for each well were masked by utilizing A chromosome repeats from a known maize genomic repeat library (maize repeats library available at Smit, A F A, Hubley, R & Green, P RepeatMasker Open-4.0. 2013-2015, www.repeatmasker.org). Next, the assembled sequence from each pool was used to filter-out A chromosome-specific non-repeat sequences by comparing the fosmid pool sequence assemblies to the maize reference B73 genome (Schnable et al., (2009) The B73 Maize Genome: Complexity, Diversity, and Dynamics. Science 326, 1112-5) (representing the maize A chromosome sequence) using alignment software Cross Match (with parameters -minmatch 17 -minscore 200 -tags -masklevel 0 -penalty -3), Phil Green, www.phrap.org/phredphrapconsed.html and using Monsanto in house scripts to parse the alignments outputs and to trim and to filter out matched chromosome A sequences. Also, the B73 mitochondrial (NCBI Reference Sequence: NC_007982.1) and chloroplast (NCBI Reference Sequence: NC_001666.2) genomic DNA was filtered out in this process. The next step was to align the sequence of each pool against the other 161 pools such that all pools were individually compared to one-another. This analysis was done to filter out "B-chromosome repeats" which were identified by a sequence that occurred in 130 or more wells, or to filter out "A-chromosome sequence which is not in the reference data set" which was identified by a sequence that occurred only one to three times across all of the pools. Finally, the remaining sequences were compared to find the longest representative sequence for each of the contig groups with multiple matches among contigs in the group. The contig sequences that were greater than 2 kb are identified as unique sequences (SEQ ID NOs: 10-13, 16, 19, 21, 22, 24, 25, 32, 34, 38, 40-45, 17-49, 55, 56, 60, 62, 64, 65, 68, 70, 72, 73, 75-79, 81, 83-86, 88-92, 94, 95, 98, 100, 102, 103, 107, 108, 110-112, 114, 116-118, 121, 123, 124, 126, 129-133, 135, 137, 138, 140-150, 154-159, 162-166, 168, 171-180, 183-197, 200-212, 214, 215, 217, 218, 220, 222-225, 228-232, 234-236, 238-241, 243, 244, 247, 249, 251, 253, 254, 256-258, 260-266, 269, 270, 273, 275-279, 281-295, 299, 301, 302, 304-316, 318-320, 322, 323, 325, 327-329, 331-335, 338-344, 346, 347, 349-354, 357-360, 363, 365, 366-373, 375-379, 381, 383, 384, 386-388, 391, 392, 395-398, 400-404, 406-412, 415, 416, 418-420, 422, 423, 428-433, 435-441, 443-446, 448-450, 452, 456-459, 461-464, 466-475, 478, 479, 481-484, 486, 487, 490-495, 497-499, 501-503, 505-508, 510-513, 517-520, 524, 525, 527-529, 531-543, 545-547, 549-554, 556-560, 563-577, 579-584, 586-593, 595, 596, 598-609, 611-614, 616-619, 621-624, 626, 627, 629-636, 638-640, 643-652, 655, 657-661, 663, 664, 666-668, 670-674, 676-680, 683-688, 690-701, 703, 705-708, 711-717, 719-729, 731-734, 736-738, 740, 741, 743-748, 750, 752-764, 766, 767, 770, 771, 773, 774, 776-785, and 787-791) to the maize B-chromosome.

Example 2: Maize B Chromosome Reference Assembly

To generate a B chromosome reference assembly, the genomic DNA from the B73 plant containing 20 B chromosome copies was prepared for PacBio® sequencing following the manufacturer's protocols. The PacBio sequencing generates long-read sequence to generate high-quality, contiguous assembly of the genome. The long-read B chromosome sequence data was combined with the unique B chromosome sequence generated from the fosmid library sequencing and analysis, as described in Example 1. The combined data sets were used to generate B reference chromosome assembly sequences 792-889. This B reference chromosome can be used to map small RNA and DNA methylation patterns, to identify novel maize genes and their respective promoters, introns, terminators, and insulators, to develop new B chromosome markers, to physically map the new B chromosome markers, to enable experiments to measure recombination that might occur between B chromosomes, and to design gene editing tools such as TALENs, CRISPRs, Cpf1, Zinc fingers, or meganucleases.

Example 3: Site-Directed Genome Modification of Maize B Chromosome

The maize B chromosome sequences identified herein are used for site-directed genome modification. A meganuclease is engineered to target one of the unique maize B chromosome sites selected from a sequence in any one of SEQ ID NOs: 10-13, 16, 19, 21, 22, 24, 25, 32, 34, 38, 40-45, 17-49, 55, 56, 60, 62, 64, 65, 68, 70, 72, 73, 75-79, 81, 83-86, 88-92, 94, 95, 98, 100, 102, 103, 107, 108, 110-112, 114, 116-118, 121, 123, 124, 126, 129-133, 135, 137, 138, 140-150, 154-159, 162-166, 168, 171-180, 183-197, 200-212, 214, 215, 217, 218, 220, 222-225, 228-232, 234-236, 238-241, 243, 244, 247, 249, 251, 253, 254, 256-258, 260-266, 269, 270, 273, 275-279, 281-295, 299, 301, 302, 304-316, 318-320, 322, 323, 325, 327-329, 331-335, 338-344, 346, 347, 349-354, 357-360, 363, 365, 366-373, 375-379, 381, 383, 384, 386-388, 391, 392, 395-398, 400-404, 406-412, 415, 416, 418-420, 422, 423, 428-433, 435-441, 443-446, 448-450, 452, 456-459, 461-464, 466-475, 478, 479, 481-484, 486, 487, 490-495, 497-499, 501-503, 505-508, 510-513, 517-520, 524, 525, 527-529, 531-543, 545-547, 549-554, 556-560, 563-577, 579-584, 586-593, 595, 596, 598-609, 611-614, 616-619, 621-624, 626, 627, 629-636, 638-640, 643-652, 655, 657-661, 663, 664, 666-668, 670-674, 676-680, 683-688, 690-701, 703, 705-708, 711-717, 719-729, 731-734, 736-738, 740, 741, 743-748, 750, 752-764, 766, 767, 770, 771, 773, 774, 776-785, 787-791, and 793-888. A maize cell is contacted with (1) the meganuclease under conditions to allow double-strand break at the selected site, and with (2) a donor DNA molecule comprising a sequence of interest to be integrated into the selected site. The donor DNA molecule may integrate by non-homologous end joining (NHEJ), or the donor DNA molecule may integrate by homologous recombination.

Alternatively, a TALEN is engineered to target one of the unique maize B chromosome sites selected from a sequence in any one of SEQ ID NOs:10-13, 16, 19, 21, 22, 24, 25, 32, 34, 38, 40-45, 17-49, 55, 56, 60, 62, 64, 65, 68, 70, 72, 73, 75-79, 81, 83-86, 88-92, 94, 95, 98, 100, 102, 103, 107, 108, 110-112, 114, 116-118, 121, 123, 124, 126, 129-133, 135, 137, 138, 140-150, 154-159, 162-166, 168, 171-180, 183-197, 200-212, 214, 215, 217, 218, 220, 222-225, 228-232, 234-236, 238-241, 243, 244, 247, 249, 251, 253, 254, 256-258, 260-266, 269, 270, 273, 275-279, 281-295, 299, 301, 302, 304-316, 318-320, 322, 323, 325, 327-329, 331-335, 338-344, 346, 347, 349-354, 357-360, 363, 365, 366-373, 375-379, 381, 383, 384, 386-388, 391, 392, 395-398, 400-404, 406-412, 415, 416, 418-420, 422, 423, 428-433, 435-441, 443-446, 448-450, 452, 456-459, 461-464, 466-475, 478, 479, 481-484, 486, 487, 490-495, 497-499, 501-503, 505-508, 510-513, 517-520, 524, 525, 527-529, 531-543, 545-547, 549-554, 556-560, 563-577, 579-584, 586-593, 595, 596, 598-609, 611-614, 616-619, 621-624, 626, 627, 629-636, 638-640, 643-652, 655, 657-661, 663, 664, 666-668, 670-674, 676-680, 683-688, 690-701, 703, 705-708, 711-717, 719-729, 731-734, 736-738, 740, 741, 743-748, 750, 752-764, 766, 767, 770, 771, 773, 774, 776-785, 787-791, and 793-888. A maize cell is contacted with (1) the TALEN under conditions to allow double-strand break at the selected site, and with (2) a donor DNA molecule comprising a sequence of interest to be integrated into the selected site. The donor DNA molecule may integrate by non-homologous end joining (NHEJ), or the donor DNA molecule may integrate by homologous recombination. The TALEN may be a single molecule or may function as a pair of molecules.

Alternatively, an RNA guided DNA nuclease, such as CRISPR-Cas9 or Cpf1 endonuclease are used to target one of the unique maize B chromosome sites selected from a sequence in any one of SEQ ID NOs:10-13, 16, 19, 21, 22, 24, 25, 32, 34, 38, 40-45, 17-49, 55, 56, 60, 62, 64, 65, 68, 70, 72, 73, 75-79, 81, 83-86, 88-92, 94, 95, 98, 100, 102, 103, 107, 108, 110-112, 114, 116-118, 121, 123, 124, 126, 129-133, 135, 137, 138, 140-150, 154-159, 162-166, 168, 171-180, 183-197, 200-212, 214, 215, 217, 218, 220, 222-225, 228-232, 234-236, 238-241, 243, 244, 247, 249, 251, 253, 254, 256-258, 260-266, 269, 270, 273, 275-279, 281-295, 299, 301, 302, 304-316, 318-320, 322, 323, 325, 327-329, 331-335, 338-344, 346, 347, 349-354, 357-360, 363, 365, 366-373, 375-379, 381, 383, 384, 386-388, 391, 392, 395-398, 400-404, 406-412, 415, 416, 418-420, 422, 423, 428-433, 435-441, 443-446, 448-450, 452, 456-459, 461-464, 466-475, 478, 479, 481-484, 486, 487, 490-495, 497-499, 501-503, 505-508, 510-513, 517-520, 524, 525, 527-529, 531-543, 545-547, 549-554, 556-560, 563-577, 579-584, 586-593, 595, 596, 598-609, 611-614, 616-619, 621-624, 626, 627, 629-636, 638-640, 643-652, 655, 657-661, 663, 664, 666-668, 670-674, 676-680, 683-688, 690-701, 703, 705-708, 711-717, 719-729, 731-734, 736-738, 740, 741, 743-748, 750, 752-764, 766, 767, 770, 771, 773, 774, 776-785, 787-791, and 793-888. A maize cell is contacted with (1) the CRISPR and Cas9 endonuclease, or Cpf1 endonuclease under conditions to allow double-strand break at the selected site, and with (2) a donor DNA molecule comprising a sequence of interest to be integrated into the selected site. The donor DNA molecule may integrate by non-homologous end joining (NHEJ), or the donor DNA molecule may integrate by homologous recombination.

The donor DNA may comprise one or more gene expression cassettes, wherein the gene expression cassettes have one or more expression elements (e.g., promoter, intron, targeting peptide, 3'-untranslated region/termination signal) to allow expression of a protein and/or RNA of interest in a plant cell. The protein of interest may be encoded by an insecticidal resistance gene, an herbicide tolerance gene, a nitrogen use efficiency gene, a water use efficiency gene, a nutritional quality gene, a DNA binding gene, a selectable marker gene, a transcription factor gene, a site specific endonuclease gene, a meganuclease gene, a DNA targeted recombinase gene or a gene encoding an RNA-guided endonuclease, such as, Cas9 or Cpf1. In some instances, the donor DNA may encode one or more of an RNAi construct, a guide sequence capable of hybridizing to a target sequence, a tracr mate sequence and a tracr sequence.

The maize B chromosome sequences identified herein are used for genome editing. One or more sites are selected from a sequence in any one of SEQ ID NOs:10-13, 16, 19, 21, 22, 24, 25, 32, 34, 38, 40-45, 17-49, 55, 56, 60, 62, 64, 65, 68, 70, 72, 73, 75-79, 81, 83-86, 88-92, 94, 95, 98, 100, 102, 103, 107, 108, 110-112, 114, 116-118, 121, 123, 124, 126, 129-133, 135, 137, 138, 140-150, 154-159, 162-166, 168, 171-180, 183-197, 200-212, 214, 215, 217, 218, 220, 222-225, 228-232, 234-236, 238-241, 243, 244, 247, 249, 251, 253, 254, 256-258, 260-266, 269, 270, 273, 275-279, 281-295, 299, 301, 302, 304-316, 318-320, 322, 323, 325, 327-329, 331-335, 338-344, 346, 347, 349-354, 357-360, 363, 365, 366-373, 375-379, 381, 383, 384, 386-388, 391, 392, 395-398, 400-404, 406-412, 415, 416, 418-420, 422, 423, 428-433, 435-441, 443-446, 448-450, 452, 456-459, 461-464, 466-475, 478, 479, 481-484, 486, 487, 490-495, 497-499, 501-503, 505-508, 510-513, 517-520, 524, 525, 527-529, 531-543, 545-547, 549-554, 556-560, 563-577, 579-584, 586-593, 595, 596, 598-609, 611-614, 616-619, 621-624, 626, 627, 629-636, 638-640, 643-652, 655, 657-661, 663, 664, 666-668, 670-674, 676-680, 683-688, 690-701, 703, 705-708, 711-717, 719-729, 731-734, 736-738, 740, 741, 743-748, 750, 752-764, 766, 767, 770, 771, 773, 774, 776-785, 787-791, and 793-888. The one or more sites are targeted with an engineered site-specific meganuclease, endonuclease, or DNA targeted recombinase. Then, a maize cell is contacted with (1) the engineered site-specific meganuclease, endonuclease, or DNA targeted recombinase under conditions to allow double-strand break at the selected genomic site, and DNA is deleted or inserted (indels), or a DNA base is changed.

Example 4: Maize B Chromosome Probe Development

The maize B chromosome sequences identified herein were used to develop maize B chromosome specific PCR primer sets. For example, Table 2 details three sets of PCR primers which amplify a region of B chromosome specific sequence from SEQ ID NO:175, 177, and 183. Specifically, PCR primer pair SEQ ID NO:889 and SEQ ID NO:890 amplify a region at the coordinates 2626-2825 of SEQ ID NO:175; PCR primer pair SEQ ID NO:891 and SEQ ID NO:892 amplify a region at the coordinates 1170-1368 of SEQ ID NO:177; and PCR primer pair SEQ ID NO:893 and SEQ ID NO:894 amplify a region at the coordinates 1118-1319 of SEQ ID NO:183. A control set of PCR primers SEQ ID NO:895 and SEQ ID NO:896 for a proximal B chromosome region, labeled BCHR0004, were identified from the sequence DU978594.1 pCL7T-2 CL-repeat reported by Cheng et al. *Chromosome Research* (2010) 18:605-619. A control set of PCR primers SEQ ID NO:897 and SEQ ID NO:898 for a proximal euchromatin region 2/distal heterochromatin region 1, labeled BCHR0006, were identified from the sequence DU820494 pCL38T-2 CL-repeat DH1 reported by Cheng et al. *Chromosome Research* (2010) 18:605-619. And, a control set of PCR primers SEQ ID NO:899 and SEQ ID NO:900 for a distal heterochromatin regions 3-4 B chromosome region, labeled BCHR0007, were identified from the StarkB repeat sequence reported by Lamb et al. *Chromosome Research* (2007) 15:383-398.

TABLE 2

B chromosome specific PCR primers

| SEQ ID NO of PCR primer 1 | SEQ ID NO of PCR primer 2 | PCR primers amplify region in SEQ ID NO | Coordinates of PCR amplicon |
|---|---|---|---|
| 889 | 890 | 175 | 2624-2825 |
| 891 | 892 | 177 | 1170-1368 |
| 893 | 894 | 183 | 1118-1319 |

The PCR amplicons were mapped to the B chromosome using previously characterized B-A translocation lines. Corn with B-A translocation events were acquired from the Maize Genetics Coop Stock Center (www.maizegdb.org/stock_catalog). The samples used for testing the primers and control B-specific probes were tertiary trisomic lines containing the B-A translocation (in addition to two normal A chromosomes), but not the reciprocal A-B translocation. Because of transmission issues, the Maize Genetics Coop stock center maintains these B-A translocations as heterozygotes. Thus, the seed packet delivered does not always contain tertiary trisomic material. If that is the case, then the translocation heterozygote (verified by FISH screening from the packet received from the coop) was crossed to a tester germplasm with a tester line, and color markers were used to identify likely tertiary trisomics in the F1 generation, which were then grown and sampled.

Figure 2:
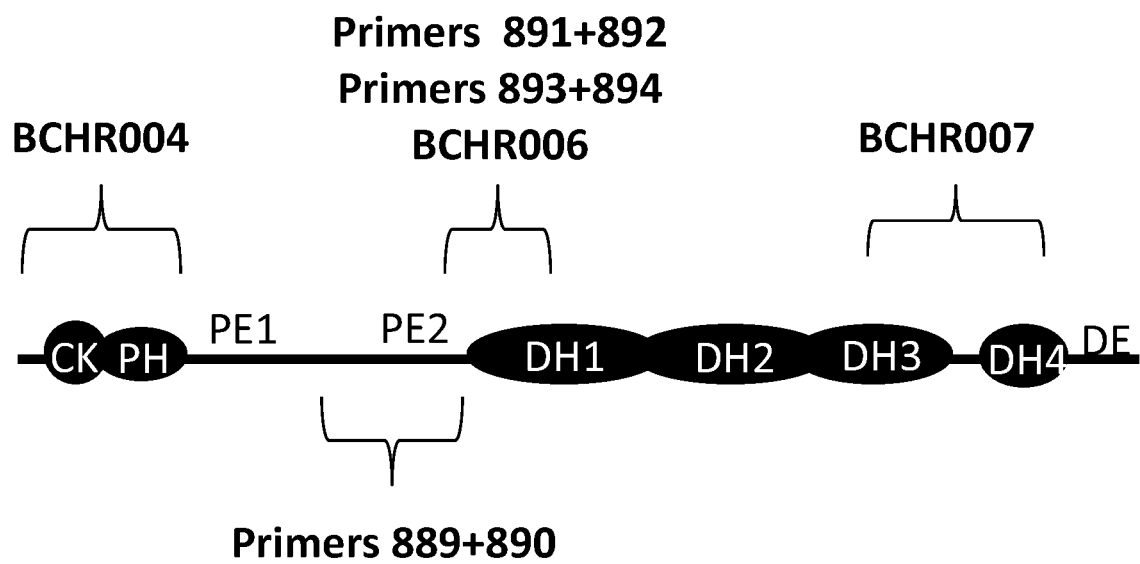
FIG. 2. Mapping of maize B Chromosome/A Chromosome translocation using B chromosome primers. Control PCR amplicon regions are indicated: BCHR004 for proximal region; BCHR006 for a proximal euchromation region; and BCHR007 for a distal region. The regions for the PCR amplification primers identified from the unique B chromosome sequence are indicated as primers SEQ ID NO:889+890; SEQ ID NO:891+892; and SEQ ID NO:893+894. Abbreviations on schematic of B chromosome are as follows: CK indicates the region of the B chromosome centromere; PH indicates the region of proximal heterochromatin; PE1/PE2 indicates the region of the proximal euchromatin regions; DH1-4 indicates the regions of distal heterochromatin regions; and DE indicates the distal euchromatin region.

DNA was extracted from tissue collected from the tertiary trisomic plants containing the one of the B-A translocation chromosomes (specifically, TB-10L7, TB-10L37, TB-10L3, TB-10L30, TB-10L19, TB-10L26, and TB-10L36); or a sample containing a full-length B chromosome (positive control for all probes); or a sample without a B chromosome (negative control); or a sample from a line with a spontaneously truncated B chromosome. The DNA was used for PCR amplification using PCR amplicon regions BCHR004 for proximal centromere region; BCHR006 for a euchromation region; and BCHR007 for a distal heterochromatin region; and the PCR amplification primer pairs identified from the unique B chromosome sequence (SEQ ID NO:889+890; SEQ ID NO:891+892; and SEQ ID NO:893+894). Results for the presence or absence of a PCR amplicon are presented in Table 3. These results are illustrated in FIG. 2, where the regions of the B chromosome mapped by the probes are indicated by brackets. For example, probe BCHR0004 was mapped to the proximal/centromere region of the B chromosome; probe BCHR0006 was mapped to the proximal euchromatin 2 (PE2) and DH1 region; probe BCHR0007 was mapped to the distal (DH3 and DH4) region; the PCR primer pair amplicon SEQ ID NO:889+890 mapped to the proximal euchromatin 2 (PE2) region; and both PCR primer pair amplicons SEQ ID NO:891+892 and SEQ ID NO:894+894 mapped to the proximal euchromatin 2 (PE2) and DH1 region. These results demonstrate that the unique B chromosome sequences presented as SEQ ID NOs:10-13, 16, 19, 21, 22, 24, 25, 32, 34, 38, 40-45, 17-49, 55, 56, 60, 62, 64, 65, 68, 70, 72, 73, 75-79, 81, 83-86, 88-92, 94, 95, 98, 100, 102, 103, 107, 108, 110-112, 114, 116-118, 121, 123, 124, 126, 129-133, 135, 137, 138, 140-150, 154-159, 162-166, 168, 171-180, 183-197, 200-212, 214, 215, 217, 218, 220, 222-225, 228-232, 234-236, 238-241, 243, 244, 247, 249, 251, 253, 254, 256-258, 260-266, 269, 270, 273, 275-279, 281-295, 299, 301, 302, 304-316, 318-320, 322, 323, 325, 327-329, 331-335, 338-344, 346, 347, 349-354, 357-360, 363, 365, 366-373, 375-379, 381, 383, 384, 386-388, 391, 392, 395-398, 400-404, 406-412, 415, 416, 418-420, 422, 423, 428-433, 435-441, 443-446, 448-450, 452, 456-459, 461-464, 466-475, 478, 479, 481-484, 486, 487, 490-495, 497-499, 501-503, 505-508, 510-513, 517-520, 524, 525, 527-529, 531-543, 545-547, 549-554, 556-560, 563-577, 579-584, 586-593, 595, 596, 598-609, 611-614, 616-619, 621-624, 626, 627, 629-636, 638-640, 643-652, 655, 657-661, 663, 664, 666-668, 670-674, 676-680, 683-688, 690-701, 703, 705-708, 711-717, 719-729, 731-734, 736-738, 740, 741, 743-748, 750, 752-764, 766, 767, 770, 771, 773, 774, 776-785, 787-791, and 793-888 are useful for developing PCR primer amplicons useful for B chromosome mapping, and B chromosome unique probe development. The B chromosome unique PCR amplicons and probes have utility in applications of Southern analysis and Northern analysis, as well as other molecular biology and sequence related protocols.

TABLE 3

Result of B-A Translocation mapping.

| B-A translocation source | Control probe BCHR004 | Control probe BCHR006 | Control probe BCHR007 | Primers 889 + 890 | Primers 891 + 892 | Primers 893 + 894 |
|---|---|---|---|---|---|---|
| Full-length B chrom | + | + | + | + | + | + |
| 10L7 | + | − | − | − | − | − |
| 10L37 | + | − | − | − | − | − |
| 10L3 | + | − | − | − | + | + |
| 10L30 | + | + | − | + | + | + |
| 10L19 | + | + | − | + | + | + |
| 10L26 | + | + | − | + | + | + |
| 10L36 | + | + | + | + | + | + |
| spontaneous truncated B | + | + | − | + | + | + |
| No B chrom | − | − | − | − | − | − |

(+) indicates PCR amplicon present,
(−) indicates no PCR amplicon

Example 5: B Chromosome Transgene Insertion

Transformation of transgenes into corn germplasm containing B chromosomes was done to evaluate methods of detecting transgene insertion into corn B chromosome. Two transgene transformation vectors (transformation vector A and transformation vector B) conferring glyphosate tolerance were transformed into corn immature embryos using *Agrobacterium tumefaciens* to produce transgenic plantlets according to methods known to those of skill in the art. The F1 immature embryos used with transformation vector A were derived from a cross of parental germplasm of B73+B chromosomes (range from 6 to 15 B chromosomes) (female) X LH244 (male). The F1 immature embryos used with transformation vector B were derived from a cross of parental germplasm of LH244 (female) X B73+B chromosome (range from 4 to 16 B chromosomes) (male). Following transformation, glyphosate was used to select for progeny containing the transgenes. At the step of transferring the plantlets to soil, root tip samples were taken for FISH analysis. The FISH probes were designed to the transgenes randomly integrated into the corn genome during transformation, and FISH was done essentially as described by Kato et al. (2011), including a DAPI counterstain. From this analysis, no B chromosome insertions were identified with transformation vector A. FISH analysis of root tip tissue from plantlets generated with transformation vector B identified about 10 events of random transgene insertion into B chromosome. Leaf samples were taken from the plants identified by the FISH analysis as having confirmed B chromosome transgene insertion and DNA was prepared. The DNA was used with inverse PCR (Hui, et al. (1998) Cell Mol Life Sci. 54:1403-1422; Tonooka and Fujishima (2009) Appl Microbiol Biotechnol 85:37-43.) to identify flank sequences of the transgene insert. Of the 10 events, 5 had a single copy of the transgene inserted into the B chromosome, and left and right flank sequence was obtained (Table 4). The flank sequence was used to map the transgene insertion site to the B chromosome sequence, thus confirming the FISH analysis.

The unique B chromosome sequences presented as SEQ ID NOs:10-13, 16, 19, 21, 22, 24, 25, 32, 34, 38, 40-45, 17-49, 55, 56, 60, 62, 64, 65, 68, 70, 72, 73, 75-79, 81, 83-86, 88-92, 94, 95, 98, 100, 102, 103, 107, 108, 110-112, 114, 116-118, 121, 123, 124, 126, 129-133, 135, 137, 138, 140-150, 154-159, 162-166, 168, 171-180, 183-197, 200-212, 214, 215, 217, 218, 220, 222-225, 228-232, 234-236, 238-241, 243, 244, 247, 249, 251, 253, 254, 256-258, 260-266, 269, 270, 273, 275-279, 281-295, 299, 301, 302, 304-316, 318-320, 322, 323, 325, 327-329, 331-335, 338-344, 346, 347, 349-354, 357-360, 363, 365, 366-373, 375-379, 381, 383, 384, 386-388, 391, 392, 395-398, 400-404, 406-412, 415, 416, 418-420, 422, 423, 428-433, 435-441, 443-446, 448-450, 452, 456-459, 461-464, 466-475, 478, 479, 481-484, 486, 487, 490-495, 497-499, 501-503, 505-508, 510-513, 517-520, 524, 525, 527-529, 531-543, 545-547, 549-554, 556-560, 563-577, 579-584, 586-593, 595, 596, 598-609, 611-614, 616-619, 621-624, 626, 627, 629-636, 638-640, 643-652, 655, 657-661, 663, 664, 666-668, 670-674, 676-680, 683-688, 690-701, 703, 705-708, 711-717, 719-729, 731-734, 736-738, 740, 741, 743-748, 750, 752-764, 766, 767, 770, 771, 773, 774, 776-785, 787-791, and 793-888 are used to select specific target sites for genome modification, to select specific target sites for transgene integration, and to facilitate B chromosome transgene flank identification. Additionally, inclusion of the unique B chromosome sequences presented as SEQ ID NOs:10-13, 16, 19, 21, 22, 24, 25, 32, 34, 38, 40-45, 17-49, 55, 56, 60, 62, 64, 65, 68, 70, 72, 73, 75-79, 81, 83-86, 88-92, 94, 95, 98, 100, 102, 103, 107, 108, 110-112, 114, 116-118, 121, 123, 124, 126, 129-133, 135, 137, 138, 140-150, 154-159, 162-166, 168, 171-180, 183-197, 200-212, 214, 215, 217, 218, 220, 222-225, 228-232, 234-236, 238-241, 243, 244, 247, 249, 251, 253, 254, 256-258, 260-266, 269, 270, 273, 275-279, 281-295, 299, 301, 302, 304-316, 318-320, 322, 323, 325, 327-329, 331-335, 338-344, 346, 347, 349-354, 357-360, 363, 365, 366-373, 375-379, 381, 383, 384, 386-388, 391, 392, 395-398, 400-404, 406-412, 415, 416, 418-420, 422, 423, 428-433, 435-441, 443-446, 448-450, 452, 456-459, 461-464, 466-475, 478, 479, 481-484, 486, 487, 490-495, 497-499, 501-503, 505-508, 510-513, 517-520, 524, 525, 527-529, 531-543, 545-547, 549-554, 556-560, 563-577, 579-584, 586-593, 595, 596, 598-609, 611-614, 616-619, 621-624, 626, 627, 629-636, 638-640, 643-652, 655, 657-661, 663, 664, 666-668, 670-674, 676-680, 683-688, 690-701, 703, 705-708, 711-717, 719-729, 731-734, 736-738, 740, 741, 743-748, 750, 752-764, 766, 767, 770, 771, 773, 774, 776-785, 787-791, and 793-888 in genome sequence analysis is used to improve specificity (and thus reducing off-target effects) of target site selection of both A chromosome and B chromosome genome modification.

TABLE 4

B chromosome transgene flank SEQ ID NO

| | SEQ ID NO | |
|---|---|---|
| Event # | Left Flank | Right Flank |
| event 1 | 901 | 902 |
| event 2 | 903 | 904 |
| event 3 | 905 | 906 |
| event 4 | 907 | 908 |
| event 5 | 909 | 910 |

Example 6: B Chromosome Marker Development

The B chromosome sequences identified herein are used for B chromosome marker development, essentially as described in US20060141495, which is incorporated by reference in its entirety herein. Identification of SNP and Indel polymorphisms is accomplished by comparing alignments of sequences of contigs and singletons from at least two separate maize lines. Genomic libraries from multiple maize lines containing B chromosomes are made by isolating genomic DNA from different the maize lines by standard methods known in the art. For genomic libraries, genomic DNA is digested with a restriction endonuclease enzyme (for example, PstI), the digested DNA is size fractionated over 1% agarose gel, and recovered DNA fragments are ligated in a plasmid vector for sequencing by standard molecular biology techniques as described in Green and Sambrook (2012). All sequences are assembled to identify non redundant sequences as described in Example 1 and Example 2. Sequence differences from multiple clones on assembled contigs are identified as single or multiple nucleotide polymorphisms. The B chromosome sequence from multiple maize lines is assembled to into loci having one or more polymorphisms, i.e. SNPs and/or Indels. Candidate polymorphisms are qualified by the following parameters:

(a) The minimum length of a contig or singleton for a consensus alignment is 200 bases.

(b) The percentage identity of observed bases in a region of 15 bases on each side of a candidate SNP, is at least 75%.

(c) The minimum sequence reads in a given contig is 4.

Once regions of polymorphism are identified, Taqman® probes are designed to detect the specific genotype in a corn DNA sample. Such probes can be designed and provided by Applied Biosystems for their proprietary Taqman (Registered trademark) assay (Applied Biosystems, Foster City, Calif.). To confirm that an assay produces accurate results, each new assay is performed on a number of replicates of samples of known genotypic identity representing each of the three possible genotypes, e.g., two homozygous alleles and a heterozygous sample. To be a valid and useful assay, clearly separable clusters of data points, such that one of the three genotypes can be assigned for at least 90% of the data points, and the assignment is observed to be correct for at least 98% of the data points. Subsequent to this validation step, the assay is applied to progeny of a cross between two highly inbred individuals to obtain segregation data, which are then used to calculate a genetic map position for the polymorphic locus. The SNP analysis is also used to aid selection of B chromosome target sites for site-directed genome modification, as detailed in Example 3.

SEQUENCE LISTING (910 sequences)

SEQ ID NO: 1 - DNA, 28189 bp, Zea mays
agcgatccctccccgtccgttttttttagcgccgattggagcgagtatggcaaacccaaagcgagcatcgctccgagcagtcaaggacggcgagcaggtagcggctccgaagcctattacttccgtgttggaagctgccgagaatggcaccgtgctggatgagttggagcaaatgcgccgcgttgcgtcgaggcgtattgatgacccgaacacaaacccaacagccctcgccgctctaatgcgtcgtcaaattgagatctctcgggaaatagagacgctaaaacgtcaaaagtccgaggaggccgaatctattggcgcaaccgaagactcggagtggtcagaagaagctatctgaggtagctcgccatatctgccgccccactggaatagtgtccacgggctggccggctgtcaaagagcgcgccgaaaagatgggtatgccctctgatgcatggcaggacggcattggtcgcctagccttagcgaagcgtgactctggactctacgccgctggaattggcggcgtcatcctctcaatccctcgccaggtcggtaagacctacctcatttcgcttatcgtgttctccctgtgctcactcttcccgaatctcacggtgatctggactgcgcatagaacgcgaacgcacaatgagacattcaagaagatgcagtccactgccaagaagccgaaagttgcgccttggattgagaatgtccgcgccactaacggcgagcaggaaataacattcgtcaacggctcgcgaatcctcttcggtgctcgcgaatccggctttggtcgcggcttcgacgaggttgacatccttgttctagatgaggctcagatcctctctgaggacgccatgacggatatggttccggcgacgaacgcggcacccaatggcctagttttcatgatggggacgccgccacgcccacgcgataatggcgaggtctttacgtccgctcgctcagacgcactaagcggcgacgaggaccgtctctatatcgagctttccgctgataaaaacgccaacatcaatgatcgttcgcagctggcaatcgcaaacccttcttatcctcaccgaacaaccgaagcggcaattcttcgaatgagaaagctgctcggatccgatgagaacttcaagcgcgaagctctcggaatctgggatgaaacttcgctcacccgaaaggccgtcaacttcgataagtgggcggctcgttccatctcatctaccgacgttccgcgtgacggcatccgagtttttgcagtgaagttctcaattgatggatctgcaatcggtctcgccgccgcaactcgccccgccaatggccccgtgcatgtggaggctatcaagcaggccccgtcgagcaacggcacgtcatggctcattgattggcttgttgagcgcaaagaaagcaccgcccagattgtcattgaaggaaagtctggagttgggtatttggtaaacgctctaaggactgagggaattccggaatcggtaatcaagaccccatccgccgatgaagctattgcagctcacggaatgttcgaatctgcaatcgcggataacggcattactcatatcagccaacaagcgctcgacgatcaaataaaaccagccgtaaagagaaaaatcggcaacaacggcggcttcggctgggcttcccccgacggcggcacggtcgtcctattcgacgccgtgacgttcgcattctggggcgcaaagactacaactcgaaatccgagaagaaaggcggtgttcttgtgagcacttggactacctcggacatctcgaagatctccatttccggcgttaccgatgctgagcgagacacaatctcggggcttctcagggcatggaatggccgcctagagaagaaccagcgccgcagcctctattacgacggcgaacaagcgttcaaggatcttggactcatgctcccgccgcagctaaagaacgcgaagttctaccttggctgggcgactatggcagttcgcaagctggcgtcaatgagtcagtttgagggcttacgactccccggctctgaggatccgtttgagcttggcgaggtttttgaagccaaccgtttcggtctcgaattctcacagggtgtcacttctgcatataagcacggcgtatctttcgcgacggtcgccaagggtgctcctggtgagcctgatgttcagattcagacgcattccgcagagcatagctcggcactctgggacgctcgacgccgcgcaatctctgcggcgctcacgattaccgacactaaaaacggtagaccgtccgcatttattgtttatcttcctgacgcgattcttcattgccgcttaggtggcaagggaacgtggatcacggagcgcacgaaaaacattattgggcgcaccctagcggtcgcgatcacctatgatccgcagctagggaagccgtttgggcgttcgcgtattactaatccagttatggcgcttacggatatggccgttcgagcctatgtccgcatggaaggcaatgctgagttctactcatcgccacaggttgccattgagggcattgacgctgaggcgtttgacggtgacccgtcatctcagaagcgcttccagctcgcaatggatcgtcttatcgctctcacgcgagacgcggacggtcacgcgccgaatatcaagcaactccagcaagcaacaatggctccacactcggacatgttgcgcacggtagcaatggcattctctggcgaaactggaataccaccggcaagccttggaatcatccatgacaatccgtcatccgctgaggctatccgggcgaataagcatgacctactcgtggatgcgacattccagaacaagtacgttcttggaaccgccgttcgcgatattgcctcactcgccgtcatggtgcgcgatgggctaagcgaaccaccttctgacatgtggcaactctccgcgaagtttgcggaccctgagttccggtcaacctccgcgaatgccgattcttacgtgaagctggcgagcgcgaatccggcgcttgcacagtcccaggtattgcttgaaacggtctttgacgacgatcaggtgaagcgcattcagtccgacgtgaaccgctctgcaattacgcagttagtccagaacattggcgcgaatcgcggaagtgatgcgcagtcaatggtcgcaaccgcagagggttcaaccggcaccggatcggtgactagttaggggatctcgtgacggttttccctattgaggtcactcaaggctttcgcctggttcaagaagagattcgccgcgaagcctatgcgcgattatcgcaattggttgcggctgggattactcgcgagcaattgattgatattgctccggagatcttcggcccacttggcgatcttatgatcaccgcgagcgtcaagtggtacgacgagttgcgcgagcttcaagaggtctccggatcattcgtggcggaaccgcttgagtccgtgtctcgctcgcggtggcactccttggcagggtatggcacgagttcggttgcacttgatgaggtcgtggacgctgatgcgtttgggcgtattgcgggcgggctgacatgggttctcactgaggcgtcattcgacacaattattggcaacgccgagattgatacaaccccggttggataccagcgcgttccgagtgccggctgctgcgcgttctgcgcaatgctcgcgtctcgtggcgctacgtatggctcctacgagtccgcaaaaacggtcgtagggcgtggaactgagattccaaaggttcgacgccgtggcggtcaagcaaagggcatccgtccacgcggatcccgccgactcggagacagctttcacgactattgccgatgcaccgtagttgcggtgcatgagggcaactctttcaagctcgaacaggacgcagatcgctactacgagcaatacagcgaatcagcgaagaaggtttctgagggtcaagagtggattcctggagagcgtgacgctgacggtaatcgcaccactaaggggcgatgggttgacgctgacggaaaaactcgctccgacaaggaaaagaagcaacagatcctcgcttcaatgcgctccgaattaggaatgcgctaacaaggttttcacggcccaccgtgaagcggcacgcacccgttcaagtgcggtcaatgatgccagacgtggctaaacggagaggtgattcggcatgcccgatgcagtaaacaacaccagcacggtggacgaacaaaccactaacgccgttcaggcggacgcggtaaccagtgctcaagaattcaaggctccttcttcacaggaagagcttgaccggatcattggcgagcgcgttgcacgcgagcgcaaaaagtatgagggatacgacgaactcaaggctaaggctgagcagttcgagtcggttctctctgaaaagtctgcactcgaaaacaaggttgctgagttcgaagcgcagtctgagcgcaatggttggctcgctgaaatctccaaggaatacggcattgcgccagacgtcctccgaggtggcacgcgagacgaactagttgcccatgctgagcagttgaagtcattccttgttccacagtccggcccagttattcaagggcaagaaaaagttccagcgccaattgaggcgagcgacgaaatcaaggccgtccgctccctgtttggcgcataaaccgaaaggtaaatcatggctattttcagcaccgctgaagccaaggttctgctcccgcgcaatatcgcggacggcatgatcaaggaaacccgttcactttctaccgtcgcaaagctttcaggccgcgagcctatgaagttcggcgagaccgattacatcgtattcaacgacttcccaaaggcggagtttgttgaagagggtgccgacaaggcgagcacgagtggcggcttcagccccgttacggctaagcctcacaaggcgcaggttacgatgcgcttcagcgaagaagttcagtgggcatccgaggattaccagctgaacgtctttagtgagcttgcaagcgccggtcaggaagcactttctcgcggcctggaccttggcgtctaccaccgcatcaatccgcttaccggatccgttatcaccgcctgggataactatgttggcgcaaccacgaagcgtgttgaaatcgccacggctgacgctgatgcggatatccgcaccgcagctggcctgctcatcaattcggccccatcctggggcgtaaatggcatcgcgattgaccctaagtttgcttgggcgctcgccgacctccagaccgagaatgcagacggatccccttctgggtctcagcgctacccgaaccttggactcggaacggacatcacctcgttcgcatccatcccagcagctcagggcaacaccgtatccggcaccccggaggcggttgatacgaaggttcgcgcaatccttggcgacttccagaacggcatccgctggggtattcagcgcgagcttcctgttgagcttatccgcttcggcgatccagacggtcagggtgacctcaagcgcaggaaccagatcgcacttcgcctcgaagttgtttacggctggtacgtattcgctgatcgcttcgctgttatcgaagacaaggttgcataacttgcctcgcttcaaaaataaggtaaccggctccattgtgaacgttgacgaagagactgcaaagactctggatcagacgttcgtaaaggttgtcgaaaaggcatccgcagcttctgagaaataaggggtaagtcatggccgacgtaacgcagtttgcgacacttgctgagcttattgagcgctggccagactttcccgcaggggctgaggatcacgccaacgtgttgctcgctgatgctagtcagttcattgtggacaccgttcccagtgcgctggccgcatcggcgagcacacttcggcgcatcgtttgtgctgtcgtaaaacgtgcaatggcatctggcgacatggctggcaatgagtcggtccagtttggagccggcccattccagatgaccgccaagccgaccaatccacacggcgacttctacctaaccaagcaagagcgccgcgcgctgggtgaggggcgtcaaacggcgttcggggttcagatcgcgtcattctatgcggttattcatcgtccttggtgcaatctgaattttggcgcgctctactgctcgtgcggcgctgacattgcgggggttccaatttatgaataaccgcatagtcacccgtttccccgcctcatggcgcacctcgtttacgattcttcgcggcggcggtcgcgacaagttcactaatccgcttcccgaatccgagattgaagttccgcatggtctaatcgcgcctcgcgtctcgactgagcaggacgacttttcggatctcgcagacgcaaccgccgtgctgtattgcgatctaacgcccggtttatcgttcttgaacactgaccggatacgcatcccagaaggctcgcgtttggctggtatttggtcaatcgtggggcgtcctggtgaatggccgtttggctgggaagtggggctaaagaaatgaagctccagaagattcccggcgtcaagagttaccgctcgctgaatcagggcttgcgcgttcttggcgcgtctagcgagatcggcaaggcgactctagaggttgctgagggtgttgcgggatcggctaactcgatgggtgaagcggagtattcagcggtgcccacgtcggttcgctttggtcgcaacaatgaagagcgttctggtgcgtccgtgcaggtgacgacgcagcattggcgcgacgctcgcgatcaggttcttcttcgccttattcaggttatgaaggtgagtaagtaatgtacgacgctctcatttggcctgacatccgcaaggctctcgtgctcatggtggacggcgaggaacacgctggttcagtcatctacgcagctcagcatatggaagttgacgctaacggaatctcacatattccgctcgcgttattcctcgattcggctggtggaaacatcggctatatcgaccgtgccgaccgtgtgctgattgaggtttacgcgccgggcgagcttgcaaagaagatcctcgaaagcatcatcacctcattgtgtggtgacggcatcgaggggcctgacgtgttcttcgattccattcagtgcatcgtcccgcctactgaatcgccttacccgcaagacactctaaatctagcaacggcggtcattgagactatcgttcgcccgctcgactagtcgcccacctttcaccccactcggggtttctccacattgacaccctcgaaaggggttatttgctatgtccacagtagaaactgagcgcaaggacttcgactcccgcgcactcgttcggaaaactacggtaggtctcgcgtgctttgcacctaagactgtcgagcttccggctaccctccttacttctgcaaccgaaatcgcagacctgtccacgctgggcttcattcccattggcatggttacccgcgacggttacacgttctccggcgagatcgaaaaggaagacattgacgcacttggctattacagcccggtccgctcggatgttacccgcgtaccgcgcaccgtttccatgacgcttcttgaatccggcaaaaaggccattcaggaactcgtgcgcggtacgaagatcaccgaaacgcagtctgctacgactggtgaagttgtcttcgatgagccagacctcccgaacttcgatgaagtccgcctgatcgtagtatccgctgacggcccactgtccaatcactggatcgaggggcgcggattcttcgccgcaaagatctcatcccttggcgaagagacgtgggcgcatgaaggtgctcaccagcgccaagtgacgttcgacatcttcaatgatgacgtcgagggcgtcccggttcgccattacttcggcggctccggcgcgattctcgctaaggacattctgggatacacccagggcgcctaacccctagttgtggcgcgcacgtccttgggcggctcgtgcgcgccgcttttcattgccgccccacgaaaggtagtcatgcctactttttccaatggtgcccaaaaggtcaccgtaagcaagccaacccgcgcagaaattcagcgactcaaggcacttggattctttgaagagaagcccgcgccaatcgttgaagccaagccagtaaacccatctaagtaaaggagccagtcatggcagccgcccgcaagatttcagataagccagcaccacgtcacaccatcggatccattatcaaagacggcgaggacgttgagccatatgtgctcgtgctcgccgatgggtcagagatcacctttgtttctccggaagaactcgaagctgagtcaggtgttcgactgctccgagctgcgacgattcgcccgcatgagttgtgggagattcttggtgaatggcttcccgaagaagagcttcgattgattcgcaagcagaaattcacgcttggtcagattggcaagattctcgccgctgtcaagactcactttgaggacttcttcggcccctcgggaaactagaacgcctcgatgcgctcttagaacggtttaggccagagatccgcgccgatctcgcacatgagtacggcgtggatctctcattgttctatcagcgccgcaggtacgtggcattgctggatctcattgatcagctcccgcgcacctcgcgttacttcgaggcgatgtccaaggatcctgagtttattcaggcgcgtctagagattgaagaatctcgcaccgacgacgaagaggataacactccagagtggcatccaagcatcacagagtttggactcactgagcagctacttcgcgagcttctgcactcaatccaagagggcaacatgatcgccatgcgtgcagctggtggcaagcctccgaaacctaagccattcccagcgccgttcgatccactcgccgaagcacgcgctgatcgcgagattgagcacgtcgcgggactcgctgagatgtttggcttcaagcgctctgacgtcactctaaagccgccaaaaaactaaatcctttaagggggtcgcatgcctactatcggcgttgctgaggtactgattcgaccgtctttcaaggactttcaaaaggaagtcggcaaggttgttgacggcacctctaagggtggtcaagaatctggcaagagcttcggctccgggttttctggtgccgctaagggtgcattgcttggcggtgctgcggctgcggctggcggtttcgcgttggcactcactaagggcttcggacgactccagagcctagagaatgcacgcgctaaactagccggcctcggtcacgatacgaagaccgttgagaccatcatgaatgacgcgctgaaatccgtaaagggtaccgcgtttggcatggatgaagcggccacggttgcggcttcggctgtggcgtctggcgtgaaacctggcaaggatctagagcgcacgctcaagcttgttgctgatgcttccactattgccggcgttcccatgaatgaaatgggcgcaatcttcaacaaggttgcaggtaccggcaagattcagggtgaagtcctcgcgcagcttggcgagcgcggcatccccattctccagctccttggaaagtccctaggtgaaacccctgagtcagtccagaaaatggcatcagagggaaagatcggcttcgaggatttccaaaaagccatggagcagggcatgggcggcgctgctctcaagtctggcgacacgttgcagggtgctttcaataacacgctcgcgtctatcggccgcgttggcgcaaacctcttgagcaaggtttacccgaagttcacggagttcttcaaggggctgctcaagcttctggagccggtagaagagtgggctaaaaaggctggcgaggctattggtaaattctttgacgaacagctcgtgccattctttgcagcgctctgggattggctcggtaagaatacgccgctcctgtggtctatcgcgggcgctgcggctgcattcttcactggtcttcttatttacaagacggttacgggaattattggattcttggcggctgctcgcgtcgcattcctgaaactcaacgcggcaatgctggcgaatccgatcttcattgtgattggtcttatcgcgctcctagttggcgctctggtgtatctctaccagaccaatgaggacgctcggaagttcatggatgaagcgtgggctggcattcaaaaggtcatcaagtgggcttgggagaatgtcattcaaccggcattcaaggccattgtcgatttcgtgatgaacgttctcattccggccattgtctggttctggcaaaacgtgatcgtcccagcttggaacggcatctcggcagccgtgaaatgggcctgggagagtgtaattctcccagcgtttagggcgattcgcgacttcatcaacaacgtcctagcgccaatcttcaaatggctttacgagaacattattcgtccagtttggcaggctatcgtcgcagctgtctctatcgcttggggcattctggatacgatcttccgaaccattgtatgggttgtgaaaaacgtcctctcaccagcctttacatggctctataagaacatcatcaagccggtttgggacaaggtttctaaggtcatcacggatgcgtgggaagacgtcatccagccagcattgcgcgagttcggtaacttcttccgcgacgttcttgagccagcgttcaaaaagggcgttgatgcgatcaagaagatctggaatggcatccagcgcatcgcagcggctccaatcaactttgttatcggcaccgtctataacgatggtctccgcgttgccctgaacaaggttcgcgagatcgtcggcggcgacgcactgccacgacttggattgattgacgtccccgcatacgccactggtggacaaatgcgcaacggctggaagctcgtgggcgaagaaggccccgagcttatccacacaggccccggctacgtctacacggcgaacgagaccaagcgcatgttggcatcacaacagcaagcgccaatggatgcactcgatacgctcaacggcggacgctccaagaattccccactgccaatcggcggctggctggaagagcttggaaacttcgggcgcgacacagtgcgcaatatcggcaacggtctcgactgggtgcgtggcggactggcagatgtggcgtcaatgctactgaatcccgtcaaggacgcaatcaagacgctcctacctggagagaatgctttcccggatattgctcgccgtgcttcgacgggtgcaatcgacgcggccatttcatggattcgcggcaaggatcagatgaccggcgatttcggcggcggcgctggtgggtacttcggctacgacggaccgcttggcaacttctaccgtcctcgcggtgtcatcacgtccggctttggtacgtctcgtggtcgttacccgcacgcgggcatcgacttcgcaagcccagtcggtacgccattccgcgcaatgtacaacggcatcgttcgcaaggcgggctggaacatcgttgcagggcgtacaggtattggtcagctcattgatcacgcgaacggcatctctacctacgtgggccacctttcaaaggttctcgcgggtgcaggctctcgcgtcaagggcggccagattacggcgcttaccggcaatacaggtaagtccaccggtcctcacgctcacgttgaaatgtggaagaacgggcagccgttcaactgggctggatacctccagcgcggtggtggcggtcccgtcaaggcgttcgctaatggcgggcgcgcttccgggtggtctctcgtgggcgagcaaggccctgagctggtgaatttcagctcccctggcaatgtgttcacggctcgcgattcggcaggtctcacggcacttctaggcgctctgagcaatgtcagcaactcgcagagcttcgacgcaatcaatgcgtctctcgcggcatctcgcacaccgtcacggatggaactggtactcgaaaacggccagcgcctttcgggatacgtgcgcgaagttgctggaagccaactagacgaactagcgcgtgacgctcgcagggttgtccgcgcacgataaggagctatcttggctatcacttggggcgcatctaagactggcggttctaacggtattcggctgggctacgagtttactcaaagcccggccaccgttggaaccggcacatcttcggttacggtcacactgaagctgtatgtgtggactatgggtcctatctcggattcgactaactcgctcacggtaagcggcgatttctcattctccggtagcgtctcagtttccacgtcgtcgggttcacagtggtctacgtctaatcagcagctcatcaagacgatcaaccgtactttctcgccactgtatggcggcgcggttacgtctagcttctccggctcactgagtggcattgaggctgtcggcgggtccgtcacggctacggcttcaggttctacgacgacagccaagcggccaccctacgcaccggatgcgccaaccgctgtaactgtagctcgcacggattcgacgcggcacacggtctcgtggacgcgcacgaatgccacggatccaacgaagatctatgacacgcaaacgatccagcgcgcagacgttctaggctccggctcatacgtcacgatctccacgctcgcgggttcatcgtcgtcattcgtggacacttctacggtctcgaataagaaataccgttaccgtgtccgcgccaacaatgacagcggttcttcggcgtgggcttactcgcccaccttttacaccgcgccaatctcgccaaccgatgtcaaggccgcgaagtctggcggcgatattgccgtttcgtggactcgacgcgcacatgtcgaagcgcgctacgaggtcgaggactgggcgaacggtgttgcgacaacgccaacgattctcacggcggcaaacgcggcatctactgtcgcaacggctcccgatccagctaagacgcacgcttaccaggtgcgcgctttcgttgacgatgcaacctttgggcgactctattccgtctattcggtgcaatcggccacggtgcaacttatggcaccgccgaacgcgccaacgaatctcgcaccaagtggcaacgctgcggatggcgcaaaggcgatcacgctctcatggcgtcacaatcccgtggacaccaccgcgcaaacgtactactcgctacgtcaccgcgccgtgggtgcttcgacgtggactacggtcgccaagacggcaagccctacacagtcccgcgcgctcgcggctggaacctacgcgaacggcactagctttgagtggcaggttcaaacgtggggcgatcatgctaccggctccgagtggagcgcggttgctgttgtgccactgtccgcaactcctatcgcgacgatccttagccctgaaacggttctaggatccaagctgaccgctcaatgggcttatgcggatccagagtcaacgaatcagtcagcttatcgcgtcacgctcattcagtctaggcagactctcgaaacatataccggatcaggttcggcatcatcgcgagttcttgcaacgcgactcgataacggtggaacttatacgctcaaagtcgccgttcgcgacggggcgggattgtggtccgcagatacttcgcaggtgttcacggtctcctatgcgccgccaccatctgccacggctacggctatctatgacacttccacaggcgcggcggttatcgaggtcaccattcccggccccgggtctggcgaagtggacgcggttacatggcacctagagcggcacactggcgcgggtgattgggttgcggtcactaactcaatctcggttactccaggtctttccgagtctgttgttgaccagctcccggccgtgaatgctctcaatcggtaccgcgtgatcacgacctcagagcttccatccacggccacatcggcagaagttatcctcgacacgtccaagcatcggggtttcgtctacgtcaacgccggccccggattctcgcaagtgatcaagtttgcagatttcgccacggcttcggtcaacgcgacacgcgagcgggtattcaacaactttgcagggcgctcgtatccagtagctactaccggcgagacgcgtgacaagacagttagcgtttcagggcgactaggggataactcttctacgccgtccgaggttgaagcgcttatggatctcgcgggaaccttctgtgtgcgcgctccttacatgaagcaaggcgcgggcgggaatgttcgcgagtttgtgcagcccaactctgggactgcactggaatttgagcgcatcaagggcactgtctcactgagcttccgaaaggtggatttcattgagtagcgtcgtattttcggatcttattgaccgtcggacttatgacgcgcttactgaccgccacgaagaattctggacgtatcagcgactcgatcgaaacctaaacctcatcgaggaagtggatggggttgacgcgtgttcggtcgatctgaacttcaattcggatgtgcgcggctccggctcattctcctaccttggctcaattgactggcgtaagggcaacttgattcgcccggtatacacagtcaaggctggggattctgtcgcgtcatggccgctgggtgtctacgtcccaatgtcgccgcaacgcaagcatggcgctacgggttcgccgtgggaatttcagatgtacgaccgcatgatgctgttgcgggacatcaagatgagtaacacctatacggcggcaaagggcatcaacgccattggtcgagtgaagtacctgctcacattctggggcttaccccaatacgtgattgacgactccgatgaagttttgcgcacggcgattacatgggaaccaggaacaacggttctgcgtatcgtgaatgatctgctcgctgccgtgaattacttttcgatctacgcggacggcaacggctattttcgatcacagccatatcagcggccacaggatcgagcggttgagttcgggttcattgacgacgaaaagggtatctacgcgccagagttcaccgaagactatgacgattacgcagtgcctaaccgcgttgtggtcgtctcggagggcgacagtgacgctccggccattcgcggattcgcgcaagacaatgaccctaactcgccgttctccacggtgacaacggggcgcattctcacggcggaggtcgagagcgtagagctgacatctgagactgtcgcaatggcctacgcgaaacggcgacttggtgagctgcaacagatcacttccggcttcgatattgagcacgcgccgatcccactagttggcggcgatgtggtcacgttcgccaactcgactagtgatatttcaattcgcgccgtggtgcaaaaggtgtcctactcttcggagcttggcgcactgtgcagcacgactcttcgggaggttgtcggtgcgtaatccactagctgacattatgcccgcaacgtcgagcgcttcggattcatggattgaagcaaccatcacgcaggtgtcgccgctcaaggtgcatctcattacggacgacgatccatcggacgcggaacctatcgcactcaatgacacgccactcgcggcaggtgatcgggtgtgggtgcagatgcgcaaccgccgcttgttcattgtcggcctcattacgccgcgtgagacctccggaactattgcggggccagcgctcacatgggcgtctacctactcaccggcgtacgtggcaacggcgaacgtctcgacgccctacgcgccaccagagggttacggcttccaggtttacacgatccaaacatctggatgggtgtgggtttcggttgcctcgcaaacagagtcaaccgtcacgcttcgagtctttacctacgacacagcaacgccgccaagtgaccttattgtcacgctcggctggcgattagtacgaatctaaataaggggagttgtggcatataaccattacgcagaactagtggtggcagactccactaccgggcggccactcgcgaatcaggttgtgaaactgcttgacttcgagactggcgcagaagttgacgcatatcgcgacgaggtggcaacactccttgtttctggcgcaaacggtctagtgaccccatttcagacattagataccactcgccgcgtgaagatgatcgtcggtggcgtggagtactcgcgctggtgtgacgagatgatcctccaagtcggcagcgcggtggatgagctcgaacggctgacggtcacaaatctcgccattgatacagacggcaccccttatatcagcattgggtcaactggcgctcgcatcctcgttgacacagacgggacgccctactttgaacaggtttagcgcaatggaacacaaaaactttatcagccttttcgagctaggagcctagtatgcagacaccagatgtacgactggtcacggaagagaagctgactgaggcactagttggcgtcaccggcgcaggcatccccatcttcgaaacccttgctgaggctgacgcttacgaggcggcgaacccggggaagattgcgctgacgcttgagccttcgacgccggatacgacggcccctgttgcgggtaccttgtcggggacggtgacgcataattcggcggcgttgtctgtcgctggtgcgtctgatgatcgtgtggtggcggggtatgcgttcaaggtgaattcgggtgcttggtctgcgtggcagtctggcagttcatattctgcgacggggcttacggcgtctacgtcgtatacgttccagcataaggtcaaggacggtgctggcaatgagacggtgggtacgtcgattgctaagactacggacgccatgccagttacggttcctgtgggtgattacgacaacgctgttctcgcggatagtccgttgcattacttgccgctggatgatgctgtggggtcctccactgcccggaatcttggttctgcgggcggcacagttgcggtgactggattcacgtttggtgctacgggtattggtgacgcggcgacgtgtgcgactttgacgcagacgtctgtgacggccagtatcgcgcataatccttcgtctactggtgcgacgtgggagtggattatgaagccgactgggtatccgactggcggcatgaagatactggaatacggcgctgacgcttttgtgatcatgtatccagagaatgacggcgttcaccccgcaggtcagatcgcgtcgtacttcaagaacatcatctcaactggtgccacgacgctcgaccagcgcaagcatgtggcggttacgtggactagcgcgggcgtttcgaagttgtatatcaatggcacgctggttaatacggcgaccgcggcggtgcccaccatgacgtcgttcgtgttcggcaagatcgttgggcaggttgcagggtttgcagtaacgaattctccgctttccgatgctcggattcttgctcacgctcaagcggcgggggttgcgtaatggcgaatatttacagcactcaggggaatctggtgactgtgtaccggacgagcggcgctttggtgtttggtgattccgagccgcccgttgagccggaaccgtggacgcctcccgtgtatgtgcagacggttcggcaggcgatgaaccgtactcgccccatgaataaccgatatgggggtgccggggctgattccacgacctctcttacgtcgcgacgtaagcacgtggtgtatggcacagggcaagggttccgtctcgtcttcaataatcttggcgggctcagtgtggggccgagcccctacacggtcaaggtgacctttgagacgctcgctggcgcgctgattccgtttacctttggcggcgccagttcggctgtcgtggagccgggtgcgctagtcctgaccgatccgattgacattactcccggagagtactgggtgcgaacgtttgcatctgtggcagaggggaaccgagttccttgtacggtcatcgacgacgcgcaccggactggtgaggctgtgtctatgaatgtagacctgaccggagtgacagggccgattacaaagaatatcgcgcagggtcctgcaccttccgccgcgatagagactggcaccggaattgcggttggcgtggttggcgactcggtatctgcgggagcatacgacatcatcacagagcatggtgcgttcgcccgaggtcttaccgcagccggagtgccacacgtcctctggggagttggtggatctaatgccagccagaacacgacggcctactttgactctgtggcgctaccagaccccggtgttacccatgtcatcgtcgagcacgggctaaacgcgtcgtcgttcggggtcaacacctctaagacatatgaagtcgatttgtggttcaggcttcaagcgcggttccccgtcggtgtgaagctctaccagaccacgatcaatccatacactacgtcaactgactcatgggctaccgtggaaggacaaacggagctacatcctggcgtgcagggagcgtataactcgtggatccgcgacgggtgcccgatcaaggacgggttgcacgccgcggttggcgacagcaccgcaatcagggctggcgaggaaggccacccactggcagggtggatcgagttcgcgggaccggtcgagtcctcgcttggatcgaaccgttgggcagcaccgggcggcactcaactaactaacgacgggcttcacccgaacggcgaagggttcgctctaatggccggagcagtacaagcgtgggctgaagggcttagcgcctagtaggcaatatccatctggtagtccatagcgcatttgccggagcagaagtcagagccgggagccttcgaaagttcgcggcactggaagcacatgtcacgaggcacttccagcttccatagcatcacggcccgacgcaagagagtcatcatgtgactgatgctactcgccgcagcacaaattacccagaggagtccatcatgtggcgtgccacaatcccacataggaaaaagctatgatccgcacctatcatccgatctatacgccgccgaggtggtgggagcgtatcctcgtccatccaatggagaacgccctcgcagtcctcgcaatcgtattcggcgtcgtcatgtcagcaagtatcccgatcgaccatttccagccgtccccagcaatggcggatatgccgtggccgctcgtggcaatctgcgcggggttcattggccttggtggagtgacgagcgtgatcggcttgcactggcatgactcgcaagctatcaacagggcgtgggggattgagcgaaccggatggatactctcagcaggcggcttcttcgtctacgcaatcgccgtcgccattagctacccaaactccgtgttctcatggctcgtacctgctggactgggcatcgcctcatccctacgcgcaatctcgctactcgtcatatggctggtggcacgcagaaagctgggggtgaaatgagtgagacgctaatcatctccattgtcgccggcatccttacgatctttggtggcgcggggttttggagctaccgggcatcacgagccgaaacgccactcaaacaaggcgcgcacgatcttgcgctggcggcgggtgcgaaccagattctcctaacctcactcaagagtgttgaggatcggctcgaaaagcaagacaagcgcatcgacatcctcgaagctgagctagaggaagagcgcaccgagcgcaagaacttcgctgaccggctcgaacgctgggcgatctggtatcagcagctcgcggctggctgggaagtccaccgccagaagccaaacgcgccaccatcaccggacacactacgcacctgagagggtgctttttattggagtgagacatgccatatttcacaggactagcgagggtagcgcgtacaactggctaccccgtgatcgaggtggacggctgggagaagcgcggacacgggccaatgctgggcgcgaaaaccatcaaatgccaccacacagcgggtggcgcaaacgggaacttcccatcaatgggcaccgtgctcaacggacgcacggggctatcaggtccactgagtcactacggactggggcgcgacggaaccatctacgttatcgccgctgggcttacctaccacgctggcgcatcacgcacagttgaagagggcaactcctactcaatcggcatcgaggcagagaacacgggcgatggaaccgagccgtggggagctaagcagctcgactcctacgtgaagctctgccgagcacttattgacgaattcgggctggatgtctccaaggtgcaaggacacaaagagaccgccatcccccttggccgcaaacctgaccctcgcggcattgacatggacgacttccgcgcatgggtcaagcgcggctactacatcaaagcaaccgttacaccaacttccaccaccgcaaaggacgaaatcgacgtggcaaccgtagacgacattttcaagaagctcgctgagttgaagacggctattgacgcgaaggcgtctaaggctgacttgagcgacattcgcgccgacgcagctaaggcggcaacggctaaccaggtgaactctgtttacgttcgccagcgtgagtatcaggccgcaaccgatgaacagctacgacagctcgccaaggcaagcaacgtagtattcgacgccgccaaggtgcaggaagccgcaaagatcggcgcaaagctcggcactgaggaagctattgcaagcggcttcacagtatcgggcacgacgaccgttgaagtaaaggcggctgagtgatgatcttcactaaggcattctggatgggagcggcggaacgtgcgatcaagaccttcttccaaactttcgtcgccgtggtcactgccgcattcggtgtaaacgctatcggcgttagtgccgcactcggtgacgtgtcatggctgaacgcgctgtcaatcgccggactcgctaccgtgctatcgctcgccacctccatcggcaacgctgaattcacggctggcacgagctacgacggcaagcacgtggacattagcgagtagactgtaatcactatgactcgtagggccacatggcacaccgcgagtcctcacaaagacccccgctctccacttacggagggtgggggctattcgtgtttttgtgctaaaccaaaggcagccccggagagtgcacgaacactcgacccggggcctgatcactaacactggaatggttctgtagtcatgcgcctaaaagtgacctataagcatccttatacgcacttccgtgtaaaataggggcatggaaacagaccttgtcgagcagttcatccactgggccgagcgagaccgcaaccgctcgcctcacaccatcgcccgataccgagccaccctgaaacaactagcagacccaggagccgcgacacgcgaggaggtcgaggcgtggtgggcgagccgatacgacgccgcaccggccacccgagagaatgaactagcatgcctgcgatccttctaccgctgggccatgcgattcgaccaccgagacgacgaccctacccgccggctcgacgcgccgaccgtccccaataagatcccgcgcccaatcgccaaatctgacctagaacggatcatcggcccgctcacggtagaccacctggaaatacggcgggcagtagcgctcggcgcatatgggggactccgagttgcagaggtcgccgctctcgactggtccaatgtggacatcgaatcccggcgcatctacatcagaggcaagggggccaaggagcgcgtcaatggcctgtctgcggtcctccaggacattatcgcgccgaataccggcgggaacgtcgttacggccgggggcgggcaatacagcgccgccgtgctgcaacgcaaggtgaaccgatttatggagcgcaccggcatcaaccagaccttccacgacctgcggaagcgaggggcaacccaggcaatggccaaggtccgcaacccgcaggctgtagcgcaggcgttcggctggtcatccttgcagaccgtgactcactatgccgtcgtaggagacgagacgctggatgaaatcgccaacgccatgatctagccgttgtaggtttcctacagacttcgaccggcacccgtatttcagttgacaggtttgattaggtttggataggttctagtcatgaacgaaacaccagaacaactaacgatcggggaggtcgcccgagtgctcggcgtcacagttggaacgatccgacgctgggaagcggagggtaagatcgccgcaacccggacccctggcaaccagcgtcgatttgaccgaaccgaagttgaccacctccgcgacgccgcctaactccggcaaacacccccaagcagtattccgactgcgacccacgggtccagcgcagataaggagtctaattgccatgcccgaaaacgaattgtccacagtaactggcttcaagaatcgcatcatcgaggcaagccctggaatcaacgaggaatacgccaagcgcgttgcgactcgcctaaagaaacgcatggaccgcatgaccgaagagttcgacttcttcgccgagctgcggatccttggaatcatcagtgacccaacggcgctaacggctgtgaagaatttggaggccgccgcatgacccccaccgactacccacccctaacccacgtcctcgctggcgtgggtttcgtttttaccgtcattctcgcgccgtgcatcgcggcgtgggcactctgaaagggagagttatggaaaaggaaattaggccagaggacatccgcgtcggtgacacgatccggcgcgaatgggtgtatctcgacacgaggtacacatccgagggcaaggttaccgcaatcgacgctgacggactctacctagaggttggcagtgggacagtatggacgttccatttaaataggtacacatgtttcctcgtgcaccgtccaacgcctaccctgccaaccgagcccggctcagtgatcatcgcaacgaaggtgcgcggcaaagagggcaagtggcgattgatgcgcgacgtggatagtgattggatttcgcccgagcgcatcctcggcgctcaatttcaccgcgacaatgacatccaagaatggctaccaaccgaaatcttcgaggtgaccccgtgagcgacaacctcaccgtctaccgcgagctagagcagaacacgccagaatggcttcaagcgcgtgccggtatcgtcaccgcgtccgtcgtagggcaactcatttcacgcgagtcagtccccgctatcaactacgactgcccggagtgtggagcgctcgcattctcgccatgcctaagcaaagtaacgaaggctggtgctgatgccaaggaaatcaagacgctccacagctcgcgcagctctaaggcacgagagctaaacgaaagcgtcctcacgttctcccacggtgatacggcaatgtcactcatcgccacaatcgctgccgaacgaatcacgaagcgcgtcgtccagatcatccctagccgcgcaatgatacgcggaacacttgatgaaccattcgcaagagaggtctacgcgcaaacattcgcgcctgtcgaagaggttggcttcatggtgcgcgacttcggaaacttcaagcttggatactcgccagacggactagttggcgatgatggcctgattgaaatcaagtcacgcgagccgaagattcaactacaaaccgtcattcgcgacgaggtgcccgctgagaacatggcgcaacttatgaccggcctactcgtgactggccgcaagtggattgactacaccagctactgcggtggaatgccgctgtacgtgaagcgcgtctacccggatccagcttggttcgaggcaatcactgacgcggtagatgacgctgagggtcacatcctcgcgtgcattcacgagttccaggatgcgaccaagggcgcaccgcctaccgaatacatagaccattgggcagaaatggagattgagttctaatggatatttcgagcagcatcatcccgaaaagcgaccaaattaatgccgatgacctggttgcaggtccgcgcactgtgaccgtagcaaaggtgagccaaggttcaccagagcagccggtcaacgtgcatatcatcgaggatccaaagcgcgcataccgacctagcaagtcaatgcgccgcgtgctcgctgaaatctggggcacgcaatcagataactgggtgggcaagtctctcacactgtttcgcaacccaaacatcaagttcggcggcgagacggtgggcggcatcgagattagtcacatgtcgcacattgataagcctgtgactgtttcactcacggcaactcgtggcaagcgtaaaccgttcaccgtgaagccgctcctggttgcgcagacgattgattgggcggcagtgattccaacgaagaacgccgaagagctccgcaacatctggcagaccaaccccgaagctcgcgagcttatcgaggccgaggttgcgcggcgcaaggaggaagagtgaacttcccaaacctcgcacgacttgaaaagtatcacctagaagatacaagtgcagacgaaatccgagaaacggacatctgggacctagcagatgccgcatacgacgcaatgaaagaggagcagtaaatggcgaacgaaaccatcattaccattatcggaaatctaacctccgatcccgaactacgattcaccccgtccggtgccgccgtcgcgaactttacgatcgcatcgacgccacggacgtttgatcgccagtccaacgaatggaaggacggcgaagcgctattcctccgcgcttcagtgtggcgcgaatctgcggagaacgttgccgaaaccctcaccaagggtatgcgcgtgatcgctcaaggccgcttgaagtcccgcacatacgagaccaaggagggcgaacgccgcaccgtcatggagctggaggtcgaagagattggcccatcgcttcgtttcgcttcggcgaaggtgactcgcgctcagcaaggcggtggtcaacgctcgcagcaacagcccgcgaatgacgcgtggacgaatcaatcccacgccgaatcaaccggctgggaagttgttggcgccggcatgcatggatccgatgggccgccgttctaaacctgtacataaacacgtacagagccttgtatcccgcaaaacaacccccgcgccttgtggcgctttttttatgccgtggcgcgctcatgacgggcgcgccattggcgtacctgagaggacatgctttgaatgagattgacgaagatgcacacctcgcactgtgggtcgatgaagtgacgtgcgaagaactgaattacatgtacgcacgcggtgggatcgcttatcccgtgagcggcgacttcatcacgacgggccgcatcgagaagcgctggagctttaccggtgacgactaaaggccatgtgccagacgcgaatctggacgtataccgagcgctcagggatgcacgtgatgccatcgagcggtactggcgcatacagcgcgtctcgcacgcgacggactcatatgggttgcggcaacttagcgaatccatcacgggcaccatgaggaccctacgcgttgacgtcgaggatccagagtgacttgcgacggcgagtgctgtcgtaacggtctcggcgtctgctaccacgggcgacgatgcgaacaccacaccagcgaagaaaacgaccataaagcgcgacggacgcaccctgatcctacgggggataaagcatccgcacgcgctgatcgggatatggaaaggaagaggaaacgtgagcaaatatcgcaccgaatttatggatgaagtggcgcggatcgtcgaagaggtaaatgcggaaaagccgctcgatcatagcgacttccaacttggcgtaaccgagggtaagcagcgaatgtcacaagctatcggaatgctactcgctggcactgacacggacccgcaaaccaatgaccaatgggaggctgaagttgacgacctgaccgcgaaactcaagaaggccaaggagtacattctgctcctacaggtattgcgcgcacggtacgccacggagaaccggaagctgcgcgatcaaatcaaccactgacccgcacagggtctttttttatgcctgaaaggaagtcatgagcaacaaagttgaggccacataccacagcccattcctatgcgatcactactgctgcgagggtgcgcacggatgctacaaggattacaaatgcgcgtgccatcgtccaccggtagacgcgatgcccgtatttattgagccgccaagtttcgagtgggcagatgacggccatgactgcgactgagtggacgaaaaccagcgccgtcgaggattggcgagcgcgcaagcaacgtgaccgtctctactacgcagatgctgaagtagcccgctgcggaacgtgcggcgagtggatgtggcggcgcaaatgcaaagtgccacacgacaacattttgaattttcgagaggaagaaaagtaatgcctaagccaagaacaacaccgagtcactgcaaggtctgcgaacgtcccatgcgtcgcactggagtatcagccaaggaagcgccggacactgtcgtttaccacgggatcacgccggacgggcgagcatcttgcgcaacctgctttcggcgcgtcatgacaggccgcgaaaaggtgttcttgaagccgctcgaagcatccaatgtcaagatccccgcgaagttgcctgatgacgttctaaggcgcaacgagggactaagggcatatgtcttggatcgtcgccgccgtgggattcctagcgttgtggggtgggcggcgtgatcaccatatgcccgtattgcaataagccgcacccaacgaccacgagcgcacgagttgccggatcctactttgtgaagccgtacaagttcgccgcgaaatacgacggcgcaccacttcgaggcacgcgccaagaggccgaactcgactactgcaaatggaggaatcgtgactcgaagtagagcatcagcaagagccgctggaacgagctttgaaacgctcattgtgaagcatctcgcggcagtcatagacgaccggatcgaacggcgcgcaaagagtggcgctaacgatcgtggtgatatttcaggctggcgatatgcgggtaagcgcatcgtcgtcgagtgcaaaaacacaaaccgcttggagcttggaatctgggtctctgaggccgaggtagagcgcctaaacgacgacgctcaagtgggcatggtgatccacaagcggcgcggaaaaggtgccgccgaagatcagtacgtgaccatgacgctgggtgatctagtgaggctgctgacgtgacccaaagaatgaaaaacgaaattctaatgaacaatcacccacagcgcaacaaaatcgcacataggttcgatatactagtagtggtaaataaaacggccccggcagtgctaccaacactgaaacccggggcctaccactgacaaggagtggcactaatgagtgtacccacagacggcttggaaggccgcaaagaaatcgcgaggacgtttctcgcgctcgccaatgacgagtatcagaagcacaacatccaccgtggatactatgcacggatcgccaaggaacacggcctaacaaatcaagaaatcgcggaggcttacgggataaccgaagctgccgtgcgtggcttgattcgccgggcggtgaagtagtgcctcgcatccgcaccatcaaacctgagttttggtcagacggaaacatcgtcagactgtcgcgagatgcccggctgctctatatcggaatgtggaacttcacgctctgcgatgccggtcatgtggacgatgacatcgtgagattgaagatcaacatcttcccgatggacaacattgacgtcggcgtaccactccaggaacttattgaactggatcgaatatcgcgcattgacattggcgatgggaagaaatacctccacgtcaaacggttgggcgaccatcaaaaaacagacaagcggtggactccacgctgccctgtttgcgctcaccaaaactccccgaaactccccgaaactcccgcgagttcaggcgagactcaacgagtctccccgaaactccccgaaactcaccacttttttttttttcaagcagaagacggcatacgagatcttgcgaagtctcgtgggctcggagatgtgtataagagacag

SEQ ID NO: 2 - DNA, 28132 bp, Zea mays
actgtggtgagtttcggggagtttcggggagactcgttgagtctcgcctgaactcgcgggagtttcggggagtttcggggagttttggtgagcgcaaacagggcagcgtggagtccaccgcttgtctgttttttgatggtcgcccaaccgtttgacgtggaggtatttcttcccatcgccaatgtcaatgcgcgatattcgatccagttcaataagttcctggagtggtacgccgacgtcaatgttgtccatcgggaagatgttgatcttcaatctcacgatgtcatcgtccacatgaccggcatcgcagagcgtgaagttccacattccgatatagagcagccgggcatctcgcgacagtctgacgatgtttccgtctgaccaaaactcaggtttgatggtgcggatgcgaggcactacttcaccgcccggcgaatcaagccacgcacggcagcttcggttatcccgtaagcctccgcgatttcttgatttgttaggccgtgttccttggcgatccgtgcatagtatccacggtggatgttgtgcttctgatactcgtcattggcgagcgcgagaaacgtcctcgcgatttctttgcggccttccaagccgtctgtgggtacactcattagtgccactccttgtcagtggtaggccccgggtttcagtgttggtagcactgccggggccgttttatttaccactactagtatatcgaacctatgtgcgattttgttgcgctgtgggtgattgttcattagaatttcgtttttcattctttgggtcacgtcagcagcctcactagatcacccagcgtcatggtcacgtactgatcttcggcggcaccttttccgcgccgcttgtggatcaccatgcccacttgagcgtcgtcgtttaggcgctctacctcggcctcagagacccagattccaagctccaagcggtttgtgtttttgcactcgacgacgatgcgcttacccgcatatcgccagcctgaaatatcaccacgatcgttagcgccactctttgcgcgccgttcgatccggtcgtctatgactgccgcgagatgcttcacaatgagcgtttcaaagctcgttccagcggctcttgctgatgctctacttcgagtcacgattcctccatttgcagtagtcgagttcggcctcttggcgcgtgcctcgaagtggtgcgccgtcgtatttcgcggcgaacttgtacggcttcacaaagtaggatccggcaactcgtgcgctcgtggtcgttgggtgcggcttattgcaatacgggcatatggtgatcacgccgcccaccccacaacgctaggaatcccacggcggcgacgatccaagacatatgcccttagtccctcgttgcgccttagaacgtcatcaggcaacttcgcggggatcttgacattggatgcttcgagcggcttcaagaacaccttttcgcggcctgtcatgacgcgccgaaagcaggttgcgcaagatgctcgcccgtccggcgtgatcccgtggtaaacgacagtgtccggcgcttccttggctgatactccagtgcgacgcatgggacgttcgcagaccttgcagtgactcggtgttgttcttggcttaggcattacttttcttcctctcgaaaattcaaaatgttgtcgtgtggcactttgcatttgcgccgccacatccactcgccgcacgttccgcagcgggctacttcagcatctgcgtagtagagacggtcacgttgcttgcgcgctcgccaatcctcgacggcgctggttttcgtccactcagtcgcagtcatggccgtcatctgcccactcgaaacttggcggctcaataaatacgggcatcgcgtctaccggtggacgatggcacgcgcatttgtaatccttgtagcatccgtgcgcaccctcgcagcagtagtgatcgcataggaatgggctgtggtatgtggcctcaactttgttgctcatgacttcctttcaggcataaaaaaagaccctgtgcgggtcagtggttgatttgatcgcgcagcttccggttctccgtggcgtaccgtgcgcgcaatacctgtaggagcagaatgtactccttggccttcttgagtttcgcggtcaggtcgtcaacttcagcctcccattggtcattggtttgcgggtccgtgtcagtgccagcgagtagcattccgatagcttgtgacattcgctgcttaccctcggttacgccaagttggaagtcgctatgatcgagcggcttttccgcatttacctcttcgacgatccgcgccacttcatccataaattcggtgcgatatttgctcacgtttcctcttcctttccatatcccgatcagcgcgtgcggatgctttatcccccgtaggatcagggtgcgtccgtcgcgctttatggtcgttttcttcgctggtgtggtgttcgcatcgtcgcccgtggtagcagacgccgagaccgttacgacagcactcgccgtcgcaagtcactctggatcctcgacgtcaacgcgtagggtcctcatggtgcccgtgatggattcgctaagttgccgcaacccatatgagtccgtcgcgtgcgagacgcgctgtatgcgccagtaccgctcgatggcatcacgtgcatccctgagcgctcggtatacgtccagattcgcgtctggcacatggcctttagtcgtcaccggtaaagctccagcgcttctcgatgcggcccgtcgtgatgaagtcgccgctcacgggataagcgatcccaccgcgtgcgtacatgtaattcagttcttcgcacgtcacttcatcgacccacagtgcgaggtgtgcatcttcgtcaatctcattcaaagcatgtcctctcaggtacgccaatggcgcgcccgtcatgagcgcgccacggcataaaaaaagcgccacaaggcgcgggggttgttttgcgggatacaaggctctgtacgtgtttatgtacaggtttagaacggcggcccatcggatccatgcatgccggcgccaacaacttcccagccggttgattcggcgtgggattgattcgtccacgcgtcattcgcgggctgttgctgcgagcgttgaccaccgccttgctgagcgcgagtcaccttcgccgaagcgaaacgaagcgatgggccaatctcttcgacctccagctccatgacggtgcggcgttcgccctccttggtctcgtatgtgcgggacttcaagcggccttgagcgatcacgcgcatacccttggtgagggtttcggcaacgttctccgcagattcgcgccacactgaagcgcggaggaatagcgcttcgccgtccttccattcgttggactggcgatcaaacgtccgtggcgtcgatgcgatcgtaaagttcgcgacggcggcaccggacggggtgaatcgtagttcgggatcggaggttagatttccgataatggtaatgatggtttcgttcgccatttactgctcctctttcattgcgtcgtatgcggcatctgctaggtcccagatgtccgtttctcggatttcgtctgcacttgtatcttctaggtgatacttttcaagtcgtgcgaggtttgggaagttcactcttcctccttgcgccgcgcaacctcggcctcgataagctcgcgagcttcggggttggtctgccagatgttgcggagctcttcggcgttcttcgttggaatcactgccgcccaatcaatcgtctgcgcaaccaggagcggcttcacggtgaacggtttacgcttgccacgagttgccgtgagtgaaacagtcacaggcttatcaatgtgcgacatgtgactaatctcgatgccgcccaccgtctcgccgccgaacttgatgtttgggttgcgaaacagtgtgagagacttgcccacccagttatctgattgcgtgccccagatttcagcgagcacgcggcgcattgacttgctaggtcggtatgcgcgctttggatcctcgatgatatgcacgttgaccggctgctctggtgaaccttggctcacctttgctacggtcacagtgcgcggacctgcaaccaggtcatcggcattaatttggtcgcttttcgggatgatgctgctcgaaatatccattagaactcaatctccatttctgcccaatggtctatgtattcggtaggcggtgcgcccttggtcgcatcctggaactcgtgaatgcacgcgaggatgtgaccctcagcgtcatctaccgcgtcagtgattgcctcgaaccaagctggatccgggtagacgcgcttcacgtacagcggcattccaccgcagtagctggtgtagtcaatccacttgcggccagtcacgagtaggccggtcataagttgcgccatgttctcagcgggcacctcgtcgcgaatgacggtttgtagttgaatcttcggctcgcgtgacttgatttcaatcaggccatcatcgccaactagtccgtctggcgagtatccaagcttgaagtttccgaagtcgcgcaccatgaagccaacctcttcgacaggcgcgaatgtttgcgcgtagacctctcttgcgaatggttcatcaagtgttccgcgtatcattgcgcggctagggatgatctggacgacgcgcttcgtgattcgttcggcagcgattgtggcgatgagtgacattgccgtatcaccgtgggagaacgtgaggacgctttcgtttagctctcgtgccttagagctgcgcgagctgtggagcgtcttgatttccttggcatcagcaccagccttcgttactttgcttaggcatggcgagaatgcgagcgctccacactccgggcagtcgtagttgatagcggggactgactcgcgtgaaatgagttgccctacgacggacgcggtgacgataccggcacgcgcttgaagccattctggcgtgttctgctctagctcgcggtagacggtgaggttgtcgctcacggggtcacctcgaagatttcggttggtagccattcttggatgtcattgtcgcggtgaaattgagcgccgaggatgcgctcgggcgaaatccaatcactatccacgtcgcgcatcaatcgccacttgccctctttgccgcgcaccttcgttgcgatgatcactgagccgggctcggttggcagggtaggcgttggacggtgcacgaggaaacatgtgtacctatttaaatggaacgtccatactgtcccactgccaacctctaggtagagtccgtcagcgtcgattgcggtaaccttgccctcggatgtgtacctcgtgtcgagatacacccattcgcgccggatcgtgtcaccgacgcggatgtcctctggcctaatttccttttccataactctccctttcagagtgcccacgccgcgatgcacggcgcgagaatgacggtaaaaacgaaacccacgccagcgaggacgtgggttaggggtgggtagtcggtgggggtcatgcggcggcctccaaattcttcacagccgttagcgccgttgggtcactgatgattccaaggatccgcagctcggcgaagaagtcgaactcttcggtcatgcggtccatgcgtttctttaggcgagtcgcaacgcgcttggcgtattcctcgttgattccagggcttgcctcgatgatgcgattcttgaagccagttactgtggacaattcgttttcgggcatggcaattagactccttatctgcgctggacccgtgggtcgcagtcggaatactgcttgggggtgtttgccggagttaggcggcgtcgcggaggtggtcaacttcggttcggtcaaatcgacgctggttgccaggggtccgggttgcggcgatcttaccctccgcttcccagcgtcggatcgttccaactgtgacgccgagcactcgggcgacctccccgatcgttagttgttctggtgtttcgttcatgactagaacctatccaaacctaatcaaacctgtcaactgaaatacgggtgccggtcgaagtctgtaggaaacctacaacggctagatcatggcgttggcgatttcatccagcgtctcgtctcctacgacggcatagtgagtcacggtctgcaaggatgaccagccgaacgcctgcgctacagcctgcgggttgcggaccttggccattgcctgggttgcccctcgcttccgcaggtcgtggaaggtctggttgatgccggtgcgctccataaatcggttcaccttgcgttgcagcacggcggcgctgtattgcccgcccccggccgtaacgacgttcccgccggtattcggcgcgataatgtcctggaggaccgcagacaggccattgacgcgctccttggcccccttgcctctgatgtagatgcgccgggattcgatgtccacattggaccagtcgagagcggcgacctctgcaactcggagtcccccatatgcgccgagcgctactgcccgccgtatttccaggtggtctaccgtgagcgggccgatgatccgttctaggtcagatttggcgattgggcgcgggatcttattggggacggtcggcgcgtcgagccggcgggtagggtcgtcgtctcggtggtcgaatcgcatggcccagcggtagaaggatcgcaggcatgctagttcattctctcgggtggccggtgcggcgtcgtatcggctcgcccaccacgcctcgacctcctcgcgtgtcgcggctcctgggtctgctagttgtttcagggtggctcggtatcgggcgatggtgtgaggcgagcggttgcggtctcgctcggcccagtggatgaactgctcgacaaggtctgtttccatgcccctattttacacggaagtgcgtataaggatgcttataggtcacttttaggcgcatgactacagaaccattccagtgttagtgatcaggccccgggtcgagtgttcgtgcactctccggggctgcctttggtttagcacaaaaacacgaatagcccccaccctccgtaagtggagagcgggggtctttgtgaggactcgcggtgtgccatgtggccctacgagtcatagtgattacagtctactcgctaatgtccacgtgcttgccgtcgtagctcgtgccagccgtgaattcagcgttgccgatggaggtggcgagcgatagcacggtagcgagtccggcgattgacagcgcgttcagccatgacacgtcaccgagtgcggcactaacgccgatagcgtttacaccgaatgcggcagtgaccacggcgacgaaagtttggaagaaggtcttgatcgcacgttccgccgctcccatccagaatgccttagtgaagatcatcactcagccgcctttacttcaacggtcgtcgtgcccgatactgtgaagccgcttgcaatagcttcctcagtgccgagctttgcgccgatctttgcggcttcctgcaccttggcggcgtcgaatactacgttgcttgccttggcgagctgtcgtagctgttcatcggttgcggcctgatactcacgctggcgaacgtaaacagagttcacctggttagccgttgccgccttagctgcgtcggcgcgaatgtcgctcaagtcagccttagacgccttcgcgtcaatagccgtcttcaactcagcgagcttcttgaaaatgtcgtctacggttgccacgtcgatttcgtcctttgcggtggtggaagttggtgtaacggttgctttgatgtagtagccgcgcttgacccatgcgcggaagtcgtccatgtcaatgccgcgagggtcaggtttgcggccaagggggatggcggtctctttgtgtccttgcaccttggagacatccagcccgaattcgtcaataagtgctcggcagagcttcacgtaggagtcgagctgcttagctccccacggctcggttccatcgcccgtgttctctgcctcgatgccgattgagtaggagttgccctcttcaactgtgcgtgatgcgccagcgtggtaggtaagcccagcggcgataacgtagatggttccgtcgcgccccagtccgtagtgactcagtggacctgatagccccgtgcgtccgttgagcacggtgcccattgatgggaagttcccgtttgcgccacccgctgtgtggtggcatttgatggttttcgcgcccagcattggcccgtgtccgcgcttctcccagccgtccacctcgatcacggggtagccagttgtacgcgctaccctcgctagtcctgtgaaatatggcatgtctcactccaataaaaagcaccctctcaggtgcgtagtgtgtccggtgatggtggcgcgtttggcttctggcggtggacttcccagccagccgcgagctgctgataccagatcgcccagcgttcgagccggtcagcgaagttcttgcgctcggtgcgctcttcctctagctcagcttcgaggatgtcgatgcgcttgtcttgcttttcgagccgatcctcaacactcttgagtgaggttaggagaatctggttcgcacccgccgccagcgcaagatcgtgcgcgccttgtttgagtggcgtttcggctcgtgatgcccggtagctccaaaaccccgcgccaccaaagatcgtaaggatgccggcgacaatggagatgattagcgtctcactcatttcacccccagctttctgcgtgccaccagccatatgacgagtagcgagattgcgcgtagggatgaggcgatgcccagtccagcaggtacgagccatgagaacacggagtttgggtagctaatggcgacggcgattgcgtagacgaagaagccgcctgctgagagtatccatccggttcgctcaatcccccacgccctgttgatagcttgcgagtcatgccagtgcaagccgatcacgctcgtcactccaccaaggccaatgaaccccgcgcagattgccacgagcggccacggcatatccgccattgctggggacggctggaaatggtcgatcgggatacttgctgacatgacgacgccgaatacgattgcgaggactgcgagggcgttctccattggatggacgaggatacgctcccaccacctcggcggcgtatagatcggatgataggtgcggatcatagctttttcctatgtgggattgtggcacgccacatgatggactcctctgggtaatttgtgctgcggcgagtagcatcagtcacatgatgactctcttgcgtcgggccgtgatgctatggaagctggaagtgcctcgtgacatgtgcttccagtgccgcgaactttcgaaggctcccggctctgacttctgctccggcaaatgcgctatggactaccagatggatattgcctactaggcgctaagcccttcagcccacgcttgtactgctccggccattagagcgaacccttcgccgttcgggtgaagcccgtcgttagttagttgagtgccgcccggtgctgcccaacggttcgatccaagcgaggactcgaccggtcccgcgaactcgatccaccctgccagtgggtggccttcctcgccagccctgattgcggtgctgtcgccaaccgcggcgtgcaacccgtccttgatcgggcacccgtcgcggatccacgagttatacgctccctgcacgccaggatgtagctccgtttgtccttccacggtagcccatgagtcagttgacgtagtgtatggattgatcgtggtctggtagagcttcacaccgacggggaaccgcgcttgaagcctgaaccacaaatcgacttcatatgtcttagaggtgttgaccccgaacgacgacgcgtttagcccgtgctcgacgatgacatgggtaacaccggggtctggtagcgccacagagtcaaagtaggccgtcgtgttctggctggcattagatccaccaactccccagaggacgtgtggcactccggctgcggtaagacctcgggcgaacgcaccatgctctgtgatgatgtcgtatgctcccgcagataccgagtcgccaaccacgccaaccgcaattccggtgccagtctctatcgcggcggaaggtgcaggaccctgcgcgatattctttgtaatcggccctgtcactccggtcaggtctacattcatagacacagcctcaccagtccggtgcgcgtcgtcgatgaccgtacaaggaactcggttcccctctgccacagatgcaaacgttcgcacccagtactctccgggagtaatgtcaatcggatcggtcaggactagcgcacccggctccacgacagccgaactggcgccgccaaaggtaaacggaatcagcgcgccagcgagcgtctcaaaggtcaccttgaccgtgtaggggctcggccccacactgagcccgccaagattattgaagacgagacggaacccttgccctgtgccatacaccacgtgcttacgtcgcgacgtaagagaggtcgtggaatcagccccggcacccccatatcggttattcatggggcgagtacggttcatcgcctgccgaaccgtctgcacatacacgggaggcgtccacggttccggctcaacgggcggctcggaatcaccaaacaccaaagcgccgctcgtccggtacacagtcaccagattcccctgagtgctgtaaatattcgccattacgcaacccccgccgcttgagcgtgagcaagaatccgagcatcggaaagcggagaattcgttactgcaaaccctgcaacctgcccaacgatcttgccgaacacgaacgacgtcatggtgggcaccgccgcggtcgccgtattaaccagcgtgccattgatatacaacttcgaaacgcccgcgctagtccacgtaaccgccacatgcttgcgctggtcgagcgtcgtggcaccagttgagatgatgttcttgaagtacgacgcgatctgacctgcggggtgaacgccgtcattctctggatacatgatcacaaaagcgtcagcgccgtattccagtatcttcatgccgccagtcggatacccagtcggcttcataatccactcccacgtcgcaccagtagacgaaggattatgcgcgatactggccgtcacagacgtctgcgtcaaagtcgcacacgtcgccgcgtcaccaatacccgtagcaccaaacgtgaatccagtcaccgcaactgtgccgcccgcagaaccaagattccgggcagtggaggaccccacagcatcatccagcggcaagtaatgcaacggactatccgcgagaacagcgttgtcgtaatcacccacaggaaccgtaactggcatggcgtccgtagtcttagcaatcgacgtacccaccgtctcattgccagcaccgtccttgaccttatgctggaacgtatacgacgtagacgccgtaagccccgtcgcagaatatgaactgccagactgccacgcagaccaagcacccgaattcaccttgaacgcataccccgccaccacacgatcatcagacgcaccagcgacagacaacgccgccgaattatgcgtcaccgtccccgacaaggtacccgcaacaggggccgtcgtatccggcgtcgaaggctcaagcgtcagcgcaatcttccccgggttcgccgcctcgtaagcgtcagcctcagcaagggtttcgaagatggggatgcctgcgccggtgacgccaactagtgcctcagtcagcttctcttccgtgaccagtcgtacatctggtgtctgcatactaggctcctagctcgaaaaggctgataaagtttttgtgttccattgcgctaaacctgttcaaagtagggcgtcccgtctgtgtcaacgaggatgcgagcgccagttgacccaatgctgatataaggggtgccgtctgtatcaatggcgagatttgtgaccgtcagccgttcgagctcatccaccgcgctgccgacttggaggatcatctcgtcacaccagcgcgagtactccacgccaccgacgatcatcttcacgcggcgagtggtatctaatgtctgaaatggggtcactagaccgtttgcgccagaaacaaggagtgttgccacctcgtcgcgatatgcgtcaacttctgcgccagtctcgaagtcaagcagtttcacaacctgattcgcgagtggccgcccggtagtggagtctgccaccactagttctgcgtaatggttatatgccacaactccccttatttagattcgtactaatcgccagccgagcgtgacaataaggtcacttggcggcgttgctgtgtcgtaggtaaagactcgaagcgtgacggttgactctgtttgcgaggcaaccgaaacccacacccatccagatgtttggatcgtgtaaacctggaagccgtaaccctctggtggcgcgtagggcgtcgagacgttcgccgttgccacgtacgccggtgagtaggtagacgcccatgtgagcgctggccccgcaatagttccggaggtctcacgcggcgtaatgaggccgacaatgaacaagcggcggttgcgcatctgcacccacacccgatcacctgccgcgagtggcgtgtcattgagtgcgataggttccgcgtccgatggatcgtcgtccgtaatgagatgcaccttgagcggcgacacctgcgtgatggttgcttcaatccatgaatccgaagcgctcgacgttgcgggcataatgtcagctagtggattacgcaccgacaacctcccgaagagtcgtgctgcacagtgcgccaagctccgaagagtaggacaccttttgcaccacggcgcgaattgaaatatcactagtcgagttggcgaacgtgaccacatcgccgccaactagtgggatcggcgcgtgctcaatatcgaagccggaagtgatctgttgcagctcaccaagtcgccgtttcgcgtaggccattgcgacagtctcagatgtcagctctacgctctcgacctccgccgtgagaatgcgccccgttgtcaccgtggagaacggcgagttagggtcattgtcttgcgcgaatccgcgaatggccggagcgtcactgtcgccctccgagacgaccacaacgcggttaggcactgcgtaatcgtcatagtcttcggtgaactctggcgcgtagatacccttttcgtcgtcaatgaacccgaactcaaccgctcgatcctgtggccgctgatatggctgtgatcgaaaatagccgttgccgtccgcgtagatcgaaaagtaattcacggcagcgagcagatcattcacgatacgcagaaccgttgttcctggttcccatgtaatcgccgtgcgcaaaacttcatcggagtcgtcaatcacgtattggggtaagccccagaatgtgagcaggtacttcactcgaccaatggcgttgatgccctttgccgccgtataggtgttactcatcttgatgtcccgcaacagcatcatgcggtcgtacatctgaaattcccacggcgaacccgtagcgccatgcttgcgttgcggcgacattgggacgtagacacccagcggccatgacgcgacagaatccccagccttgactgtgtataccgggcgaatcaagttgcccttacgccagtcaattgagccaaggtaggagaatgagccggagccgcgcacatccgaattgaagttcagatcgaccgaacacgcgtcaaccccatccacttcctcgatgaggtttaggtttcgatcgagtcgctgatacgtccagaattcttcgtggcggtcagtaagcgcgtcataagtccgacggtcaataagatccgaaaatacgacgctactcaatgaaatccacctttcggaagctcagtgagacagtgcccttgatgcgctcaaattccagtgcagtcccagagttgggctgcacaaactcgcgaacattcccgcccgcgccttgcttcatgtaaggagcgcgcacacagaaggttcccgcgagatccataagcgcttcaacctcggacggcgtagaagagttatcccctagtcgccctgaaacgctaactgtcttgtcacgcgtctcgccggtagtagctactggatacgagcgccctgcaaagttgttgaatacccgctcgcgtgtcgcgttgaccgaagccgtggcgaaatctgcaaacttgatcacttgcgagaatccggggccggcgttgacgtagacgaaaccccgatgcttggacgtgtcgaggataacttctgccgatgtggccgtggatggaagctctgaggtcgtgatcacgcggtaccgattgagagcattcacggccgggagctggtcaacaacagactcggaaagacctggagtaaccgagattgagttagtgaccgcaacccaatcacccgcgccagtgtgccgctctaggtgccatgtaaccgcgtccacttcgccagacccggggccgggaatggtgacctcgataaccgccgcgcctgtggaagtgtcatagatagccgtagccgtggcagatggtggcggcgcataggagaccgtgaacacctgcgaagtatctgcggaccacaatcccgccccgtcgcgaacggcgactttgagcgtataagttccaccgttatcgagtcgcgttgcaagaactcgcgatgatgccgaacctgatccggtatatgtttcgagagtctgcctagactgaatgagcgtgacgcgataagctgactgattcgttgactctggatccgcataagcccattgagcggtcagcttggatcctagaaccgtttcagggctaaggatcgtcgcgataggagttgcggacagtggcacaacagcaaccgcgctccactcggagccggtagcatgatcgccccacgtttgaacctgccactcaaagctagtgccgttcgcgtaggttccagccgcgagcgcgcgggactgtgtagggcttgccgtcttggcgaccgtagtccacgtcgaagcacccacggcgcggtgacgtagcgagtagtacgtttgcgcggtggtgtccacgggattgtgacgccatgagagcgtgatcgcctttgcgccatccgcagcgttgccacttggtgcgagattcgttggcgcgttcggcggtgccataagttgcaccgtggccgattgcaccgaatagacggaatagagtcgcccaaaggttgcatcgtcaacgaaagcgcgcacctggtaagcgtgcgtcttagctggatcgggagccgttgcgacagtagatgccgcgtttgccgccgtgagaatcgttggcgttgtcgcaacaccgttcgcccagtcctcgacctcgtagcgcgcttcgacatgtgcgcgtcgagtccacgaaacggcaatatcgccgccagacttcgcggccttgacatcggttggcgagattggcgcggtgtaaaaggtgggcgagtaagcccacgccgaagaaccgctgtcattgttggcgcggacacggtaacggtatttcttattcgagaccgtagaagtgtccacgaatgacgacgatgaacccgcgagcgtggagatcgtgacgtatgagccggagcctagaacgtctgcgcgctggatcgtttgcgtgtcatagatcttcgttggatccgtggcattcgtgcgcgtccacgagaccgtgtgccgcgtcgaatccgtgcgagctacagttacagcggttggcgcatccggtgcgtagggtggccgcttggctgtcgtcgtagaacctgaagccgtagccgtgacggacccgccgacagcctcaatgccactcagtgagccggagaagctagacgtaaccgcgccgccatacagtggcgagaaagtacggttgatcgtcttgatgagctgctgattagacgtagaccactgtgaacccgacgacgtggaaactgagacgctaccggagaatgagaaatcgccgcttaccgtgagcgagttagtcgaatccgagataggacccatagtccacacatacagcttcagtgtgaccgtaaccgaagatgtgccggttccaacggtggccgggctttgagtaaactcgtagcccagccgaataccgttagaaccgccagtcttagatgcgccccaagtgatagccaagatagctccttatcgtgcgcggacaaccctgcgagcgtcacgcgctagttcgtctagttggcttccagcaacttcgcgcacgtatcccgaaaggcgctggccgttttcgagtaccagttccatccgtgacggtgtgcgagatgccgcgagagacgcattgattgcgtcgaagctctgcgagttgctgacattgctcagagcgcctagaagtgccgtgagacctgccgaatcgcgagccgtgaacacattgccaggggagctgaaattcaccagctcagggccttgctcgcccacgagagaccacccggaagcgcgcccgccattagcgaacgccttgacgggaccgccaccaccgcgctggaggtatccagcccagttgaacggctgcccgttcttccacatttcaacgtgagcgtgaggaccggtggacttacctgtattgccggtaagcgccgtaatctggccgcccttgacgcgagagcctgcacccgcgagaacctttgaaaggtggcccacgtaggtagagatgccgttcgcgtgatcaatgagctgaccaatacctgtacgccctgcaacgatgttccagcccgccttgcgaacgatgccgttgtacattgcgcggaatggcgtaccgactgggcttgcgaagtcgatgcccgcgtgcgggtaacgaccacgagacgtaccaaagccggacgtgatgacaccgcgaggacggtagaagttgccaagcggtccgtcgtagccgaagtacccaccagcgccgccgccgaaatcgccggtcatctgatccttgccgcgaatccatgaaatggccgcgtcgattgcacccgtcgaagcacggcgagcaatatccgggaaagcattctctccaggtaggagcgtcttgattgcgtccttgacgggattcagtagcattgacgccacatctgccagtccgccacgcacccagtcgagaccgttgccgatattgcgcactgtgtcgcgcccgaagtttccaagctcttccagccagccgccgattggcagtggggaattcttggagcgtccgccgttgagcgtatcgagtgcatccattggcgcttgctgttgtgatgccaacatgcgcttggtctcgttcgccgtgtagacgtagccggggcctgtgtggataagctcggggccttcttcgcccacgagcttccagccgttgcgcatttgtccaccagtggcgtatgcggggacgtcaatcaatccaagtcgtggcagtgcgtcgccgccgacgatctcgcgaaccttgttcagggcaacgcggagaccatcgttatagacggtgccgataacaaagttgattggagccgctgcgatgcgctggatgccattccagatcttcttgatcgcatcaacgccctttttgaacgctggctcaagaacgtcgcggaagaagttaccgaactcgcgcaatgctggctggatgacgtcttcccacgcatccgtgatgaccttagaaaccttgtcccaaaccggcttgatgatgttcttatagagccatgtaaaggctggtgagaggacgtttttcacaacccatacaatggttcggaagatcgtatccagaatgccccaagcgatagagacagctgcgacgatagcctgccaaactggacgaataatgttctcgtaaagccatttgaagattggcgctaggacgttgttgatgaagtcgcgaatcgccctaaacgctgggagaattacactctcccaggcccatttcacggctgccgagatgccgttccaagctgggacgatcacgttttgccagaaccagacaatggccggaatgagaacgttcatcacgaaatcgacaatggccttgaatgccggttgaatgacattctcccaagcccacttgatgaccttttgaatgccagcccacgcttcatccatgaacttccgagcgtcctcattggtctggtagagatacaccagagcgccaactaggagcgcgataagaccaatcacaatgaagatcggattcgccagcattgccgcgttgagtttcaggaatgcgacgcgagcagccgccaagaatccaataattcccgtaaccgtcttgtaaataagaagaccagtgaagaatgcagccgcagcgcccgcgatagaccacaggagcggcgtattcttaccgagccaatcccagagcgctgcaaagaatggcacgagctgttcgtcaaagaatttaccaatagcctcgccagcctttttagcccactcttctaccggctccagaagcttgagcagccccttgaagaactccgtgaacttcgggtaaaccttgctcaagaggtttgcgccaacgcggccgatagacgcgagcgtgttattgaaagcaccctgcaacgtgtcgccagacttgagagcagcgccgcccatgccctgctccatggctttttggaaatcctcgaagccgatctttccctctgatgccattttctggactgactcaggggtttcacctagggactttccaaggagctggagaatggggatgccgcgctcgccaagctgcgcgaggacttcaccctgaatcttgccggtacctgcaaccttgttgaagattgcgcccatttcattcatgggaacgccggcaatagtggaagcatcagcaacaagcttgagcgtgcgctctagatccttgccaggtttcacgccagacgccacagccgaagccgcaaccgtggccgcttcatccatgccaaacgcggtaccctttacggatttcagcgcgtcattcatgatggtctcaacggtcttcgtatcgtgaccgaggccggctagtttagcgcgtgcattctctaggctctggagtcgtccgaagcccttagtgagtgccaacgcgaaaccgccagccgcagccgcagcaccgccaagcaatgcacccttagcggcaccagaaaacccggagccgaagctcttgccagattcttgaccacccttagaggtgccgtcaacaaccttgccgacttccttttgaaagtccttgaaagacggtcgaatcagtacctcagcaacgccgatagtaggcatgcgacccccttaaaggatttagttttttggcggctttagagtgacgtcagagcgcttgaagccaaacatctcagcgagtcccgcgacgtgctcaatctcgcgatcagcgcgtgcttcggcgagtggatcgaacggcgctgggaatggcttaggtttcggaggcttgccaccagctgcacgcatggcgatcatgttgccctcttggattgagtgcagaagctcgcgaagtagctgctcagtgagtccaaactctgtgatgcttggatgccactctggagtgttatcctcttcgtcgtcggtgcgagattcttcaatctctagacgcgcctgaataaactcaggatccttggacatcgcctcgaagtaacgcgaggtgcgcgggagctgatcaatgagatccagcaatgccacgtacctgcggcgctgatagaacaatgagagatccacgccgtactcatgtgcgagatcggcgcggatctctggcctaaaccgttctaagagcgcatcgaggcgttctagtttcccgaggggccgaagaagtcctcaaagtgagtcttgacagcggcgagaatcttgccaatctgaccaagcgtgaatttctgcttgcgaatcaatcgaagctcttcttcgggaagccattcaccaagaatctcccacaactcatgcgggcgaatcgtcgcagctcggagcagtcgaacacctgactcagcttcgagttcttccggagaaacaaaggtgatctctgacccatcggcgagcacgagcacatatggctcaacgtcctcgccgtctttgataatggatccgatggtgtgacgtggtgctggcttatctgaaatcttgcgggcggctgccatgactggctcctttacttagatgggtttactggcttggcttcaacgattggcgcgggcttctcttcaaagaatccaagtgccttgagtcgctgaatttctgcgcgggttggcttgcttacggtgaccttttgggcaccattggaaaaagtaggcatgactacctttcgtggggcggcaatgaaaagcggcgcgcacgagccgcccaaggacgtgcgcgccacaactaggggttaggcgccctgggtgtatcccagaatgtccttagcgagaatcgcgccggagccgccgaagtaatggcgaaccgggacgccctcgacgtcatcattgaagatgtcgaacgtcacttggcgctggtgagcaccttcatgcgcccacgtctcttcgccaagggatgagatctttgcggcgaagaatccgcgcccctcgatccagtgattggacagtgggccgtcagcggatactacgatcaggcggacttcatcgaagttcgggaggtctggctcatcgaagacaacttcaccagtcgtagcagactgcgtttcggtgatcttcgtaccgcgcacgagttcctgaatggcctttttgccggattcaagaagcgtcatggaaacggtgcgcggtacgcgggtaacatccgagcggaccgggctgtaatagccaagtgcgtcaatgtcttccttttcgatctcgccggagaacgtgtaaccgtcgcgggtaaccatgccaatgggaatgaagcccagcgtggacaggtctgcgatttcggttgcagaagtaaggagggtagccggaagctcgacagtcttaggtgcaaagcacgcgagacctaccgtagttttccgaacgagtgcgcgggagtcgaagtccttgcgctcagtttctactgtggacatagcaaataacccctttcgagggtgtcaatgtggagaaaccccgagtggggtgaaaggtgggcgactagtcgagcgggcgaacgatagtctcaatgaccgccgttgctagatttagagtgtcttgcgggtaaggcgattcagtaggcgggacgatgcactgaatggaatcgaagaacacgtcaggcccctcgatgccgtcaccacacaatgaggtgatgatgctttcgaggatcttctttgcaagctcgcccggcgcgtaaacctcaatcagcacacggtcggcacggtcgatatagccgatgtttccaccagccgaatcgaggaataacgcgagcggaatatgtgagattccgttagcgtcaacttccatatgctgagctgcgtagatgactgaaccagcgtgttcctcgccgtccaccatgagcacgagagccttgcggatgtcaggccaaatgagagcgtcgtacattacttactcaccttcataacctgaataaggcgaagaagaacctgatcgcgagcgtcgcgccaatgctgcgtcgtcacctgcacggacgcaccagaacgctcttcattgttgcgaccaaagcgaaccgacgtgggcaccgctgaatactccgcttcacccatcgagttagccgatcccgcaacaccctcagcaacctctagagtcgccttgccgatctcgctagacgcgccaagaacgcgcaagccctgattcagcgagcggtaactcttgacgccgggaatcttctggagcttcatttctttagccccacttcccagccaaacggccattcaccaggacgccccacgattgaccaaataccagccaaacgcgagccttctgggatgcgtatccggtcagtgttcaagaacgataaaccgggcgttagatcgcaatacagcacggcggttgcgtctgcgagatccgaaaagtcgtcctgctcagtcgagacgcgaggcgcgattagaccatgcggaacttcaatctcggattcgggaagcggattagtgaacttgtcgcgaccgccgccgcgaagaatcgtaaacgaggtgcgccatgaggcggggaaacgggtgactatgcggttattcataaattggaacccccgcaatgtcagcgccgcacgagcagtagagcgcgccaaaattcagattgcaccaaggacgatgaataaccgcatagaatgacgcgatctgaaccccgaacgccgtttgacgcccctcacccagcgcgcggcgctcttgcttggttaggtagaagtcgccgtgtggattggtcggcttggcggtcatctggaatgggccggctccaaactggaccgactcattgccagccatgtcgccagatgccattgcacgttttacgacagcacaaacgatgcgccgaagtgtgctcgccgatgcggccagcgcactgggaacggtgtccacaatgaactgactagcatcagcgagcaacacgttggcgtgatcctcagcccctgcgggaaagtctggccagcgctcaataagctcagcaagtgtcgcaaactgcgttacgtcggccatgacttaccccttatttctcagaagctgcggatgccttttcgacaacctttacgaacgtctgatccagagtctttgcagtctcttcgtcaacgttcacaatggagccggttaccttatttttgaagcgaggcaagttatgcaaccttgtcttcgataacagcgaagcgatcagcgaatacgtaccagccgtaaacaacttcgaggcgaagtgcgatctggttcctgcgcttgaggtcaccctgaccgtctggatcgccgaagcggataagctcaacaggaagctcgcgctgaataccccagcggatgccgttctggaagtcgccaaggattgcgcgaaccttcgtatcaaccgcctccggggtgccggatacggtgttgccctgagctgctgggatggatgcgaacgaggtgatgtccgttccgagtccaaggttcgggtagcgctgagacccagaaggggatccgtctgcattctcggtctggaggtcggcgagcgcccaagcaaacttagggtcaatcgcgatgccatttacgccccaggatggggccgaattgatgagcaggccagctgcggtgcggatatccgcatcagcgtcagccgtggcgatttcaacacgcttcgtggttgcgccaacatagttatcccaggcggtgataacggatccggtaagcggattgatgcggtggtagacgccaaggtccaggccgcgagaaagtgcttcctgaccggcgcttgcaagctcactaaagacgttcagctggtaatcctcggatgcccactgaacttcttcgctgaagcgcatcgtaacctgcgccttgtgaggcttagccgtaacggggctgaagccgccactcgtgctcgccttgtcggcaccctcttcaacaaactccgcctttgggaagtcgttgaatacgatgtaatcggtctcgccgaacttcataggctcgcggcctgaaagctttgcgacggtagaaagtgaacgggtttccttgatcatgccgtccgcgatattgcgcgggagcagaaccttggcttcagcggtgctgaaaatagccatgatttacctttcggtttatgcgccaaacagggagcggacggccttgatttcgtcgctcgcctcaattggcgctggaactttttcttgcccttgaataactgggccggactgtggaacaaggaatgacttcaactgctcagcatgggcaactagttcgtctcgcgtgccacctcggaggacgtctggcgcaatgccgtattccttggagatttcagcgagccaaccattgcgctcagactgcgcttcgaactcagcaaccttgttttcgagtgcagacttttcagagagaaccgactcgaactgctcagccttagccttgagttcgtcgtatccctcatactttttgcgctcgcgtgcaacgcgctcgccaatgatccggtcaagctcttcctgtgaagaaggagccttgaattcttgagcactggttaccgcgtccgcctgaacggcgttagtggtttgttcgtccaccgtgctggtgttgtttactgcatcgggcatgccgaatcacctctccgtttagccacgtctggcatcattgaccgcacttgaacgggtgcgtgccgcttcacggtgggccgtgaaaaccttgttagcgcattcctaattcggagcgcattgaagcgaggatctgttgcttcttttccttgtcggagcgagtttttccgtcagcgtcaacccatcgccccttagtggtgcgattaccgtcagcgtcacgctctccaggaatccactcttgaccctcagaaaccttcttcgctgattcgctgtattgctcgtagtagcgatctgcgtcctgttcgagcttgaaagagttgccctcatgcaccgcaactacggtgcatcggcaatagtcgtgaaagctgtctccgagtcggcgggatccgcgtggacggatgccctttgcttgaccgccacggcgtcgaacctttggaatctcagttccacgccctacgaccgtttttgcggactcgtaggagccatacgtagcgccacgagacgcgagcattgcgcagaacgcgcagcagccggcactcggaacgcgctggtatccaaccggggttgtatcaatctcggcgttgccaataattgtgtcgaatgacgcctcagtgagaacccatgtcagcccgcccgcaatacgcccaaacgcatcagcgtccacgacctcatcaagtgcaaccgaactcgtgccataccctgccaaggagtgccaccgcgagcgagacacggactcaagcggttccgccacgaatgatccggagacctcttgaagctcgcgcaactcgtcgtaccacttgacgctcgcggtgatcataagatcgccaagtgggccgaagatctccggagcaatatcaatcaattgctcgcgagtaatcccagccgcaaccaattgcgataatcgcgcataggcttcgcggcgaatctcttcttgaaccaggcgaaagccttgagtgacctcaatagggaaaaccgtcacgagatcccctaactagtcaccgatccggtgccggttgaaccctctgcggttgcgaccattgactgcgcatcacttccgcgattcgcgccaatgttctggactaactgcgtaattgcagagcggttcacgtcggactgaatgcgcttcacctgatcgtcgtcaaagaccgtttcaagcaatacctgggactgtgcaagcgccggattcgcgctcgccagcttcacgtaagaatcggcattcgcggaggttgaccggaactcagggtccgcaaacttcgcggagagttgccacatgtcagaaggtggttcgcttagcccatcgcgcaccatgacggcgagtgaggcaatatcgcgaacggcggttccaagaacgtacttgttctggaatgtcgcatccacgagtaggtcatgcttattcgcccggatagcctcagcggatgacggattgtcatggatgattccaaggcttgccggtggtattccagtttcgccagagaatgccattgctaccgtgcgcaacatgtccgagtgtggagccattgttgcttgctggagttgcttgatattcggcgcgtgaccgtccgcgtctcgcgtgagagcgataagacgatccattgcgagctggaagcgcttctgagatgacgggtcaccgtcaaacgcctcagcgtcaatgccctcaatggcaacctgtggcgatgagtagaactcagcattgccttccatgcggacataggctcgaacggccatatccgtaagcgccataactggattagtaatacgcgaacgcccaaacggcttccctagctgcggatcataggtgatcgcgaccgctagggtgcgcccaataatgtttttcgtgcgctccgtgatccacgttcccttgccacctaagcggcaatgaagaatcgcgtcaggaagataaacaataaatgcggacggtctaccgtttttagtgtcggtaatcgtgagcgccgcagagattgcgcggcgtcgagcgtcccagagtgccgagctatgctctgcggaatgcgtctgaatctgaacatcaggctcaccaggagcacccttggcgaccgtcgcgaaagatacgccgtgcttatatgcagaagtgacaccctgtgagaattcgagaccgaaacggttggcttcaaaaacctcgccaagctcaaacggatcctcagagccggggagtcgtaagccctcaaactgactcattgacgccagcttgcgaactgccatagtcgcccagccaaggtagaacttcgcgttctttagctgcggcgggagcatgagtccaagatccttgaacgcttgttcgccgtcgtaatagaggctgcggcgctggttcttctctaggcggccattccatgccctgagaagccccgagattgtgtctcgctcagcatcggtaacgccggaaatggagatcttcgagatgtccgaggtagtccaagtgctcacaagaacaccgcctttcttctcggatttcgagttgtagtctttgcgccccagaatgcgaacgtcacggcgtcgaataggacgaccgtgccgccgtcgggggaagcccagccgaagccgccgttgttgccgatttttctctttacggctggttttatttgatcgtcgagcgcttgttggctgatatgagtaatgccgttatccgcgattgcagattcgaacattccgtgagctgcaatagcttcatcggcggatggggtcttgattaccgattccggaattccctcagtccttagagcgtttaccaaatacccaactccagactttccttcaatgacaatctgggcggtgctttctttgcgctcaacaagccaatcaatgagccatgacgtgccgttgctcgacggggcctgcttgatagcctccacatgcacggggccattggcggggcgagttgcggcggcgagaccgattgcagatccatcaattgagaacttcactgcaaaaactcggatgccgtcacgcggaacgtcggtagatgagatggaacgagccgcccacttatcgaagttgacggcctttcgggtgagcgaagtttcatcccagattccgagagcttcgcgcttgaagttctcatcggatccgagcagctttctcattcgaagaattgccgcttcggttgttcggtgaggataagaagggtttgcgattgccagctgcgaacgatcattgatgttggcgtttttatcagcggaaagctcgatatagagacggtcctcgtcgccgcttagtgcgtctgagcgagcggacgtaaagacctcgccattatcgcgtgggcgtggcggcgtccccatcatgaaaactaggccattgggtgccgcgttcgtcgccggaaccatatccgtcatggcgtcctcagagaggatctgagcctcatctagaacaaggatgtcaacctcgtcgaagccgcgaccaaagccggattcgcgagcaccgaagaggattcgcgagccgttgacgaatgttatttcctgctcgccgttagtggcgcggacattctcaatccaaggcgcaactttcggcttcttggcagtggactgcatcttcttgaatgtctcattgtgcgttcgcgttctatgcgcagtccagatcaccgtgagattcgggaagagtgagcacagggagaacacgataagcgaaatgaggtaggtcttaccgacctggcgagggattgagaggatgacgccgccaattccagcggcgtagagtccagagtcacgcttcgctaaggctaggcgaccaatgccgtcctgccatgcatcagagggcatacccatcttttcggcgcgctctttgacagccggccagcccgtggacactattccagtggggcggcagatatggcgagctacctcagatagcttcttctgaccactccgagtcttcggttgcgccaatagattcggcctcctcggacttttgacgttttagcgtctctatttcccgagagatctcaatttgacgacgcattagagcggcgagggctgttgggtttgtgttcgggtcatcaatacgcctcgacgcaacgcggcgcatttgctccaactcatccagcacggtgccattctcggcagcttccaacacggaagtaataggcttcggagccgctacctgctcgccgtccttgactgctcggagcgatgctcgctttgggtttgccatactcgctccaatcggcgctaaaaaaaacggacggggagggatcgctgtgacttgaagtcgcggc

SEQ ID NO: 3 - DNA, 20087 bp, Zea mays
gatcggcgtgctgcggcccgtggcgatatccagcacggccacgtcattggcgaaacgctggtaggtgaccgcatgcgagaacggtgccttgagtgttctggtcagcacatgcacgccatccggggcggctccgatgctgtccagcagcgccggggcgccgacggtgcgcacggtgttggaagcggtatccaccactgccagctgcgactggccgtaataggcgaacagcgcttcatcgtaggcactggtcagcgtatcgcgggcttcgtaggtgctgctttcgccagccgtgcccagcgactcctggatgtccgggccgatcgcaccttcggcgctcggcgccggtccctgcttggcaggcaccagcttgaccagcagctgctggctgccgccgagccactgtacggtgctgccgaagatcgggttcagcgcgacgttgggcacctggcggacctggccggtcgctgcatcgccgatccacagctgcacgctgtcatcgaccacgttctggaaggcgaagcgttggccgtcggccgaccactgcgccatgccggcgcacccgctgggcaaggacaccttggtggagcggccactggcggtatcgaccacggtgaagtcgcccacgcacggtggaatgccataaccacccggggtgtcgtggcggctgcggttcttcggctccaggcgcacgccggccagcttcagatacggctgggcgacgcgggtgatcgacggataggtctgcgtggtggtcagcagcaggcgctggccggtcgggtcgacgctgggcgtcggcggcggcggtgccttgagcaccttgagcaggctctccggcggcgtggcgtaaccggcaaaggccggtgcagcgagcagcagcccgaaggtggcaacggcaacggccgcagccagcgaagtacgacggatcagcatccttatccccttgcagtgtcaacgagtgcccgcaacaggggcatgacccgaatctagcaccgccgggaccggtgtgaatgggccggaagggccaaccgcccgacactgcaaagcgaggcgttccaccgtgccgggtagcgcccccttacgcgtcacgcccggccttggcccggctagaatgccccatgcgaaccgtgcacgccctccgatatgtcaccccgctgcgcgaaggcggctccctgcccgccgtggtcgagaccgacgacgacggcatggtggtgctcaaattccgcggcgccggccaaggaccgaaggccctgatcgccgaactgatcgccggcgagatcgcccgcacgctcggcctgccgatcccggagatcgtgttcgtggagctcgaccgcgagtttgcccggaccgaaccggacccggaaatccaggatctgatccgtgccagcgagggcctgaacctgggcagtgattacctgcccggggcgatcaactacgacccggcggccatgcagcccgatgccgagctggcctcgaagatcgtgtggttcgatgccttcaccagcaacgtggaccgcaccgcgcgcaatcccaacctgatggtctggcatcgcaggctgtacctgatcgaccatggcgcagcgatgtatttccatcacgactgggccagtgccggggaggcctgcaggaagccgttcgtgctgatccgcgatcatgtactgctgccgttcgccacgcggattgccgaagtggattctgcgctcgcggtgatgctgcccgatgccgaaatcgagcggatcgtcggcctggtgccggacagctggctggtggacgaacccgccttcgacagcccggcggcttaccgccaggcgtatatcgattatctgcaacaccgccttcgcgtacgcgcggcttttgtacaggaggccgtccgtgcccacactgcacacctatgactatgcggtgatccgcgtagtgccccgcgtggagcgcgaggaattcatcaacgtcggggtgatcgtgtcctgcccgggcgcaaagcacctggaagcagcgatcgagctggatgtggagcggctgcgtgccttcgcgccgacgctggatatcgagggcctgcagccgtggctggatgcgatcgtggcgatctgccgcggtgacacgaacgccgggccgatcgctcagctgcctgcgcgtgcacgtttccatttcctcaccgccaagcgcagctcggtggtgcagatgtcaagcacgcacgtgggccgtaccgcagagccgacaggcgtggtcgagcatctgatgcggaagatggtgcgggtcccggcgtagcgccgtcggggcggcggcaccgtcaccattcagaccggccagcggcaccacgaaaacggatagccatgcagaccgctggccagccccgcccgcatcgggagggacaggatgtcggtggcgcgcgcaagcaggtcgcgctcatcgcaccgggaatgatcgtggcagcccggttgccagatcctgccctggttcgcattgcgttgagtgagcgcgtgcgccgatcgcgatttcagccagcggaccacactcgtcatcgggtgcctgcgaagccggaacagccaatgcacgcggtcgggcatgatggcccaggcgaaagattccgtgcgtctttccgcatcggaagcacgcagccagcgcgcaacatcctgcgcattgccgtgatgatggaacagcgggaattgatgggtggtgacagtggtgacgacgtagcaggcatttgacagcggacatcgcgcagatcgaacagaggaactcggcatccggccagcatggcagcgcgtgccctccaggctcaccgggagagaacgcggcccgttgtcagatttctgcgcgaagcgctgtagtctcgcaacgagcggccgggcgctgcccggccttgcgtcaatggaacgccggccacatccgacgcggcgtccctcaccccttcggcaacgcgtaggcgatcacgtaatcgccggccggggtttccatgaagtgatgaccaccggccatgatgaccacgtactggcggccaccgaactcgtagatcatcgggttggcctggccgccggccggcagcttggcatgccagagttccttgccggttttcaggtcgatcgcgcgcagcagatcatcggtcgccgcggcgatgaagatcaggccgctggccgtgaccaccgaaccaccgttgttgggcgtaccgatctcgatcggcaggccggagcggatgccgaacggcccattgccgcgggcgctgccgaacgggcggtcccacagggtcttgccggtacgcaggtcgaccgcgcggatgccaccgtagggcggctgcttgcacagcagcttggtgaacggcaggcgccagcccgcgttgacgtcgatggcgtacggcgtgcccacctgcggatcgcccgcgccttcggcgccgcccttgtcggcggtcacatcctcgcgcggcagccatcccagtttgtccgccttctcgcgcggcaccagccggttgtagttgggcatgtcgttgtagttggcaacgatcacgcctcggcgcggatccacggccacgctgccccagtccgagcccccgttgtagccgggatactcgatggaatgacggtccgcggtcggcggggtgtagaagccttcgtaactggccttgcggaactggatgcggcagaccagctggtcgatcggggtcatgccccacatgtcgcgctcggtgaggtccggcttgcgcagcgtgtgatacagcgagaacagctgggtgggcgagcgctgttccggctcgacgccgcccgtgggcaccttgcgctcttcggcggcggtcagcagcttgccggtgcgacggtcgaggatgtacatgtcgccctgtttggtcggcagcagcagggccgggactttgccggcggcggtcgggtagtcgatcagggtcgcctgcgagcccatgtcgtaatcccagacgtccttgcgcaccgcctggaagtgccaggccggcttgccggtgttgacgtcgatcgccaccagcgaggtggcgtaccggttttcgttttcggtgcgcgagccactccagtaatcgccggccgagttgcccatcggcaggtagaccagcccaagttcgtcgtcgccggtcgcggtggtccacatgttgggggtgccgcgggtataggtctcacccggcggcggtgcgccgttgcgctccgggcggaccatgtcccaggcccagcgcagtttgccggtgacggcatcgtaggcctggatcacgccggacggcgcgtcgcggcgctgtccgtccagcacctggtggccggtcacgatcacgccctgcacgatcgccggcggcgaggtgatggagacatagccggccgggctgtcgcccatgcccacggtgatgtcgacctggccgttgttgccgaaaccggcgcacggcttgccggtggcggcatcgaccgcgatcaggcggccatccagggtgccttcgatgatgcgggcggcacaggcgccacgcggcacctgggtcagcacgggcacgccgctgggaacggccaggtccgcggccacatcgttcaacgcggtgtcctgcgcggtggcgggcacttcgtagtaggagaccccgcggcaggcggcggtgtacgggatcgacttgtccttgatcttcgggtcgtagcgccagcgctcggtgccatcggcggcgttgagcgcgaccagctgattgcgcgcggtgcacaggtagaggctgtcgccgactttcagcggcgtggtttccgcaccccagcgcttctccggcaggtcgccagtgcggaacagccaggcctgctcaagcttggccacgttgtccggggtgatctgctgcagcggcgagaaacgcgttgccgcgttgttgcgaccataggcggcccagtcaccgtccaccgggcggtcggccggttgcaggggcgcgtcggccgtgggtgccaggccggtgctggtcatcggctcggggaaggcgccctgtgcctcggtaacaccatgtggcacgaaggccagggtgaaggccgccacgaacaccagcgccagcacgccggcgatgccgcgcgagaccttgcgcgacaccgggcgatccaacgtcggcagcagcagagacagcacgaagccgatcgccacgatcaggcccaggcgcggcacccagcgccaatagttgctgcccgactcccaccacgtccacagcagcgtgccgacgaacaccagcgcgaaccacagcgcgccgctgtagcggccccgccacagctgcacgccggagatcagcaggccgacgccggccagcacgtaataccaggaaccaccgaggctggcgagccaggcgccacctgcggtgaatacaacgcccagcaacagaatgacaattgccagcacagccaccagccaatggcgggggcggcgggtctgcgtcgtggtggacatcggtttctcctgaagcgcgaagatcgccgacgttgccgccggccccgcggctcttatcccaccggggtcgtgaacgttgcgcgttctttgctgcagccgccagcgtcggcacagccgacgatgaaagcgtgcaatctccctgccccacaacgaaaaacgccggcatctgccggcgttttccgtgtcactgccgcaggggcttacgcctccggcggtgccaccaccgggctggcctcgacggccgccggtgcatcttcttccacaccctcatccagcgaggcatccatgcgttcaaccgcctggagcttctcttccttggacagacggatcagggtcacgccctgggtgttgcggccgacgcgcgagatttccgaaccgcgggtacgcaccagggtgccaccatcggagatcagcagcacttcgtcgcgcgggcccatcagcaccgcacgcaccagcttgccgttgcgctcggtggtctggatgccgatcacaccctgcgtgccacggcccttgcgcgggtaatccggcagcggggtgcgcttgccgtagccgttctcggtcgcggtcaggatgtagagcgcgttgtcatcgtcggcgccgttctcgatcacggcatcgccgctgtcgatcacggtctcgtcgacctggctctcatcctcgttctcgtcttcgctgccgccggcactctcggccacgatcaggctgaccacttcctcacccttgggcatcttgatgccgcgcacgccggtggcggtacggcccatcgagcggaccttgtcctcaccgaagcgcacggtcttgccgttggaggcgaacagcaggatgtcgcgctcgccatcggtcaggccgacgccgaccagcgcatcgccctcatcgaggttgatcgcgatcttgccgcgcgccaggcggaaggcgaactcgctgagcggggtcttcttgaccgtgccgttgcgggtggcgaagaacacgaactggccttcggcgtactcgcgtaccggcagcacggcctggacccgctcaccggcttccagcggaatccagttgatgatcgggcggccacgggcgttggagccggcctccggcaactggtggaccggcagccagaacaccttgcccgcactggtgaaggtcagcagcgtgtcatgcgtgttgaccagccacagctgttcgatgaaatcctcttccttggtcgaggcagcgctgcggccacggccaccgcggcgctgggcccggtaggcactgaccggctggcgcttggcatagccggcgtgcgacagggtgaccaccacgtcttccggggcgatcaggtcgaggatgtccaggtcttcttcgctgtggcggatctcggtgcggcgctcgtcgccgaactccgtacgcacgttgatcaactcttcgcggatgacctgcagcagacggtccggatcttccaggatatggatcagcccggcgatcgtttccagcagcagcttgtactcgtcggtcaggcggtcctgctccagcccggtcaggcgatgcaggcgcatttccaggatctgggtcgcctggatctccgtcagctggtagccgcccgcgagcaggcccacacccttgggcagatcatccggacgcgaggcttcggcaccggcggcgcccagcatcgagccgaccagccccggctcccacaggcgggcgagcatgcgttcgcgcgcctcggtggggttcggcgaggtcttcgccgacttgaagtaaggcttgttggcgtgcgcgttgagttcactcatcgcgaacagcacgcggcgatgcaccggcttgaggccatcgcgcgcatccgggagtgcgcgccccacgatcacgctcatcgcgtaatcgaggtaactcttgcgcatctcgtcttccaggttgacctggatgatttccttggcggtttctgccattcgggttccgttgtctggtagcggtccagtccgtcacgaccgccctttcggggcggttgcgccggaatctcgattaaccgttggattctaccacagcgggccattttccgcccgcttttacgggggttttaccggcaagaatcaggaacttacgggagcgttggcgggcgcttgggcaggccacgaccgtcggtcgtggcacgcgccgcagccggcctcagccgaacgcggcctgcatgttggccaccgtcgggttcaggatcaccccgcgctcggtcacgatggcgtcgatcaggctgcccggggtgacgtcgaagaccgggttccaggcggcgatgccctcggccacggtgcgggcgccgcccacgccgtagagctcgccgggatcgcgctgttcgatctcgatctgctcgccgtcggcagtgtccatgtccaccgtggaggacggcgccaccaccatgaacttcacgccgtggtggcgggcggcgatggccagctggtaggtgccgatcttgttggcggtgtcaccgttggcgcagatgcggtccgcgcccacgaccacccactgcaccgcaccggtcttcatcaggtgcgaggcggccgaatcggcgatcagggtggcatcgatgccatcctgctgcagctcccatacggtcaggcgcgcgccctgcagccacggccgggtctcgccggcgaacacgcgggcgatgcggtgctgggccatgccggcgcggatcacgcccagcgcggtgccgaagccggcggtggccagcgagccggtattgcagtgggtgagcacaccgctgccggcctcgatcaggccggcgcccagcgcgcccatgtggcggttggcggccagatcctcctcggcgatggcctgggcttcggcggccagcacctgctgccagtcggcaccggccggggccagcgcgcggcgcatgcgggccagcgcccaggccaggttcacggcggtcgggcgcgaggcgttgaggcgttgcagggccggctccagcttcaacagcgcttgggcgccatcgtcggcctggacctcattggccgccagtaccacgccccaggcggcggcaatgccgatcgccggtgcgccgcgcacggtcagcgcatggatggcctcggcaaccgcgtcgctgtcgcggcactccacgtgctcgacgatgaacggcagtttgcgctgatcgagcagctgcaggctctcgccggtccacaggatcgggcggatatggtcgtaacgggcgtagtcgatgtcggtggatgcgttcatcgggccattgtagcggcgtgccgatgcaggcggaatcgcgcgctcagttgaccgcgaactcggcgcggcagcccttgtcgacccagaccccacggctgtcccagccccagctgctgccctgctcgcagggggtgccggagagctgcttgttgagcgtggcaccgtgggtgatcccggcgccacagaagcggcgctggcgcgacttggactcgcataccaggatgcgtggcacgttgaggaacccgctgccatcggcggcaccgacctcgaactcgccctggcaaccgcgggtcacccagatctcattgcggcgatagccccagctgtggccttcgcggcacggcagcgaggtgagctggcgcagcagacgcaccggcgcgccctgtagcacgaccgggcagctctgcgggcgcccgttggattcgcagcgcaccacccgccgcgtgcggcgttcaccgtcggcacgcggcgcggcagccgcggtacgcgcgcggaactcggcgcgacagcccagggtcacccagacgccggaacggtcggtgccccattccgagcctcgcacgcagctgttgtcggagagctggcggatcagatcgacaccgccttcggtggggacatcgcaatgcacccaccccatgtcgcgcgattcgcaacgcaccacctggccggcatagccgccggcctgcgcgagcgccgtttcaggcatcagcgcagtccacagcaacaccggccacaagggcatgcccgcgcctaccaacagcttcatcaacacgatccccgccacgcctgaacaatcacatgacccaccttcggacatccggtgtgatcagagcatcatcatgcagcccgtgcaagacgcgaatgcgtcaaaacgcctcaggcgtgggcgaaatcgaaggccagcacatcggcaatgcggccggtgcggttcatcgccatcagcagccggtccacgcccaccgccacccccgcgcaatcgggcagcgccggcagggccgccaacaggtgttcatccagcgggggcagcacgtcgccgcgcgcggtacggatggcatggtcgcgctcgaaacgcgcgcgctgttcagccgcgtcgttcagctcgtgatagccgttggccagctccacgctgccaaggtacagctcgaaccgttcggccagcggcggcgtgcccggccgaattctcgccagtgccgcctgggtggcaggccagtcatgcaccaccgtcatggtgtcgtcacggaagtgcggttggatgcagtgggtcatcagcagatcgagccagtcatcccgggtcaatccgtccgcatcgatgcggacctcggccagcggtgcctgcaggtcttccaggctggcctggaacgggtccagcccgacgtgctgctggtagagaccacggtaatcgatgacctccagcgtcgcctcgcgctggaccagctgcagcgcatcgcgcacgagggcggcggtctcgtcgatcaggcgacggtggtcccagccgacccggtaccactccagcatggtgaactcgggattgtggcggccgccggcttcgccgttgcggaacacacgacccagttcgtagcagtcccccacccctgccgcgagcaatcgcttcagcgggaactccggcgaggtgcgcagccagcgtcgcgcggtgcccgcatccacgtgcccgctgaagcgggtatggaagctgtcgatgttcggctcggtattgcctgctgcggacaggatcggcgtttcgacctcgagcacgtcgcgtgcggcgaagaagcgacggatcagcgcattgagtgcggcacgctggcgcagcgcggcgatcacgcgcgcgcgtccttcaggcgctgggccagcggcagggtcagcagatcgcgggtgtcatccacgtagccggtagccaagtacaggcgtcgcgccagttcgttgtgatggttcacttccaggcgcatgcgctccacgccacgtgcgttggcgcgctgctcgaggatggacaacgcctgcttgccgcggccccgcccacgcgcggcatggctcaggtacagctcatcgagcaacgcgaagtggccgccctgctccaggctgaagcccatcgccagtgctccatagcccaccaccgcgccggcctcgtccagccacagcagcacttcaccgttgcgcggatcttccagcaacgcggccagcgcgttccgcacccgtgtgtcttcgaagtcgagtttgtcttcggcgtagaaatcacgcatcagcccgatcagcagctcggtgtcggcgacggtggccaggcggaaatcgagggggacggtctgcatgcggtttctcttgttcagtgctgcgcgaggaaggcgaccagctggtcttcgtcccagaccggcacgcccagctcctgcgccttggtcagcttggaaccggcctcggcaccagcgactacgaaggaggtttttttcgacacactgccggccaccttggcgccgagcgcttccagccgggctttggcctcgtcacggttcatctgcgtcagcgttccggtcagcacggcggtgtggccgtccaacgggccggcgacctggtcggcctgctccggcgccagtgccagcagcctctggcggtagtcctcggccttgagcagcatcgggccgtggccttcgctgtcgagccagtcggccagcccgagggctacctcgttcggcaggccggcggccacgaaccgcaccggctcggcgtccagcaccgaggccgcatccggcaacatggccaccagcttctccgcgcgcagccgggtgatgcccggaatctccgcttcgaccagcagctgcgcgaaatccagaccgtcccgcagcttggcgatcggcgggtgcacatcgctgatgcgcacctggccgacctgcagcaacgcatcgatcgcctcctggttgccggcctgttcgaagaagtggccgagcgaacgcgccacttcgccgccgatgtcgggcacgcgcttgaacagcggccacggcagatgacggatcagttcgagatcgccgaaccaggtcgccagcgccttggcggtgctctcgccgacatgctcgatgcccagcgcgaacaacagccgctccagcgtggtggtgcggctggcgtcgatcgcggcgatcaggttgtcggcccacttggtcgcgatcttcttcgtgttccaggcgaacgtggccggcatcgccagcgcctgcgcgcgccatgcctcgtcgctgccatcgagcttgaggatggccctcaggtactcgccgctgccttccggcggcaggtgcaggccgatctggctggccagcgcctcgggcgattcggcatccagcaccagcttgagctgcagcagttgatcgcgctgcaggcggtacagatcggctacgccgcgcacgataccggcgtcgaccagggtctcgatgtacttgccgcccaggccgtcgatatccatggcgcggcgcgacgcgaagtgcgcgatggcttccttgcgctgcgccgggcagctcagctcacccgagcagcgccaggcggcctcgccctcttcgcggacgatctccgagccgcacaccgggcactgcgagggcatctgccacggcgtggtgccggcgggacgacggtcggcgatcacgctgaccacttccgggatcacatcaccggcgcggcgcacgatcaccgtatcgcccacgcgcacatccaggcgcgcgatctggtcggcattgtgcagcgtcgcgttggagacgatcacgccggccacggcgaccggcgccagacgcgcgaccggggtcgcggcacccgtgcggccgatctggatctcgatcgcctccaccgtggtggtctgttcctgcgccgggaacttgtgcgcgatcgcccagcgcggtgcgcgcgcgacgaagcccatctgttcctggccggcgcgatcttcgagcttgtagaccacaccgtcgatatcgaaagccagaccgtcgcggcgttcgccgatgtcgcggtaataggcgagcagcccgtcggcgccctccaccacctggcacaggtcactcaccggcagcccccacgcgcgcagctgcgccagcgtggccgaatgcgtgggcggcagctcgccgccttcaacctggccggtgccgtaagcgtagaagctcagcttgcgccttgcgctcatcttcggatcgagctggcgcagcgaaccggcggcggcgttgcgcggattggccagcactttgccgtcatgcaggcgcgcatcggcgttgtaggcctcgaagtcggcacgggccatgtagacctcgccgcgcacttccagcaccgctggccagccctcacccttgagcacctgcgggatcacactgatctggcggaggttcgcgctgacatcctcgccggtggcgccatcgccacgggtcgccccctgcacgaaacggccctcctcgtagcgcaggctgatcgccaggccgtcaagcttcggttcggcggaaaaatacagcgtgctgcgacgcaggcgctcgctgatgcggcgcacgaaatcctggacttcctcatcactgaaggcattgcccagcgacagcatcggcaccgcgtgacggacctcggcgaaacgggaggacgccttgccaccgacctgccgggtcggcgaatcggccgcggccagctccgggtgtgcctgctcgatcgcctccagctcgcgcaccagcaggtcgtactcgacgtcggggatcagctgctcgtcgcgctcgtggtatgccttgccggcatcctcgatctggcggcgcaggacgtcggcacgtgcggcggggctgggggtcatgcgggaggcgatcctggtggggcattcaattttacccctccccccgctcctgcgcgcagtgaagaacgcttgccgccgatccgccgtggcgctagcgtgcgccgaaccccttgtttccggtgccccgtgacccctgcccccgccacttcccgtcgctcgttcctgcagctggccggtgccggcctggcgttgtccggcctgggcgtgctgcctgcatccgccgcgccgtcgcgtgcgctccccgtccgcacaggaccggtgctgctgaacttcaacgaatgcccgtatgggccatcaccggctgcgcaggcggcggcgcgcgacatcatcgccagcagcgggcggtatctgtttggtctggccggcgagctgcgcgatctgttcgcccagcaggaaggcatcgacaaggatcacgtgcggctgtatccgggctcgagcgagccactgaaccgggcggccgtgctctggacctcgcctggtgcggggctggtggtcgccgatcccaccttcgaggcgctgggcgatcttgccgcggcgcgtggggccacggtggccagggtgccgctgcgcgccgacggggcacacgacgtgcatgcgatggcggcggctgccgcgacggtcaatgccggcctgctgtatctgtgcaaccccaacaatcccaccggttcgatcaccccggcggccgacattgcctggctgctggccaacaagccggcccagacccgcgtgctggtggacgaggcctacctgcagtacagcgagcagcgctcggtgatcggccaggtgatgcagcgcgacgatgtgatcgtgctgcgcaccttctccaagctctacggcatggccggcctgcgcctggggctggcggccgcgcatccggaccggctgaaggaactggccagcctgggcgacaacccgctgccggtcaccgcgatggcggcgggactggcgagcctgcgtgatccgggattgatcgcgcagcgcaaggcggagaatgccctggtacggcaggagaccatcggctggctcggtaagcgcggctttagctgtgtgccgtcggaagcaaactgtttcgtggtcgatgtgcagcgcgacggcgcggcgttctctgcggcgatggccgaacagggcgtggtcatcgggcgcagctggccgatctggccgcagcggggccgcgtgacggtgggcaccgcggccgaaatggcgcggttccgtgcggccttcgacacggtggtcagccagaacaggtagagccgaccgttggtcggctctacggcaatcaccagcgcggggccttggtcagcggcggggcctggtgctggcggtcgtaggcgcgcagctcatcacggatgtgcgcgatgcgctggcgacccagggcattgcggctgtcatcgagcacgacgccatcgagcagctcgcccatgcgctgcacggtcggcagcatcttttcccaggcgtccagcgcggtcagcggcgccggcagggtcaggaagaaggcgatcgccggcgtttccatctcgcggatgttggccatatcgaaactgcccggcttcatgatgctggccatcgagaagatcgggccgcgctcggggtggccttcgaccaggcggtggaagacattcatgtggccgaacaccaggccggtcttttccgcagcgacgacgatgtcttcgccacgcagctgctcgcccgcgcgcgcagcgacgaacagcgagacgatcttgtcgaaatcctgcgtcgcacgcttgcccaggtcactggccggcgcggcgtccacgtccggcaggcccagctcgggctgggtaacgccgtcttcgccgacaacgggggcagcgccctcggccgggctctcgccctcgcccaacacgggctcacggcgctggccgctggtgctctccgcaccttcgacgcgacggccctgcactttctttttcggacggccaaacaggaagatcgcagcgatcaacagcaggccggcggccaggatgccgatgcggagcagtgccatgtcggacattcgggggggtctccggctaaatcattcaggtacttaaggatggcacgtcaggccgcgcccgccaatcgtgcggcttcctccaggtcgacactgaccagtcggctgacgcccggctcgcgcatggtcacgccggagagctggtgggcagcttccatcgtggccttgttgtggctcacaaacaggaactgaaccttctcgctcatttccttgaccatgttggccaggcgaccgacgttggcttcgtccaacggcgcgtccacctcgtccagcaggcagaacggggccgggttgagctggaagatcgcaaacaccagcgccaccgcggtcatcgccttctcgccaccggacagcagcgagatgctcgacacccgcttgcccggcggccgcgccatgatcgcaacaccggtgtcgagcaggtcttcacctgtcagctcgaggtaggcgtggccaccaccgaacaggcgcggatacagctgctgcacaccggcgttgacgcggtcgaaggtgtccttgaagcggccgcgggtctcgcggtcgatcttgcggatcgcgtcctccagggtttccagcgcggtggtgaggtcggtgttctgcgcatccaggtactccgaacgctgcgacgcctcgccgtattcctggatggcggcaaggttgaccggctccagccggcgcatgcggccatcgatctggtgcacggcctgctcccagtcggtgacccgcgcatcctcgggcaggctgttgatcacgtcctgcagcacgaagccggccttctccacagaggccgacagctggtcggcactgagcaccagtgcctgctggtcgagcttgcgctgggaaatgcgctcgcgctgcgccagcgcctgttcgtcgcgctggtggcgggtctgctcgaacgtgcgcagttcggcatcgatgccatcgagcaacgtacgggcttcgcccagcacgcggtcggcacgcacgcgctcgcccaaggcgttctggtgttcggcttcgagcgccttgaccggcgaatcaccgtcgtccagctgcgaatgcagttcacccaatcgcgtatccagctgcccacgctgggtactcatgcgctccagcgcctggctcagcgaggcgatctgcgcgcgttgcgattccagcgtcaaggcgagcgaatgcgccgcctcgcgcacgttgcgggcctggtcgcgggcctggtcgcgggcatcggtaagctggcgacgctcgccttccagcgcggcgcggaccgattccaggtcgcccatgctggtgaccgcatcgtccagccgcgaacgtgcttcgcgcacctgctcgcgaccggcatccagcgtctccagcaattgcaccagctcgccttcgatacggtcgatgcgggtgcgtgcggcctccaccttgccctgctggctctgcagctggccaccgagctcggaaacgctgcgatgggccaggtacagctggcgctgcgcatcttcgcgttgctgctcaccggccagcaactggtcacggaagccggccagctgctcttccagggccgcttcgcggtcctgcagtgtctcaatctgctcgcgcagggtgacgatctcgcgttcgcgcagcagcgcgccctgcttggccgcgccggagcgcgacacgcgcacccagccctcgcccagccgctcgccaccgcgggtaatgaccgagtcgccctcgcccagtgtcgcctgcagcgcacgggcggacgcgagatcctcggcggcatgcaggcgtgccagcagccgacggatcgcagtggggccctgcactttcgcggccagcgaggtcggcgcgacgtccagcgcgtcctgctcggccgagaccagcgcgatacggccttcgccgagttcgcccagcgcgtccaccagcgatgccggggaatcgaccagcacgccctcgatcagctggccgagcgcgctttccacggcgttttcccagccgctctccacggtcaggcgctcgccgacgcgcgcgcccgaatccagcccgcgtgccttcagccaggccaccgcggcgccctgctcctggcccagtgcggcctgctgcagggtttccagtgacgacaaccggccgcgggcggcctgggcctgcttgcggatctcggccagctcggtctgcccggcgcgctggcggtcctgcagcccggccacggcatgcttgcgttcttccacctgctcgttgagcgtgtccagcgaggccttctgggtctcgtgctggaggtgcagttcttcaaacacctcggccagggcgtccagatccagcccggcgcgctcggcctgcagcgactcgcggcggcgatcggcttccagcacctggcggtccagataatccacgcgggtgcgctcgacttcgccggcgcgcgaggcttcggaggtgctgcgggtatggctctcccagcgctgctgccaatcggccagccgggcctcggcatcacgcagggcttcctgcttgatctcattctcttcctgcaactgctccaggcgcggctcggcatcgtccaccgcctcgcgcagcaccatcagcttggcctcatcgccactgatgtgctggcccagatcggccagtgcctgctgcgcttcatcgcgcgccttgttcagtcgctgcgacatctcgcgctgatgctggatctgctgctccaggcgggccagcgtgctgccgacctggtagacctcggcctgcgcggtgttgagcgcatcggaggcctcttcgcggcgcaggcggctggtttcgatgcgggcttcggcatcgcgctgctcggcgatcagctgttgcaggcgggtctcctcgcgcgaaagtgcttcgcgcaggccgcccaggcggccatccagcccacggtattccagcgccttccactcggcgtccttgaccttgcgctcttcctgcagcgcctggtactgctcggcctggcgcgcctggcgcttgaggtgctcgagctgtttgccgatctcctcgcgcaggtcgttgaggcggtcaaggttctcgcgggtatgccggatgcgggtctcggtttccttgcggcgctccttgtacttggagatgccggcagcttcttccaggtagacccgcagatcttcaggccgagcctcgatgatcttgctgatcatgccctgctcgatgatcgagtagctgcgcggccccaggccggtgccgaggaacaggtcggtgatgtcgcggcggcggcacttggtgccgttgaggtagtagttgctgctgccgtcacggctgacggtgcgcttgaccgagatctcgttgaacgaggcgtactcaccggtgatggtgtggtcggtgttgtcgaagatcagctcgacggcggcctgcgagacgggcttgcgggcggaggagccggagaagatgacgtcggtcagcgagtcgccacgcaggcggctggcggagctttcgcccatgacccagcgcacggcgtcgatgatgttcgatttgccacagccattggggcccaccacgccggtcatgttggtcggcaggtgcagcgtggtcggatcgacgaaggatttgaatccggacagcttgatcgtggacagacgcatggcgtgatggttttccgggcgaaggcctgaagcgacccccaccatggtggattacggagcggatttacccctcaagccattgatattgcaggacttcaatgaccccgggggcgacgcgatagcctgagtataacggggccggtgttcagcgcgctgcgggggcggctccagcccgcatttccagcgtggggccaggcaccctcccgtctgtatcgtcacggcgccaagccgttgccgttgccacaaacaaaaaacgggcaccctcgcgggtacccgtttcagtgacgcccgcctttcggcaggaatcaggccttttcggcttccacaaccaccttgacggtggtttccacgtcggcgtgcaggtgaacagtcacctcgtactcgcccacgttgcggaaggcgccttcgcccaggatcacttcgctcttttccagcggcaggccggcagcggtgaaggcttcggcgatatcgcgcgggccgaccgaaccgtacagcttgccttccgtcgaagcgttggcagcgatggtcacgctcttgccttccagctgcgccttgcgggcttcggcatcagcgtggatcgactgggccttggcttcgtaatcagcgcgcttggcttcgaactcggccacgttggtcgcggtggccggaacggccttgccggtcgggacgaggaagttgcggccgtagcccggcttcacgtcgaccagatcgcccagaccgccgaggttggtgaccttctgaagaagaatcagcttcatggtgtagctccaaatgtgtattcgttagcgaggcccaggccccgcagcgatggctgtccgaatatccgaacggcagatcctttacaccgcccgacgcttcacagcgcgggcggcgggatctgcgaaagcggcgacccgcaggccgcccgccttcatcagacgtcgtggttgtcggtgtacggaatcagggccaggaaacgggcgcgcttgacggccgttgccagctggcgctggtacttcgacttggtaccggtcacgcggctcggcacgatcttgccgttctcggtgaggtactggcgcagggtgttgagatccttgtaatcgatctccttcacaccttcggccgtgaacttgcagaacttgcgacgacggaagaacttggacatgtcagtgctccttaa

SEQ ID NO: 4 - DNA, 19489 bp, Zea mays
  misc_feature (18693)..(18694): n is a, c, g, or t
ttcttctttacaacgatagctcgccttactgctcttaaatccctactagccatctcttccctccctcgcccaggcagggctggtgacatctaaggaggatggagcaccttccattgaagaataggcatggaaggaatgccctatttatctctttgatagaagaagcagcttactttccacaccttgcctacttgacaacgcttttatatggagtggcttcaacccatcacgcatgaaagtgccaaaggattttctttacgacaactcagagtcgaattggtcctttgcaagtggacgccagccgtagagccctagttctagcctactatgtagagtagagtagactcttacttgaaaaaagataagttaagaaatcaattcttattcgcttttcactttcactactggtcaaagctcgtccttagagactactgccttactttaaagaactcactagggctagcttattagggataggttattcagcttgctgacaaggttagtgcttaccaggctatattctatcaataaaattgcttagggataaaacagattgtcttatcctacttaggtattagggtttagatgacctcctcatcctcttgagtatgatgcaattacatcggccctcatgtattattgcatcaataccccatcataggcaagtttacacactgggacaacatagggtgggccccacaagagagtagccaacagaaccaagaacaagatctagcagatggtgggagattctcactcgtgatgaaactatcatctcctacgagaatatgcactacatcggcatcaatcaacctggcttcgcgttctattcttacgataggggggcacaatctcgtcagtctcctggattccagtcatgtctctaccatcggtttctcccttttctccggctcgcgtaataaggagggagtcagagactaccaactcgacaatgttggctcgatcatgtttatattggcaggaggaagtacagcatgcttcttaagcttattttccaaggcgcggctgagagttatgccgaatggagtgaaagtcctgagtgtctttggttttccgtcagacaagatattcacttcactattcttgcttgttccccccagggctatcttctttccttttggatctgcctctttgacctgtgatccatgagtcccatcccattgtagatagcatcttcaatacgagtggctgcttcaatcaaagagcatggtcatcgcttggaaatagaaatagtcatggtattgcctactcatgttattcatcattatccgaacttgttccttttctggggatagatcaatcacttgggctgctttggccttccaacaggccaggaaattggtcacaatcataaaagacctgaactggaggtgcttgaggtgcagtagaaggaacagactttgattgatgagagattttggataagagttcataaaaggcgctagcctgtttcatggtcaggaagggaaaggaaagagctgggtttctaacaaaaaaggaaacgtttccgtaggaaaaatctatcacatggaaactcgagtaaatagaagtttttttcaatccttggttgcaatggttcaatcgagagaagagcaagtcaatttcataaattggaacaaccacatcagcttcattcttttcgcataggggtagttttgtcaactcgcctgaagaccactggaatcgtaaccaatacccctggccacacaattcaaacctaccaaactctagtacttacatccctaaccattatccaccttctctcattctctctctgcgaatgagctaatgcttttttttcgatccctgccacacccggcatcgtgttaccatttgatgacttcttagggggacagtttaagtaagagtagggatagttgaaagagtagttagatgagtcctgactcctgcgtatttgtacgagataccttagagcttcaaagtgacaaagtccggtgtgaggttaattgaacatattgaaatatgggtccccacacaaataaagtaagaaaccaaattttccttaaggaattggctctgaggcccggcaactcgaacttttctaagcaggaaggaaggaaagataaaatcaagatctttctttattattgcatccctctatcccttatgatctgatctatgttctgtaccagtgtgaatacatactctttaggctggtttctttactgattcagtgtccctgcttgacttgcttggattgcgtacaaagcttccccatatttcttatagggatgatgaccactgacatttgacattgtcttcattcgtttactgctggcctgaatattccataattggatggatgcccgagcatatgctcttgtaggtgccgtagcccattctctccaaagaaaggaagcaggaagcgatccatacattttgtctggttggaagaagaaagaagcagcgaaattacggtgcctaaagaatgggggttgaagtgaggacatgacagagtgtgcggaaagcaggcttgacctaactaaagttacggcggagcactgggctgtagattttcaagtgggaataggaataagcgccttagagtgttaattttctgatgagtagggagacttactcactcttgaaaaagcttgaatcattcgagaatcctagtttatttttttatggaacacccgcttgctaactgacttttgtcaagcccgtctccacgagatctattttcatccgagggaggggcaacgtcccaaagctggacttcccgctggaagctccctattctgagtggttgataagcctgctcatacgagaagagccctagttttttcggaaccacacaattgagagtggcccgatgcaccggagccgtgtgaccagccacgaacaatcgatgcgtctgccaaactacttcaaaaaggaaaacacgagctaaaccagtaagtagttgctttgctttggactgtgatttcataagcgaattgctttaacactcctctttcaatcagcagaccaaaaaataaaactcgttattccacgcacgttattagtagttagtattagtaaaggaaagacaaaaaaataacaatcgagtagttcaaacgagtatagatttctacaggtagacatcaggttaggttagtagaacagatagacaacgaacaagtaagggggcaatgcttactcccacttaaacttctccaacaatgccgaggggttgataccttctaccctttcaattctattaccaatagacagcccttacgtttattttgcacggattggggaaacacctaccttaagctacacaatttcactctttagggtagggattctggagacgaagcataatctacagacgaagcagacaccacaaaaccatattcaggttcgaacccaactacggaaagtagaaatctccattcctacactaattcggctcttttcttgtctccggacctgtgaaaaaccacactcgtaccaacacccacggagaacgttgcacctcttaagatattacccaaaaccaggcatattctcatatgcttcacaacaactaacgtttataaccaacaacaactactaccaacgagaaacgttaccttacaacgtttataaactaggaatcaaaacacaattccataataatacaactacctatggcagcttcgttttgcacacagaggaggatgatcgttatttaagattatatgtgaattgctaatattaaataggattccattctcttaaagttctctttgtcttcgagcttttattcctcaatccacttattcgttcccttctttcatatacctccccaccaataaatagagacaaatgggaataaccgaaccacgtctacaaaatgccagtaccatgcagctgcttcaaagccaacgtgatgcttcttggtcagatgaccaagatattggcgaataccacatacgatcaagaaaagagtacctataatcacatgaaaaccatgaaagctagttgctaagaaaaaggtagaaccataaatactatccgaaatagtggagggtgcttggtaatattccattccttgaaagccagtggatactagagccagtaaaacggttgctactaaagtgtaaactgctcgtttttccttccccgcgagtatagcatgatgagcccaagttacggcagctccggatgaagggagaataggggtattaagaagagggatttcccaaggatctaaaaccccaatcccttttgggggccaaatacctccgatctctaccgtaggtgccaaagaagaatgagaagaagcccaaaaaaagcaaaaaggaacataacctccgagactatgaagagaatagaaccatatcgaggtcctaattgtacagcttttgtatgatgcccttccaacgtggattcacgtagaacatcccgccaccatacgaacatggtataaaggagaaatattaggcccaaactgagaagtgttgcacccccttgaaatgagtgcatgtacatcacacctcctacggtggttgccaaagctccgagtgaacccgaaataggccatggactttgatctaccaaatgataagaatgcctctgagattcaatcataaaccactttgccccggttgtatgtaaaccccccttcacccccatcccctaaagtggtaaagaaggaggctcttctttgtctcattaggacaaacaaataggaagggatagttctttcattgcattgatagaagtgatactatcaaaagatctctctattattttagagaagtgtcggcgttggttctaccaacgaaacgaagaagttttggattggtctttatcatgtcatgggataaccccccgaaagaagagtgcaaagaccaagttcccatttcctccgttcatccacgagaatcgatattcgttctttccactttgaatacgtcaattctcatccgttacttgagattcgatacgtaagatacgtcatttctcatctgtaacttccatccgataagggcaataaagccaaggcaagcccatatttgcgtatctaaaggcttggtgtggagttttggggaggtttcgggagatgaaaaaagcctacttttacagctaagtgattaggacttgaccgaaaaatattgctctcaaaacatgcatttatgaggtaaactagaaaaacactacttttgacccagtgatccgcacttttttcattggaaatcgagtttccttagggaaaaaggacttgctaacttttgcagctatatgaaacggacttgcctacttttgcaccgaagaaactcaaaaatagtctttctcaaaacaaaagcaaggtaggatttctacgaaacaagcccggataggtaaccaggcggataggaaggatttctacgagcttcagttcatgaattgaaatatgcatgcatcccattcataaggagtagctggctatccgtgtgcaacactcatttctttctaggaagataagatcccgctctaaggcattggagctgctggaatatgatacgaaaatacagattgatgtttctgcttctcctctctcgggaatagtttaccgaccgggccacctgtaaattctttagttaaaacaggcctcgggagtagtcatcctagtatcgaaaatcatctttttttctttccgcgttgattctccgattatacgatggcaacatgtgtgaagtctagtaccagatcatatcggggatagctagctcatcagcagttcatttctatgtatggcgagaagtccaactgtcaagcatggcacgattccagaatcatcgcttggctgctgcttagatgagatgaaacctgagctgacttctctgttggccaggcctgcttcttaagtgaactcatccattcccttgattgattagtacagaaggaggcgatatcgtgtcaattccctaaagaaaaccgtcttttccaatgatttagggcccataccccaataatgatgacgaagaggtcttcctgcttcacttcaaaaacagggcttcctgacccgagaaaagagtgcacatggaagtagttccgctcaattctccaatacgacttcgggtgtgaccccaaccccaccaaatggtgatcctcgagaccaaagggcattgaacgagagagaaggaaatcgtccacagagaatcggagtatccggcctagtgatagttagaaagagttggccaatacagaatctcatgcgcctctcattgatgaacccctttttcctttatcctctactggtggctgattgattgagcgccggtctcactcattcttgtggaatctctctagcttgtggaatcacttccctagatgcttagatagctcgagaaagtgcgccacttctccctgagaatctaatctatggtataaaaacagataaataggctcattaagtgaagtgagaacagaactcgatctttgctaggcgtgagaagaagatatcggtcctttggccatcgggagcagtggtaaagaaatcctttgaatggatcagtgagttccggcacaattgctggaacgagcggaatctacgggaacgagatctttctgttggcacgatatctttcaggaactgcgctaaggacgaatgcttgatttgcaatctttcaagacgattttcttgtagcagatgtggaatccagattggcataacgggttctacgtgaagtcagccgttcgtcatcatttgagggttcgggtcgggatcatggccataaatcgctactttttccactagagtgaataacattcttcgaaacaggcacgcacaggacttgaagcagaatcagagagtgatccctttccaacagactaatcgaattccagtgatacactacggctggcactattcgtcacattagtagttaagttactcatttgttacgaacaaagagacgctagagattctatgaacttcagatcgatgccattcactaatctcaattgtctttctatggatttctgggccgatgggcgataaaccttcaaagtcgctgctacgggctctgtggtgcgtctcagagcccttccccatggggggttcccgttctgctaatcttgctatcttccccaggtttgctcgtttcgattggaacaagaagtccgtattggtatttcttggtattggtagcagatgtgaatgaattgcaatttccgaggagtagtaaggacgagtagtagctgtggatgccagtgtggaagatcatattctcacaagtgaatacggacttccgttccggattgggagatctgccctggctaaagacatcgaactgtggatcagtcgtgaatcaaatcgaaatcagaaatagaggaatagagtcatcctcaccacaacaaagctatgggtcggcttcaagcgaataagtaggaaaccatgcaggtacgagaaaaaacccattacttgattcagacacttgaggaaggtgtcaacggacggcacagctcctcagaggcaacccatcaaatggatctttagcggctctagtctagccaagggaacgggtatcacgtatttccttgaaggcctataaccaagcggagatgcttctgccttttggggaggcatgtttgttgtacaagaggagaaggttcgtatctcctttccgaaaagatgcatctattttcctatctttggccaaggtaacccgtattggacaagcttgccttttgtgggagcatcatttcgaaaactagtctaatttatttctttttatttaggagatgcttttccgttacttgactttcactagtgtgatgccgatctcttactcgaatgcttctgccactttaggaagggatagaggaaacaaactgggaataggaattgatagcggtagctgtagataggagataggagtgcggaccaacacaaatactcgaataaactgagccctggcgataagaaagtatttcacaagttccgaagtgccgttcaattcaattcaaggaagacgcatccctgaaagaaggtcgtagggagagagggttctcgataccgggcatggaaaaggcagagaaggttctcgataccgggcatggaaaataagttcctttgggcttttgagtcggaggagactggccacctttcctacacaaatcttcagcgcaaatgcaaatatgacttgagattggaaatagcaattccaggcatccatgcttctttaggcccagaccctataaaccaactttaggaaatcttatgaaatacgccggtcttagtcttaagcagcctagcactatcgatcaaagcgacaaccctctaaataaacttccattttcttgaacacgggtaaatgccattctatctcaactatggcgcatttgaccgaggttttcgtctcaagtccactcctgaagccctgccgattgaagcagaaaggctcttcttattctttttagggtatggtatcagactcgaaaccttcaaagtcgctgctacgtgctctgtggtgtgtctcagagccctattccatgtgggggttggaagacatttatttgatcccagagggaggaataattagacctccctctgggttgaggatacgtagcagtggaagatgccggtacattatacgtctactcacttcctaagcaaaaatcacggcaaaactttctttcttttcgaaaactggattcgggtttccagaggtagggcaaaaatacggggtttcttccctcgatcaatcatccggcaccttgactcgtagtgccgcactggcactgatctagactagagttcgacacccgtgcttgtgagcgaggttttcacttctcactcgtattgattgatgccgtggacttgccagagaggaatataggaacgagtgtcagcgctattcaatactttttggtgtcgacggaactcaagcaaggagttcccatcaaaaaggtgagaacgaactcactcgatctttgctagaggtattggccaacggtgcggcttctgaaccagactagagaaatgcttgactgcccgatatgagatccgctatacttaagaactgtggcacttgttaggtctgggccaggtacgagcacttagaggtttgagcaagcattcatgcagaacgtaatctgaacgtaagttttcgattagtgaatgatgtgaaccggtggaatctcgtactagatagagactgccatccatccggactagagggctatctacatttctgtgctcgtatcacctttcaaagacaggtttcaatgggggtcaaatctttcttccctcggagctttgaagctgtttggttcgccattagagcagcacctttctccgctaaagcccatgcttggaataatagggttcagtgatccccggtctctggggagtcagtctcgtatccagtccagaacaactcgtttagtcagcaggcttatgcgctagtcgccatctctagatctggctaaagagttcgtttacccacactggcatcaacttaaactacttctctcttttatgtggattgctatcctgcgacgagctgtgcttactcccgcatacttgcgcctgtgcttgaaatcaaaaatatatggcctttccacaacggatcacattcctctagccatgactgagatctatcttctaccaggacacggatacgagtatagtgccaaagagtaatgccgcgaagaggtcaacctttgctttcgaaagccactgttttatgtttatgttcctgaggtccctcctctccaggggttcaacagaaggagtttaggccggtgtccgccctcaagagtgccaatcctgagatcttagagttgtagaccgagtcgagggctgcttctcaatcaagcgatcggcaacagccacaagaggagagtgcactattcattctaagtgtgggatgggatcagcttctaagcttttaaagcccccccatctgcccaaatcttattaatctcaagcggacctggtggttggaaatactattagaggcataacctacgtacgtgtatcattaggtgccgggtgggtaagttctttcagctgcaatatggggcttcttctttgttggaaaagctttgatagaaacggcaggcttctaccaatggaaaataggtcgagaccacgaacactagacactaggagattgctttcgccgttggcatatgcggaagtattcgttctttgaaatattcgatccacaagcaagctctagtcaagtgtattcgaagatacaaagcatagctaggaacaatgcaagattacacagactgtacccatgatagtagtggtggctaatggaaattgaatttccactttttcacataaatcactacaaggcctgaagaggaagtaaaagtccccaatgggtgagatgatgtgtggctcagcctctactcagattgaacgttctgaaaagagcagttcttgaggggatcttgtaccaatggtgaagattgaggcaatggaacgcctaaaccaaagaaagaaaataaagcaattaaggcatttgatactaatggatatagccctagccttcagaaaaggaaatccaatagtgcgcccgtgtccaattcgaagtaagaccccattcccattccagttacttcataatgtgccatacctgattatggccacgattccaattttacataaaaccaaaccaaggtctggcgaatcctcttcccaactggcctggaatgagatccagaaaaggacctggcaagagatacgtctgtcttgttgtgatgcgaggaataggcgaatctgtcgtgatagaaaacaaccctttgttgctatgctaatggatctgctcagggaactggctagggttcagttgaagacaggaatggaaatgtttcccaactagagctacggcacttttccaataaacggaagctcaagccaagcctaaagcgaagcatccgcctcctctttactagcgagtctagtttcctacagggcaagggcgtagactggttttgagtcctataggaggatcaaagtattagagctcaagtagttctcttacgacctagtcaatacgcattggaatcatggcatcccctccaccatagtaaagtaagaagtaacgggtctacgcccagcttccttgttccggaaatgaaggatccatgcagaagtggactctctttccgttctgttcaaagagttggcctggtattctagttactctagacctattcccttcgaaatagaaactcttgctagagctgagtagaaatcatcattaccgccgcatttactatactagactagcgcctaagatagctataaacatggtatgtcttagagcgatatgagtattctttaccagcaccacccagggatccaaccacaatcagaaatggatacgttctagtttccatccttgactttactagtcctataaccggcatccaagcaaatagacttgtctttctctttctctttttccctagtccctagtaataggagatccttcctgttctggatatgtcctctattccatccggtttggacacaaattgtcaacggtgaggtggcatgaccttgatcaatagatcccttactctggtccctagttccttacctatttgatagggaagcgtttcgatatcacctaccatgaactcagatggtgtttgctgacgaaagaaaaaggctggttttggcccatagtgagcagcactggcactcaaaagggatccttccgcctgacggtacttaaagatatgatgaccttctattttttcctttacataaagttcctttatcaaatcctgtatggagtctggtacagccgaaacatccccctaaaaagggacagaccatcccaaatatggtaattaatccatagttttctagcggtaccgcctaatctaacaatagtaaagatatttccataaatgaagcttatgctgtcaggggtttgggacatgattatatgtaacacacaatcagaggcatcatagccaatgattcctgcgctgtgggcttcgaggttggctaattcactcatgaaaccattaattaatgattccgccgcatggtttagggctttccacatagttccgtgtgaacttattacctcattactcatgggagtaacccccaaatgtctatttataaattccatcattagggaatgattttccctaatagcagggctgacctcatccttaggaatgcccccatccaaacaaccagttcgttgattcaaccaaaatgatttactcgagattaactcaatttcgttacgacttactaatgttttatataccccttccttaggtaaaatattccttataacttgtgtagtaggaacaggttcaatgctaccaatgcctaaatcttgcttcaaaagtggtgaaaccgccaatcgaaatggatcttgttccaaatgtgttttcatttgattgagggtctcattcaacccattcaattggtccgcattattgtggatccgtcttttaatattactcaataggagagtagcctgagataagtccaagttgataatcatgattgaattttctattttccaagaggcgaatgtcgagatttcatttaatagtagttgcctttacccgtgtggtatgagccaccctctatgcaattgcgaagaggcagacaacgttgatcaaattaatgatcattctatgcagtttaatgtatcaaatattatttgcattatatgtctctccgcttatagggaaaaacaaaataaagttgtaccttgccttgcgaaagcttgatccgctgatgaagggaacactgcaggatgcgtcgctggctatagcgggtaaagcaatccgttcttgttctagcgtatgctatttacattatattagtagtttcgctctcccggaacttgctatgaggagaagactcggcaagagaggtttgaacaagaggaattgccgtctagttgagtttgatcattctctctttctatctctctttctttcaagagctgaataagggcatatccgcaaaggaggcgggaaaggtctaaaaacccaataggtatgaactggtctagccagggcaagtagaggtttgaaagcaagcttgggatgcaatgcatatttaggagaaagagcaccggtttaggtttagaaagataggcaagtatgtatgaacgggatggatgttcagggtagtaaagagagccaagcgcgggatacgtaataggcatatgcatgggtttagaaagagataggccagtagtagtaataagtctaggttttgtagataaagtagcctgagggagttacaaattagcatttggccagtataataggcgcttgtgcaaggaagggctagttcatagcttgtcacggcacaggtctagccagatagaaagactgaatcaaattgctaatagactcagttaaggcaactgctgatatgcgacttttcagaatcgaactgaaattggtcctcgtcagaccgtaccttcctgaggaagtcgctttgggcagttcagttggcgagaaaagccttcctatctctgcaagtccatcgggccgactacaacccgcggctcaaccccggaactaatgagatcaattagtctctccctcactttttggcaccaagaacctgttagcccggccaaggtgcgtagaggtgtgtcccggttcaacggtaggcttggtgacccaatgaattgcctctatcccgctgtgaattgaggagcgtagggccaaggcgagctttatcgtcaaaagtgatttcttgtttgcgattctgattccgctttcacacttctaaaggaagggccggggaggtctttgcttgctttgattcctgttagagatcagtctttttgtaaaaaaagttctgcagatgtttgactgacggaataagggaagacgtctttcatcaactctttggcaatttgcttgccataaagaaagagtgagatcttctttgagatgaaatggagataaaatgcggcaatgtcctaatcaaaccaggcgcaaggtcaatatttagctcaaggctaaaggcataaaggcgattattcctttttcctatactgccaagctttcctttcttatagtcgtaggcagaagaacagaaaggtcaaactgggttagaatgacatacacgataaaaaagtcaatataaaattgtacacaactcacaagcgcacatctagccgtaaatcacggggagtatcttcatatactctattaccccccaggtggaaacaacagtaacaatgagatcgagagagaggtgccggtagccctttggtgaagatatcagcaagttgagcattagagcaaacaaaggtcactttgagtcgaaattcgctcttagctttgttctttttgtgtagctctgagctgggtgactgtggtgtcgacgaatcagacatctccaaccttcactcttgaatgcataacccggttttctctacttcccaagagtggaattttagtttcaggcttctttcaatagagtaaagtccctggataggtaaagtatgtttgttttgcggtctatgactgcttgctgtgttccatatcttttgtcagttgctatcaaaagcgcgatctattcattgtgtaggatagttggctctagcctaatcttgaaaggtatgaagtaagtatctactgggttcgtgaaaatgtttgatcaaatcacgatcttataagaaactctgaccgatattgctttggttctccggttatcaattccttgtgatggaattcttccctgtaccctttttttctattcccttttatttatcgaaaagataaataaactcccccacccagctcctctaactactaagttcctctaggaggttaggttaaactaaatgaaattggaaatcgaaatcctcgctatggagaatccgagagttcatactcaatccatgattatcgagtaccaagctctcctgcctcgggaaatggagaagcagtcaataatctatctaatgaattagcctggcgagaccctcttccactttcatcgctctcatccctagctgtagaagcagtcaggccaaacttcattttaagctcaaccactaaatcgaaataatctatcctttttcttcctgccagaagtacgagcttcgtccctagcttgaattgttcatccttacacgacacggcaggagaagctgtcaagacgactttgagaatctatttctccaacccttctctgatctattatctcttgataagacatagatttctcaaccattgccttacgtaccagggaaggactgctttctcaatattgatacttgcccgctttgactctttctttcattatctcttattctacatcctatccaccatagaatactctcttccagtcctttgatcatatagccatccatctttcatcaatgaaattgttccgtatgggtagcaaataaacatatcagaagagccaacccgaaagcacttgcttcaaagaagaagctgttaccaagaaattcctgtttcaagtctgtatatctcgatagaaccaattccaatccaggtagtgtgaacagaggatgtggaagttctgtttccttgccaaatcaaaagataatatagtttccgaccttgccttaatatctctttctctctttagaccttacctttctctctttcaggattgattcgaggaagtaaaagcagctctcgggtgcgcacccctactttgaaagaaatgtccctctttcctttgacatattgtcagtgttagtgcgagtagctagcatttgccattgtttccttcctaagcgatgtagtgattttgcttgctgctgcttgctcccgcttttccactcattagaattcctataatggacatatcttttgcctactcactcgggcgggcctcaaagccagtttgaataatatatatataagaatatagaagatattggagtttttcatttgctgcgagcggatatttgtatttgagctagtcgtgcagcttcactcacataatttacggaaaaaaagtatgcaacctcctttttagcgagtcaattttgtaagtataggtcaacctctttccttcatcttgatcgtctataagtcgcaaataccagagtttcactgactagatagaaatgcttcagaagaagaagaaaatagttggtagctcaccccggcggctgactttccaaagaaaatagcctgccaaagagctagctatagaaatacagtcagtcgggataaactgaaagaaggaaatctacattcatagatagtagggcaataggctcacttacatagtggggacagcaataggctcacttacttttgaaataagagggtcggtcaactctcggcagatagggtagttgctaaataaaagcaaagacagagtgagttgaaagaagaaatgtatgtgggtcaccatataatatatataatagtacctaacttactaggtatctcggtcaactgctagcttttcatccttggtgcagtatttccaccttctattgctttgcttgcctagctcttattaccgttatttccatctgagaactagacgcccggttcaacttagccaagttaagggaacgcactactcttccctacaagcaacggattgagcgctagcgcgaaagccggtgcgcgttaggcgcatccgttttcttgcttagtagttactcattgggattcccgcagtgcagccgttgcttgttgggctacaaaacacttcttagacggaagagcggcaagcaagcctactcaagtacctagcactccacaacccattagttggaaggcaatcagcaacttagcacactagagcatacaacgacctttagcaaccttttctcgagcgatagtctagtaggtcaagcccgagtggaggccatccatccctttctgatgaaacctttgttgccctagcttgaattaaaggtttggctaaggatggggatccggtgtcttcatctataccatcagagaagaaggcttgccaagaatggatgaaggtatgattctaggaaatctagatttgaaagaaggaagcacccgaggagcaatcaaacggacatttctacgagtgaactcgctaaagctgaggatccgccagccaataactaactcatacgaaattcatggagcatagtagcgttttcccctgtgcatcactagcatcaactatcaactctttatctatgtaaattcttgattgaaatccttcactgttgtcctcgaaagactctcttcctctcaaccagttcacttctcctttccagctactgactgggcttagcaactagttatgtccctatctgcctcccctgcctccttcctcttctctactttaaatgttcaactaaatgcaagtgaaacgagacgagaatcttcgattgggaagtgcacttaacccacccacctaaaccggatcaggaaaagtgtttagtacgtgccaatcggaaacgtcctgtcctcagttcctcgatgcattcacgagggaaattcgtttgaagtcggtgattaggcagacgccccattgttcgtggtgttgcaatgaatccagtggatcagcctcatggctcggtgaggggctttatgctgataaataggattcttgttataatttctgtgggctctaagctcctccctgactaaagaaatctaaagtcagaagcttccattctaaaaactcataaagattttctgacttctttacacgggatgtagagcttttgcctcaatcctttcttttccttagctattctttattagcatgaatctccatctattcttttggggaaattgaaaaatcattaaaagtaaatggacccaggaggagtgaattacagctttcactcaatgcacttgagaataacatctaaaaaagtaactatacttgtaacccttggtgtcttatatatagttagcatattgtttgtaggcatccataagtgattaacgatgatcctactttgataccactccaagattttacgggtactttgaatataggtggtaattgaactggacatgtcctgggggaggtagtaatggaggggtctctggaaaaagaacatggtttggtttataggtggaggcttactgaaatagaccctgttgtttctgatgtaggagttggggatggaatgattgattcaagctctggtggtactaatcatgtctctgggagtaaaccaactggagcggcaaggaaacatgcagtactggagaggggatctcatagcaatactgattcaagtaatttcagagttactagagatgcaattggtttcgaaatatgtattaaaaaatggtaaactaatactgactattctctgtggatatctggttggacaccaagcatttttacccccatttgaatgcagagtcagagtatagacagctcaacaatgttgtcatatatttttataccaaattagagtgcacagtcatttttctatttatgttcccagaaattcagttcactagggaacaccttacaggttggtcatgggtcaggattggatagcaagagttgtcggtagccggcattaggtaaaaggaaaagctctataaaagcgaagaaatgaaatcgaaggatactagcacttctttctatacttgtaggctttctttcttatattcaacttcatgaattcgctatgctaggttcattccatccatctatcaggtttgagtaggtaggctctttccttaagaaaatgcacgtaaataagtgaatccgaaaagacnnattcaacttcatgaattcgctatgctaggttcattccatccatctatcaggtttgagtaggtaggctctttccttaagaaaatgcacgtaaataagtgaatccgaaaagaccaagacttgaatgaagcccatttcccaggctagttgttgcccatgtcgaatagccaaaagtgaagtgcataaagtgctattgtagccaatctttttctataaatggcaccacccgtctcgctaacttcacgtagaagcttcctttcccgggttatagagcaaatccttgttctaaagcttaatctacccctatgctatgaatgaacagatccacgagctgagaatcccatattctttaagccaatccgccatatcagcccttgttgaacaacttaataatccggagagaagatgcttctcggaagacgatggaaatgaggaacgaagttatccttcccctttttttaaggcacgggctcaggttacgtacggattttatgcaacaaatacgatacatacggtgtagaatactttattgctactggcttttgcctttcacggatctcgctgcgcgcctcaatcgtatcttctcttgcgcggagctagaagatcatcgactctttctttcgctatgaatacagggccgggtctacgtaccataccaatgaaacacacaccaattctacgcctatctgagtttatgcttaacgaaagagcaagcacttggaaaggagagaaaaggtcgtccctttactctattcctgacgttaggacggatacttaactagtgggaggccttacgag

SEQ ID NO: 5 - DNA, 14762 bp, Zea mays
gttatcacggtaatgattaacagcccatgacaggcagacgatgatgcagataaccagagcggagataatcgcggtgactctgctcatacatcaatctctctgaccgttccgcccgcttctttgaattttgcaatcaggctgtcagccttatgctcgaactgaccataaccagcgcccggcagtgaagcccagatattgctgcaacggtcgattgcctgacggatatcaccacgatcaatcataggtaaagcgccacgctccttaatctgctgcaatgccacagcgtcctgacttttcggagagaagtctttcaggccaagctgcttgcggtaggcatcccaccaacgggaaagaagctggtagcgtccggcgcctgttgatttgagttttgggtttagcgtgacaagtttgcgagggtgatcggagtaatcagtaaatagctctccgcctacaatgacgtcataaccatgatttctggttttctgacgtccgttatcagttccctccgaccacgccagcatatcgaggaacgccttacgttgattattgatttctaccatcttctactccggcttttttagcagcgaagcgtttgataagctaaccaatcgagtcagtaccgatgtagccgataaacacgctcgttatataagcgagattgctacttagtccggcgaagtcgagaaggtcacgaatgaactaggcgataatggcgcacatcgttgcgtcgattactgtttttgtaaacgcaccgccattatatctgccgcgaaggtacgccattgcaaacgcaaggattgccccgatgccttgttcctttgccgcgagaatggcggccaacaggtcatgtttttctggcatcttcatgtcttacccccaataaggggatttgctctatttaattaggaataaggtcgattactgatagaacaaatccaggctactgtgtttagtaatcagatttgttcgtgaccgatatgcacgggcaaaacggcaggaggttgttagcgcgacctcctgccacccgctttcacgaaggtcatgtgtaaaaggccgcagcgtaactattactaatgaattcaggacagacagtggctacggctcagtttgggttgtgctgttgctgggcggcgatgacgcctgtacgcatttggtgatccggttctgcttccggtattcgcttaattcagcacaacggaaagagcactggctaaccaggctcgccgactcttcacgattatcgactcaatgctcttacctgttgtgcagatataaaaaatcccgaaaccgttatgcaggctctaactattacctgcgaactgtttcgggattgcattttgcagacctctctgcctgcgatggttggagttccagacgatacgtcgaagtgaccaactaggcggaatcggtagtaagcgccgcctcttttcatctcactaccacaacgagcgaattaacccatcgttgagtcaaatttacccaattttattcaataagtcaatatcatgccgttaatatgttgccatccgtggcaatcatgctgctaacgtgtgaccgcattcaaaatgttgtctgcgattgactcttctttgtggcattgcaccaccagagcgtcatacagcggcttaacagtgcgtgaccaggtgggttgggtaaggtttgggattagcatcgtcacagcgcgatatgctgcgcttgctggcatccttgaatagccgacgcctttgcatcttccgcactctttctcgacaactctcccccacagctctgttttggcaatatcaaccgcacggcctgtaccatggcaatctctgcatcttgcccccggcgtcgcggcactacggcaataatccgcataagcgaatgttgcgagcacttgcagtacctttgccttagtatttccttcaagctttgccacaccacggtatttccccgataccttgtgtgcaaattgcatcagatagttgatagccttttgtttgtcgttctggctgagttcgtgcttaccgcagaatgcagccataccgaatccggcttgtgattgcgccatccccatagcagccatcacatcagtaccggaaagagagtcagaagccgtggcccgtggtgagtcgctcatcatcgggctttttggcgaatgaaatttagctacgctttcgagtctcatgcgccttctccctgtacctgaatcaatgttaggtttccgcagaacactgcgccggtatcgatatacatttggttggcaaacttgagtggtttcactgctggcgtatgaccaaagatgaacgtgtccgcgcctttgatttctttcacgatcccgttttgtgagttgctgattcgttcgcggttccagattacctgctgatgatcaactggctttccaaactcgtattcgtcaaagggataatcggcgtggcagataacatattttttatctttgctcaccagttcgatgattaacggaagttcatctgctttatgggcaagagctttagccagaatttctttgtcgtaatcgagattaaagaaccagccaccgccattaagcagccagtgattaacgtttccacgctctgataagccatcaatcatcatttgctcatggtttccacgtacagctctgaaccaggggaatgtgattaattccaggcattcaacgttctctgcaccacgatcaaccaaatcgcccaccgagataagcaggtcttttttgttgtcgaatccaatcgtatccagtttgttcatcaggttcgtgtagcatccgtgcagatcgccaactacccaaatatttcggtatttgctgccatcaattttttcgtaatagcgcatctctttcactccatccgcgatgaaccatgagaacgtcgttgacgatggcgtgcattttcccgtctttatcatcaacgtattttctgaccgtaccgcgactacatttcagtctgcgtgctacttctgtctgatttccgtatgcttcaacgagcatgtctggaatggtttttactgagaacgtcatgcggcctcacttctgctatttcgcaggtctttgagtttctgttggtactctgccttgatcgccttgcactcttcgatagtccagcgatggcggttatggtttgattcgatttcgtctactgcttcctgcccgatgcggctaatcagttcgacgcgatacggaacgagatttccgcttttgtgctggttgcacaccacgcattgcttgtgaatattgcgttcattaaatcggagttgaggtgccgcagcagttgtccggtaatgtccggcatcccactgagcagacgtgagcgttccgcacgagatacatggtaagtcgcggtctctttctctgatgaaggcgtttacggcttgttgggcttgtttaatccagtaactgcggggctttaaggcgagttttcgaatcttaagtttatctttctgtttctgctcctctcgtcgtcgtttcttctctgctgctttttccgctttttcgcgttctttacttcgtcgttcgagtgctatcttggttccacactctggagagcaccaccactgattagcgaatgcagggtgaaaccattcccggcattcatcgtttttacatcgtcttcgcgctggtttagccatcatcttcttcctcgtgcatcgagctattcggatcgctcatcagttctgcgcagcagtgctcacacacgtgaacttccagcacatgcagcttctgaccgcagttagcgcacgttaaagctcgctcgacgctttcttgttcgtaacttcgattttggtcaatcaccttgttttcctcgcacgacgtcttagccaccggatatcccacaggtgagccgtgtagttgaaggtttttacgtcagattcttttgggattggcttgggtttatttctggtgcgtttcgttggaaggtatttgcagttttcgcagattatgtcggtgatacttcgtcgctgtctcgccacacgtcctccttttcctgcggtagtggtaacacccctgttggtgttctttcacaccggagacaccatcgattccagtaaggttgatttggtcggaagcggttatcttctttgcattcaccgcaccgataacatcgcatcatgcagcttccctcccgaagtcgaaatcaagctgccctccaaatatttcgcatgactcagaacaagagccggtatcgaatcttttagctcgtaccatgtcctgatacagggcttgataatcattttctgaatacattttcgcgataccgtccagcgacattcttcctcggtacataatctcctttggcgtttcccgatgtccgtcacgcacatgggatcccgtgatgacctcattaaaaacacgctgcaatccctcctcatctttgcaggcaagtccgattttttgcgttgattttttaatgcagaatatgcagttaccgagatgttccggtatttgcaaatcgaatggttgttgcttccaccatgcgaggatatcttccttctcaaagtctgacagttcagcaagatatctgattccaggctttggctttagccgcttcggttcatcagctctgatgccaatccacgtggtgtaattccctcgcccgaaatggtcatcacagtatttggtgaagggaacgagttttaatctgtcagtgcagaacgcgccgccgacgtatggagtgccatatttctttaccatatcgataaatggcttcagaacaggcattcgcgtctgaatatcctttggttcccataccgtataaccatttggctgtccaagctccgggttgatatcaacctgcaatacggtgagcggtatatcccagaacttcacaacttccctgacaaaccgatatgtcattggatgttcacaacctgtatccatgaaaacgtaatgcacgtctttacctgcccgtcgcttttgctccattagccagagcaaatatgctgacgtcctgccaccggagaaactaacgacatttatcatgcagccctgtctccccatctcgctttccactccagagccagtctcgcttcgtctgaccacttaacgccacgctctgtaccgaatgcctgtataagctctaatagctccgcaaattcgcctacacgcatcctgctggttgactggcctattaccacaaagccattcccggcaaggttaggaacaacatcctgctgctttaatgctgcggtaaacacacacttccagctttctgcatccagccagcgaccatgccattcaacctgacgagagacgtcacctaagcaggcccatagcttcctgttttggtctaagctgcggttgcgttcctgaatggttactacgattggtttggttgggtctggaaggatttgctgtactgcgtgaatagcgttttgctgatgtgctggagatcgaatttcaaaggttagttttttcatgacttccctctcccccaaataaaaaggcctgcgattaccagcaggcctgttattagctcagtaatgtagatggtcatcttttaactccaaccatatcaaccagctcgctgacgtttggcagtccggcggtaacggatgcttcttcccggcaccatgcaacaaactgcccgggtgatggcagaaatggtcgattctgccgacgggctacgcgcattcctgcgttaacctgttccatcgtggtgatcccgttttcccgaaaagccagaacccactggcgacggatttcgttcacttcgttctggtcacggttagccaggctcgccgggaaagttgccagtaactggctgaacacaccgttgatgatctgcgctacctgctgtacctgcggcttttcgtcgtactgttccggcatgttgttggcgatccgacgcatctgctcacggtcaaagttaaccatctgtgcggcgatgtttttcatagatccaccccgtaaatccagtctgtgtttgtcaggtcgagttttggtttgctggctgtcacgcctgcctgttgcttgttacggttgatttcgagttgggtccacttatcgcggagtttggccgggctcagcacgttaccggaccagaagttgtcctggcatgcccagcggaacagcacacacatgtcgcggtggttacgtccgtcacgttcacgcatcaggcggatatcgttagcccacccagcaaaattcggttttctggctgatggtgcgatagtcttcaccatgtcaaacatccactctgcggcggtcaggtcttctgctgtcccccacttgctgccgctctgaattgcagcatccggtttcaccacagaaaggtcgttttctggctggtcagaggattcgccagaattctctgacgaataatcttttcttttttcttttgtaatagtgtcttttgtgtccccctgttttgagggatagcaatcccccaatttgagggatgttttatccctcgttttaggggattttccctcgttttgagggatgcaccattctgagatgtttttatttggtccaaacatgccgccttgctgcttgataatattcattctgacgagttctaacttggcttcattgcaccgtttgacaggtaactttgtaatctcgctaagttgagaatcggtgattctgtccattggtttattccacccataggttttacgcagaatggcaagcagcactttaaactgtcgcttggtcagatctgcgcccgaataagcctcaagcagcatatttgatagtctggcgtaaccatcatcgagatctgccacattacgctcctgtccggcaaagttacctctgccgaagttgagtatttttgctgtatttgtcataatgactcctgttgatagatccagtaatgacctcagaactccatctggatttgttcagaacgctcggttgccgccgggcgttttttattggtgagaatcgcagcaacttgtcgcgccaatcgagccatgtcgtcgtcaacgaccccccattcaagaacagcaagcagcattgagaactttggaatccagtccctcttccacctgctgatctgcgacttatcaacgcccacagcttccgctgtcttctcagttccaagcattgcgattttgttaagcaacgcactctcgattcgtagagcctcgttgcgtttgtttgcacgaaccatatgtaagtatttccttagataacaattgattgaatgtatgcaaataaatgcatacaccataggtgtggtttaatttgatgccctttttcagggctggaatgtgtaagagcgggaatgtcttaagcggctttaccgcgtttagttccgtactgtaaccaaaccggatcacagttaagcgccatagcaatctcaaacaagaagcgcggtcgcttggttactccagcttcaatcagttgaattgattgctgtttaacaccggctttggttgccagttcggtttgcgtcatttttaacgcaattcgcctcttcttgaggcgttcagaaagagtttgcatatcgcctccatcaacaaactttcttgtattttcatacaatgtatcttgtttgtcaaatacagtttttcttgtgaagattgggggtaaataacagaggtggcttatgagtatttcttccagggtaaaaagcaaaagaattcagcttggacttaaccaggctgaacttgctcaaaaggtggggactacccagcagtctatagagcagctcgaaaacggtaaaactaagcgaccacgctttttaccagaacttgcgtcagctcttggcgtaagtgttgactggctgctcaatggcacctctgattcgaatgttagatttgttgggcacgttgagcccaaagggaaatatccattgattagcatggttagagctggttcgtggtgtgaagcttgtgaaccctacgatatcaaggacattgatgaatggtatgacagtgacgttaacttattaggcaatggattctggctgaaggttgaaggtgattccatgacctcacctgtaggtcaaagcatccctgaaggtcatatggtgtcagtagatactggacgcgagccagtgaatggaagccttgttgtagccaaactgactgacgcgaacgaagcaacattcaagaaactggtcatagatggcggtcagaagtacctgaaaggcctgaatccttcatggcctatgactcctatcaacgggaactgcaagattatcggtgttgtcgtggaagcgagggtaaaattcgtatgatcaggattgcggcgctactctcaatactcttaactaccagcgccaattctgaatgctggattgtcacaaacctgcacgggtacggggcaatgaatggcgatcgttacgagtttacaaaagacagcacggaagattccgttttcaacgtaacaataaatggcgataaatcatcagtttatgaatcagtttctggcgtctatccagagatgaaatacactgctttgtcatcgaacactatggtaggagaataccagtctggaggaggcataaccgttgaaacttggtcaatcactacagacaaaaaagctctttactccaaagtaatgaacatcccaggtatgcaacaacttacatcaaccaaatcctttgttggtgatgtagtcggaacctgcaatcagtaatccccacctcaatctcgataacaaaaaaacaaactattttccgtttaaaaacaatggagtttgtttttcacgcccctttttacaatatttattgtttacaacatacaatcttccttgtaattttaagccatcagcaggacgcactgaccaccattgaaggtgaggctcttaaaaattaagccctgaagaagggcagcattcaaagcagaaggctttggtgtgtgtgatacgaaacgaagcattggccggaagtgcgaatccggattagctgccaatgtgccaatcgcggggggttttcgttcaggactacaactgccacacaccaccaaagctaactgacaggagaatccagatggatgcacaaacacgccgccgcgaacgtcgcgcagagaaacaggctcaatggaaagcagcaaatcccctgttggttggggtaagcgcaaaaccagttaaccgccctattctctcgctgaatcgcaaaccgaaatcacgagtagaaagcgcactaaatccgatagaccttacagtgctggctgaataccacaaacagattgaaagcaacctgcaacgtattgagcgcaagaatcagcgcacatggtacagcaagcctggcgaacgcggcataacatgcagtggacgccagaaaattaagggaaaatcgattcctcttatctagttacttagatattggccttggctttatctcaatattatatggatcatagctggcaactaattcagtccagtaaatatcctcaatagggaataatatatgctttccattccatcgggaaaaagttttgttcaacacaccaagctcaatcaactcactaatgtatgggaattgttttgatgtaaccacatacttcctgccttcattaagggctgcgcacaaaaccatagattgctcttctgtaaggttttgaattactgatcgcactttatcgttttgcatcttaatgcgttttcttagcttaaatcgcttatatctggcgctggcaatagctgataatcgatgcacattaattgctagcgaaaatgcaagagcaaagacgaaaacatgccacacatgaggaataccgattctctcattaacatattcaggccagttatctgggcttaaaagcagaagtccaacccagataacgatcatatacatggttctctccagaggttcattactgaacactcgtccgagaataacgagtggatccatttctatactcatcaaactgtaggggttgtaatagtttatccgatttctcgctgtaggggtacacgagaaccaccgagcctgatgtggttaaaagacaggcacaatctttactaccgcaatccactatttaaggtgatatatggaagaagaatttgaagagttcgaagagcatcctcaggatgtgatggaacaataccaggactatccgtatgactacgactattgataaaaatcaatggtgtggacaattcaagcgatgcaatggatgcaagctgcaatcggaatgcatggttaagcctgaagaaatgtttcctgtaatggaagatgggaaatatgtcgataaatgggcaatacgaacgacggcaatgattgccagagaacttggtaaacagaacaacaaagctgcctgatagtggcctttatttttggcataaataacagaataaacactgcactgtgtattcattccaacgagtgaatacacggagcaatgtcgctcgtaactaaacaggagccgacttgttctgattattggaaatcttctttgccctccagtgtgagggcgattttttatctgtgaggatatgaacagatgtcaaacatcaaaaaatacatcattgattacgactggaaagcatcaatagaaattgaaatcgaccatgacgtaatgacagaggaaaaacttcaccagattaataatttctggtcagactctgaataccgactcaataaacacggctctgtattaaatgctgtattaatcatgctggcgcaacatgctctgcttatagcaatttcaagcgacttaaatgcatatggtgttgtgtgtgagttcgactggaatgatggaaatggtcaggaaggatggcctccaatggatggtagcgaaggaataagaattaccgatatcgatacatcaggaatatttgattcagatgatatgactatcaaggccgcctgagtgcggttttaccgcataccaataacgcttcactcgaggcgtttttcgttatgtataaataaggagcacaccatgcaatatgccattgcagggtggcctgttgctggctgcccttccgaatctttacttgaacgaatcacccgtaaattacgtgacggatggaaacgccttatcgacatacttaatcagccaggagtcccaaagaatggatcaaacacttatggctatccagactaaattcactatcgccacttttattggcgatgaaaagatgtttcgtgaagccgtcgacgcttataaaaaatggatattaatactgaaactgagatcaagcaaaagcattcactaaccccctttcctgttttcctaatcagcccggcatttcgcgggcgatattttcacagctatttcaggagttcagccatgaacgcttattacattcaggatcgtcttgaggctcagagctgggcgcgtcactaccagcagctcgcccgtgaagagaaagaggcagaactggcagacgacatggaaaaaggcctgccccagcacctgtttgaatcgctatgcatcgatcatttgcaacgccacggggccagcaaaaaatccattacccgtgcgtttgatgacgatgttgagtttcaggagcgcatggcagaacacatccggtacatggttgaaaccattgctcaccaccaggttgatattgattcagaggtataaaacgaatgagtactgcactcgcaacgctggctgggaagctggctgaacgtgtcggcatggattctgtcgacccacaggaactgatcaccactcttcgccagacggcatttaaaggtgatgccagcgatgcgcagttcatcgcattactgatcgttgccaaccagtacggccttaatccgtggacgaaagaaatttacgcctttcctgataagcagaatggcatcgttccggtggtgggcgttgatggctggtcccgcatcatcaatgaaaaccagcagtttgatggcatggactttgagcaggacaatgaatcctgtacatgccggatttaccgcaaggaccgtaatcatccgatctgcgttaccgaatggatggatgaatgccgccgcgaaccattcaaaactcgcgaaggcagagaaatcacggggccgtgacagtcgcatcccaaacggatgttacgtcataaagccatgattcagtgtgcccgtctggccttcggatttgctggtatctatgacaaggatgaagccgagcgcattgtcgaaaatactgcatacactgcagaacgtcagccggaacgcgacatcactccggttaacgatgaaaccatgcaggagattaacactctgctgatcgccctggataaaacatgggatgacgacttattgccgctctgttcccagatatttcgccgcgacattcgtgcatcgtcagaactgacacaggccgaagcagtaaaagctcttggattcctgaaacagaaagccgcagagcggcgcaatcactttcgtctctactccgttacaaagcgaggctgggtatttcccggcctttctgttatccgaaatccactgaaagcacagcggctggctgaggagataaataataaacgaggggctgtatgcacaaagcatcttctgttgagttaagaacgagtatcgagatggcacatagccttgctcaaattggaatcaggtttgtgccaataccagtagaaacagacgaagaagctagctttgcactggattgcgaggctttgtgcttctctggagtgcgacaggtttgatgacaaaaaattagcgcaagaagacaaaaatcaccttgcgctaatgctctgttacaggtcactaataccatctaagtagttgattcatagtgactgcatatgttgtgttttacagtattatgtagtctgttttttatgcaaaatctaatttaatatattgatatttatatcattttacgtttctcgttcagcttttttatactaagttggcattataaaaaagcattgcttatcaatttgttgcaacgaacaggtcactatcagtcaaaataaaatcattatttgatttcaattttgtcccactccctgcctctgtcatcacgatactgtgatgccatggtgtccgacttatgcccgagaagatgttgagcaaacttatcgcttatctgcttctcatagagtcttgcagacaaactgcgcaactcgtgaaaggtaggcggatccccttcgaaggaaagacctgatgcttttcgtgcgcgcataaaataccttgatactgtgccggatgaaagcggttcgcgacgagtagatgcaattatggtttctccgccaagaatctctttgcatttatcaagtgtttccttcattgatattccgagagcatcaatatgcaatgctgttgggatggcaatttttacgcctgttttgctttgctcgacataaagatatccatctacgatatcagaccacttcatttcgcataaatcaccaactcgttgcccggtaacaacagccagttccattgcaagtctgagccaacatggtgatgattctgctgcttgataaattttcaggtattcgtcagccgtaagtcttgatctccttacctctgattttgctgcgcgagtggcagcgacatggtttgttgttatatggccttcagctattgcctctcggaatgcatcgctcagtgttgatctgattaacttggctgacgccgccttgccctcgtctatgtatccattgagcattgccgcaatttcttttgtggtgatgtcttcaagtggagcatcaggcagacccctccttattgctttaattttgctcatgtaatttatgagtgtcttctgcttgattcctctgctggccaggattttttcgtagcgatcaagccatgaatgtaacgtaacggaattatcactgttgattctcgctgtcagaggcttgtgtttgtgtcctgaaaataactcaatgttggcctgtatagcttcagtgattgcgattcgcctgtctctgcctaatccaaactctttacccgtccttgggtccctgtagcagtaatatccattgtttcttatataaaggttagggggtaaatcccggcgctcatgacttcgccttcttcccatttctgatcctcttcaaaaggccacctgttactggtcgatttaagtcaacctttaccgctgattcgtggaacagatactctcttccatccttaaccggaggtgggaatatcctgcattcccgaacccatcgacgaactgtttcaaggcttcttggacgtcgctggcgtgcgttccactcctgaagtgtcaagtacatcgcaaagtctccgcaattacacgcaagaaaaaaccgccatcaggcggcttggtgttctttcagttcttcaattcgaatattggttacgtctgcatgtgctatctgcgcccatatcatccagtggtcgtagcagtcgttgatgttctccgcttcgataactctgttgaatggctctccattccattctcctgtgactcggaagtgcatttatcatctccataaaacaaaacccgccgtagcgagttcagataaaataaatccccgcgagtgcgaggattgttatgtaatattgggtttaatcatctatatgttttgtacagagagggcaagtatcgtttccaccgtactcgtgataataattttgcacggtatcagtcatttctcgcacattgcagaatggggatttgtcttcattagacttataaaccttcatggaatatttgtatgccgactctatatctataccttcatctacataaacaccttcgtgatgtctgcatggagacaagacaccggatctgcacaacattgataacgcccaatctttttgctcagactctaactcattgatactcatttataaactccttgcaatgtatgtcgtttcagctaaacggtatcagcaatgtttatgtaaagaaacagtaagataatactcaacccgatgtttgag

SEQ ID NO: 6 - DNA, 16005 bp, Zea mays
cttacgagttcttttgaaacagttcggtaagcgggcttgctgatctacccatacccaggcgcttctgaaccgataatatcttagcctgaactccttcatttagtagccgaacatttcacattgcctatatcttctgccgggtctggacaccctctgaggcgcgaagcggtgagctcagctctgagacttgcgcctttctagctaataaaacctcttcgaccaatccccacattagaactccgcgttgtggaactatgacatatgtccctcccgcgtattccctaatagtgcttctcggaaggccgtcttaactcggattgtccgtcctttgagagtattcccaattaggttagggatttttattggttggtgaggtatttttatcattcccttcgtattgcaggaagtatgctattaccaatgtgttgcttgtactggagaaaaaaccctcagatcagttggattttttagagtcacgcgttagggtaggagtctttgatcatctctgaatcaagtatatattttggaatgaaaagaggattttcctagtagaaatcccttatatagagtaagtataatatattagtagatcgccattctttctatctatatcatttggagaaactcaagactttgtgaactggatgactacagccccggggttccctcactcaaaactctaccaagtgagctgaattgagatactctatatagatttcgaatgagctaatccgtatagtgaactcaacgcctagttcacttcactctttcgcttaacagatgtgaaccaagcttcttttctttctcccatagttctactatcagtgttttgctttgttcttcaatccattgatttcttctagttattagtaaaagtagggcgtcttactttgcttttctttccaagtaagcggaccacctatgcaaagagatctgacttctcctactactacttcttcctaggtaagcaattccactacttctcaaaagcctgacgctccgcgcctcgtgcctttcttcaatcaactcgtaggctcctcgcttgactatattttattagtgcatatatttctattttcgtagtgattcattgcgactcgtcctgtttcattaaggtcattggaaggctgccggagtagcaaacttctctcaaaccagcccccagccagaattttgatttaccttatcgctagtgcaaacccaaaatacaatacgatctcatgtactcttagaaaaattatatggttgcaaatagacaacagctagactagtggtagtagtagcaaaagtaatgggttgctttgaatgaagaaaataatacgaagctaggcctcgggagatgggagttattaagaagagaacggatgacacaatcaccaccactggctttacccaaatccccccctttgccctcgagaaccactacaagaataccgcatcttatgaaaaataaaagaagataattacccacaccccaatcatgattgaatcgtttcatcatatcatgaaaacaagaattaatgattctccttctaggttgatccctacaatggcttaccattactgtgtcttctttctctctctatggagcactgttactctattatcttcagaaaggatagtagatggaacaagagactctcgaagaatttgctaccgagctctaagttgaacgataagtaacgatgggtaaagcaaggtatgcatgggctagactaagagatgtaaaaggattacgagggtttgcttgagaaggttctaataggggatcgggattcaggcccagaaaacaaaccactgaccgaccaattcaagaaaagaaggactcttgaattcaaagcaggatgtggaagctgaaggaaggcccaattcatcacagagcaagcttcaccttctgttttttcttcaaccgaagcactctggcataaacgtttgtttaggccatccctccaacaaagtcatcagtcatctgttctatgagaggagaatcccagtcaagccagatgatcagcaaagttgttcagcttgctgtcaggccaaggcacaccggatccagagacctaatctacgatagaatcactctagggtttgatcctcataaatacacatcgattcactcatatcactatgaacgcgcgcataggaaaagggagaggacagagctctccattccttctttgagagaagagattgttgagaaatccactgtgagaaggcagggacaggctaactggttggtcaagggctacgactcagcttaagaaagcagcacactggacctacatgcgggccatctgagaaagaagaagacgcatctgaaaatacgaaataccaaaaagaaagtaactaagaaaagcagtccgcactcccatcccagaagcaagtccgatcggaattcctactcctgcgtattgcctctcgcaaagtacgagtttagtccaagagatgagggttcttcctttctgccacaccgtccaaaccactcacacgcttcttcgttgtactctctatactcctacccctggtctttatgcattagtttcttcgaaccttctctttattctgggtgaagtagctctctggagtactaataaggggctggctttcctaagagttatttataagtcaaagtttaaattataaggtaaagtaaaagttatagtcactcttgtgcttgcagactcttgacgaaggtttcttttcattgactagtgagatgacagggcgggaaatccaggtaggtgaatcactgaaaggaagatttctatcactacaatgaaatttgtaagcccatcttattagcttatgtcagtcttccaagtaataagccagcttttaacgcctaaagtataccttgagtctttttacctatgggcaagcaagccctttttccatacaaaactcatgttccgtaggatagaaagaaactgacgggaaatacagcacggattatagggagttatactgctatttctattcagccgtagaccttaaatctaaattggaacccttaagagcccctttttcagtctcaactcacccacatcgccaatggacgagaagtgcttgtgggtggccaatccctggcatgcatttccacgaaatggaatagaatgcttaataggcaggcccctcctttcatgttaacatacgtctaagattttaagttcgaatcattggtgcatagatttatacacccattctcactcgtgcttgctggtgaagctacccttatggaataagttcacaggaatgatacgtgcacgcctaacagtagtcgattctaatcattgtcttgtacccaacatgcatgaagaaagagtttaatagcatttaaatagttgtacaaacaattcgtgcctgtggcctctggaagcagatctacgagacgaaaatgaaatgattgagagagagaagccctagtaattcaatgtgaccagccagcacctattggttgggattactcaaggtataccaaaaaggttgagtgtctcctcgccattcattttggaatgccatctaggcgagcaatagttctctgtttccttcataatatttggccgaaccctgaaagaaatatatagggcccaaaatcataagattctctggaatctccactgttgcctgacctgagcaagtagtaagcaactgtagcgagcactgactagtttcagagagtcactgcttttcttccttggattggaatacgcgttccaacttactgagctactggacaaagaggagtatatacccggtccaggaaagctagggatagttgttgatgcaagggaaaaacaaaatagcacatctgtttgcttggctgtcccaacaaattacctgctcttgactgagctgactgttcgtttcactagtcctgtagcaactgagccaccagcccatttcgctccaactttccttggtgcatatcaagctgtccctaggcattccactgtctcgcctgccttggaacctgcttaactaactactgctgagccaactagtgccttccttatcaccagaaaaagctacttgttatagtcgttcatgtagcactgtgctaccattcctttctacccaactaaactagtcatttactcaacacaccggttcaatataaaaatcccgatgagtaagttaattcactgtgtccactaagtctttcaatgaactcgcataaataaactattcgaagaactcagtccagtccaataagtagattaacttgaaagtaaaagaactccaacctggaagtacacgcatcaagtaagtagcagcagctgaatgacctggaacccgcatcaaagccagccaggtacgagattcactctcccgagcctcctctttattcagaaatgaaaccaagccatctgatctaaccttaggaaggcggtatggattgactataactaaccaaagccagtgagtgggatctcattggtagcctagcctgggataagcaaggagcgcgcatcacaatccatatgagggtggagtcgttggttcgaacccaacttgtatattctatatatataggaaagaggaatctctagaaagaaaaagaagtctcttagtagagaagatagagattttctctattgatgtgagcctatatagttgaagagattgaaggctacccacaaatctcatatatagacgagtggaattcacaaagtcacttcgcttcactttacttcaaagtctattgatcgaagtaatgcggttcacatcctcatcttcgggttggttgcatatttttttcctgtgtccaccaggagttctcgctacccttggtgtgtgtcttggtggagttatggtggcaaagaatgcattcatatagttgatgtctttttggggagaggtgagatccctgtttttttgtaggcttggtctgagtgagtctgagtttgaagagtaagcactctcactttcaaataagaaataagccaagcacagatggaaattctcaatctctttctgcactttcacacaacataaaattgtgaaaaacgctgaagaaacaatgcactccacttatgctgattcaaacatgctaacaagaaagcaaacccgaagcgaggtgaaataggatagggagttggagctttcatcaacccgcaacgatagtggaggagagcccggatccagagtttgatggaaggaggaaagggtgaattcaaccggtcttttaatgccatcattcctaaatgttaatcctcatgctgtctacgatctgctcagagttgaattcaagagataggaatataagacaaagtttagattgaccgatcttctagatagattggataagaagatccaacaagctcgccatgagcaattagttctcaaactagccaccgccaacgaggggtatgtgttatactccccctcctgacttgagctgttataagaaagggacagaatcttgctccataagtatgaggagagtcggtacagtaggctcatacaccaatgctttttccctacaaccggatcctagaggaaaacttaatgcacaataggtagctcttaacttcgtctggttatgcccataagtcatcatgaatgcgataatgcccaagagttcacgtaaaaaactaggctctaaggttaggataagagcactctaatctagtctaggtagatgagggagatccacctaagcccaccgtctataaagaagcacacgatctaatctagtcttattgttagtctctctataaagatgatccatcacctaaagggcagactctggacagaaactgaggatttgctataggaaagaccctaccctataagttaatacaatatgctacattctatgatatcctattcaatcccccggttagcatgcgatgctcgtcgtgctaataaatcctctcttcttaaagcccaacccaagtaggacaaagaaatgcaagtaaataccctcgattcattccttttatgcgagtgggaaagctagctagaaatcaatgacaaggagtagagcctagagcaaaagggccaggcgtcaggttagttaaagcaagaaagtcaatggtgctcacttattcaatccttttttctctcctcctttgtgctaatcactagtgctaagaactaggtcaaaaggaaagtcagcccttaatacggagttttctacttgttcttacttgtgttagtgaagcctgatagttcaacttgcctgtccaaagtcaatctatgaaaagtcttccttatagacgcacccagctgtaagagagtagaagcaatcggagtaaataaatcccatagtgaaatgagcgttagatgttgactagacaaaactagctaatacatgtagtagggtaactttgccttttttctcggttatgtgaaaaggtagaaaactcgctacactttataggaaatgaactactcttaatgcaagctagtcaagctggatgagttgttaggaatggctcaacccaggcagcgctaaccctgtctttccctaaaagtatcgtctttccctagggaggacaaagattaaccaatagtagtcccgaggattgtatgagcaaggtccgaactgtttctattagtagcaacatgaggagccccgaagggagaataagaaagattaaccgacgccgcgttttcagaagaagcaattggataagaatcatacgctgtgaatgagcagacaaatcgaccgagggcttacacacaagaacagaacctaactctacttctttttcctcctctcctctttactgcccccgctatcaacaggtcagtaaataaatatatgtagtggagaaagaagagtagccccccaggtcatcaattagtaatagaataatcccatcccagtagtagtcctcttgccaacaagatttgatctacttagactaacggaaaccatggcctagttcctcgagtagttactcgttctaaactaaatacgttcgtagcagtagctgaagaaaaaagagatcactagaattcccaaggaaatctacattacttggccgaggaagaactagagttggcaaggttgacctcagctctgagaaataagaaatccggcacctattgattgagctccatctaacatatcgatatcgagacattttcacgcttttgatttctttgctgctctttcctctattgcggcgcatggataggataggcggctaggaataagtgattttaaacctgaggcagaagacgaagctaccgactccaatgttgatgcacattaactaggagtttttgagatcaagcaatcaatcctcgcctcgaactggtataaaggaagaagctggtggtgcaggtttgtatcaagtcagatgcagaatatttactttacataaatgggttgcccaagggatacgatttccggagttcaggaataaaaactagttcgattcaaggaagaagttagaagcgggtggaaaagaatctcgtgccggtttacgttcgcatacagtcgcaggtgcggaagaagtagaagcaaggtcaattccaggcagaacgtcattcgatgctatttcgattcaagcagaactagacccggccacaatagtagttgaagtattagcactcagaaaaatcataagtagaatcgggcatgaagaaatgctttggttgaaccaggcctattagcatatgcattagcagatcttctcactctagcgatttcaagcggacccatctcccttgcaaagcgttagcgctagccaggtcaatatcaataattcatctctattggtcttacttcacccagcttccatatccaactcagacgtagctgccttctggcactttttgaactatatcccatgacttgaccttgcccgaagtcaacaatcaaaggtcagaatgaaaccgtatccacccacacaagaaacttgccctgaaacttaaaccggcagaaccgactatggttagagctggatcatgatcttcctcgagaaaagcactgatcaaacctggaatgccttactagcaggaatgaaaaggtatgtatgaaccaacaaaggtcaagtttatatatattagacaagatttaaccttccttcaccgtggcttacttggatgggaaagtcgtagatacgcgttctattctagtctagaataggatccatgtataaaccaacagtcctagatggacacgaaaagtaaggtgatgaacgaacttcagaatacaataaacagaatcaaaacaagcaagagaactcttaaaagaaagaaatctactgctctatcattgacagatatcttttagtctatagcccgccctacctagggggaactcacactcgctagaaggcaaaagcacttgaaacagtagtgaggtaagaaatcaaactactcgcttattctcaatatgaaaaaacattctaagtactattaatcctgaattactaaaatccttcttagaaaaaggtggcttaactaacgaaagaaagatggaacctgatgcttctttaaaagaaagcgctttaaatttatgagaagcaaaactaaactaatgagaatgagtaccactatttcttgggataagaatgcttcttcaccagcaacggcgaaactacactaccaataacaataaagtaaaggagaaaaaactttattgggatgggataatgtgctatcattgggatcgatctccaatcgatgggaagagataacgggtcaacccgactccagctcttggctagataggctgcgaaactacgccgtccaaaacaaatggactacgccatccagaatttgcaagaaaaaaggcacctaatctttaccgtctccactgagatttcagaccagaaaggagtagactctagtttcaattgcgttgcgtatagaaagagattcgtcttgtaagagcgagcaggttgaagcgcttaggctacttcagctatatgcttaacacatgcaaatctaacgaagtgctcctggacgactctttctttgagatttcgtaagtaacctagtgcatgtgcctttgaagaaaatgaaatgaaagcttttgaagcgaagattttttataaatcatagccgggaatcaatcatgggcagatgaagtccacgtgctgcttttcaaaataaggcagaaatgcgtacaggaaggatgggctccgggtcactctcttcactgatgcttcgaagcttccacctttaactcgtcaaagcaaacctactgaatgttgaatcttgatcgatgtaagaaaccaaccgtagaaagagaggtcgaagcacctgatcactcgttcagctcgtttttcgctcgtgcctgtatgaattgcatcagtcattgtgttttggcggtggagaagtacagaagtaaacagtgtgttagtatttagttgtgcgaagcgttgttgacaagacttactcaactcacacctgcttccggtgacaactaccactctcttatgaatgggagggtagagtaccaagacatagggattagccagcgaaggcggtttatttagtaccaaatatacgtattttgaattcttttcagtcaggaagagataaggaaaactgaaaagcttctcaaaccagagtaggaattcgatcaatcgctatcaatgccaggaggcagatcaagattcatgggaacaagaaccttttccgagaagagtcaagcgagggataggatagatgaataggtttaagcctttctccgcttttagggattcatttacaatttctaaggcttcgtttttctccggcaagcagctagggaagcatttattcccaagcgatagggcttatagttcagattgatgccttagtccactcggaagatagaactaataatggaaaaagatatgcttaagaactccaacagtaagttgatcagttattaatagtatagttcggtagggacgggagacaaaactgccactgatgagaaagcgataagaagcctgaaagcgattcttacacaagatacgatgacaggaagatcaggaatggaaccgaagaatatgaaattggctctcgacccagaccttgctttgtttacctgtcctatcgtgtcgaataaggtttcctagcctagcccatcacgatgtctgctaccgaaagagagaataggtctaagggcagcatctactcgttcatcgcttgcctcacctcgaaagaggcatggcttctctcttcactcactcgcctgttcgcctgcttcaatagcatggaagaaggtgttctcagagcatagtttcacatatctcttgatcaataattcacttatagcttatagaaagtagaaagactcttatttcgaagatccatatctaatcccacttcgttcatagcgaccacacttcccatgcgcgctctactcttcactcttgctcacctctcttcttcaacaaggatttgccgttcctatctgtttttcaaggtaaaagaaggagccggcctggggctgctgtgccctttctaatggtttcatagcttttgcgcgtatcgtaggattcgtacgtctataaaacgtagtcctctatggctattcctgaatcgtgggaaaaggtatgcgtatacttaaattgaattgatcgtccgggtatagaaatgtgttcagtctcctttctcttttgggagcagagctgaaaaagatgggaaattccaatgattcttcgttcattagaaataaaattaatgaaactcttgggtaatttttttatttttcccgaactttcattattcctccttcagattttggttttcgtatcacggatgttggttcatttatggctgcgttccccgtgggggcagcccgcatttttgctacttttgtggtttttactcatttgggtgaggtggcacacgccgcgggtcacgacccttatccgaatgcgggtgctgtaggtccttctgttcccgctgctccgcccttacctcaaaggcgggcgggggcgcattttccaactatcttattgccccctgagcccaacgaacctcctcaatcgggggtcgggcgctcagctactactccgccagaaccgaaaacttccatagcatgtttggaagttgtgaaagccctcctgaatggggctgtccgggggtgcaccgggagttggtgtatggggatatggaacgaactaaaaaacggatgtaattgttgctccccgtcctcctgctgcgatgaggggtctgccgtggattgattaggattcaacttaatgtttgcatcgtttgactcaatgatggcctttctgatctcattcgtattccgagttccatttttcttttgcctcaatgatggcctttctgatctcattcgttttccgatgcataaaaagtcatatttcttggtgtaggtatctctctttgcaaatagagatgccgaggcccctacttaccttctcttctaagttttggggggaaagaagagtgggttagcgggcttctttcactgtgtcttttgactctgcttgagggggttttcccttcagcttgattgaatatctcttgtgggggtaggccatctaaaactattttagcaagtagacaggaatcgttgggatcctatctatctatccggacttgattcattcatctgaccatctcgatttccagcccacaataatagaggcagaagcacacatgagtcctagtcatacttccttctaggcttataggaatccatatttctagaagaatataccactaatctaatggtgggcgaaactattgcatgccaaggtaggtaagtcaagatcagtaggcattaagtcaagatcagtaggcatagccattctaagcactagtctagatgtcaggtgatattatcatatcagctaggcttgggtaggcatctcttagaccttcatctactattttatttgctgctatttgatctggttcagcctttccctggcaatggccttggtaatgatgcatagtgaaatcgatgcatttcatatggttagctctatcaattctctatgatttgagaaacgatctggcaccagagtccgctaaagcactgggttatgaccctattggatctcgcacatatatatccggaagataccttagctatgaaacactctttcaagcctatgaccaatacccatcgaacttattggatcttttcttcctttccttagacccgcaaacagagacaacctgatcgataatagtgccggtagaggaaaaagcaatggtcaactattctcacgcatctcgacggaaagctaagctcacaaacagaaatggttatgcccacataagcctcagagctggagacagatccaccagttaaggtattcatccagaaatgagccactagactcacttactcaaagtgctcggtagctagcccgggagagaaaaccatttgaagacaagagatttgattcaccgatgccccaactgctttagttgacgtagtgtacgagccagatcagaaccagaactcgatttgtcctagataggagactgaatgaactatctgaagacttccttccggcatcccttccctcatacgccgatctactttgattggtttgcgggcccattgctgtgctggtttgtgagcttaggaagcattgtggaggttcagttcataggtagaaaaagtcgggatcagtgagtgccagtctaattcatcgaagaaagagacgctagcgaacagacaagagattttcttcactaccgaacctggttgactttcctcattctatgtcaattcggatctaattctatgtaagaaaaagatctataagaatggaattatgggtgggatttggggaggatccggtcctctttttatatatatttatagataactcgattttcttttctgcaggtgagacgatactagccggtgattcaaaggtgcttccagcttctgaagtaggtagtagatcgggatagccagccatttcttatcctgatcgagaatagtgagcttgtacaagcccgtttctatatacgcgacagagcctagaatgcacgttagagatcttttcgtgagaattgaattgaatgcgtagggatgaaaaacgcgatatagctctaaagtaagaaagaaatcggcctgtcccgtataatgaagtcaatcaaaggcaagggtgaaactagtcttatggatgcaagcttgactggttcttagtagtcttgggtaatggatctcagcttgactggttctcctattttcatatataaatgctccggccgtgaattccttttttctaagattaattcccggcagggcgtaaactcgagcaagagcatgggaccggcacaaaaaactaggcaaactgccactggactaacatcggaaccgaagatccaaggggtcatatcaatatcatggcgactcaccactagagacaagaactcaacccagctaaggaaaagcaagtacccgatagcggaggaaaggagcttcgcagcgtaggcttgctttatggcccctgagtgcacatccttgttgtggggaaacccgagtaactcactacttgagcccatggttagtatcactttttgaatgggaaatctactctcccgaggggaattgtcaggtagtactagtacttgtactacgacaagtttagtttagtcccaacaacacctttttaaacctgcgaacgaagaacagagtcatcaaatgggttctgggcatagcatagagcttccgcagggcgtacggtattggttggtacctgttgtctgttctgtacctcatgttcatgattggaatatgcatcccgaaaggaagtatttccagtagatcttttccctctcagtggagaggtgggtcccgcctcggcacataaactctagatttcggaagcaaagcactgcagtaagcaaacctttcctaagcatctctagccttctcttttcctaagcatctctagcgtgcgttctccatagaaagaaaaacccagcagtcaagactagtcacatacacgagtgaaacaagtgattcgctgacattccattcaaatagtgccgagtagtcacagctacgacaagttcttctaagataagaggaaggagtgttccctcatacgatctacttttgcttactccctagccctagcttgatggacaaaataagggctatcctatcctaactaattctctttcctgcaacccaagctaagcttcaaccaaccgtcacctttagccaaccaagcgctttaggaagtcgattccatcatgggagtggatctcttctagtggcgaaatcacggaatcggatcactagttcagttcaaagcgctcgtagagcagacacaatacaagtgccaggtagtaatctgtctttttcccggaaaccttgcttcctattcctactacgactacgatacgatgaaactcgagcacaagtgaagagatctcatcccgtctttcattaagggcgtactatactggggcgtttaggtcgtgccattctaaaaaaatgaaagcatgagcatagctccacaaaacatttattcatcacagtagtgactcagactcattggattgccatcatcaatagctcctcttttaatcgtaacaaatgagaaatttgcgactctagtcacgaaacttgacttgtatccggtagaagctttctctttggattgagattctagaagttccgggaaaagagattcaagcacagaatccaccaggaaaaagatattcctgcagagcagctgtgggccaagagtcaagaatgaatttggcctagacctagcgtcaaagtaaagaattgaaacggaagccgacttggacttaaacttagttgagagtggtctcttttttaatctcgtatgtatctcctgcagggatcgggctagttgcattactcgaaaatgaagcataatcagaagaacctgtcgtgtagtgcctgcgtctattgtcctctggcaggtgaagtggttgcattcgccgggcttaggccaatctccagatccgagtagagagtggaattatttcttttcttcccaagacttcatcattcaatatgcgggccgagttggataaccaaatcatttctatcaagtggattcccttatctatataggcatccagtagccaagtctgttttccgatacgccagaccagcttcctgagtagaatacgaaagaaaggccattccctggatcctctagcatcactagctgtaagcactttcaagtacggcactatttcttgcttgcattgatcaagttcaagaccaatcagatgtaaggaggctaaaagcggcctcattcggtgatacgtgaatgtcaatcacttgaaagcacctatctcatcccagcacgggaagatatctctaagcaattgaactagatctcagtaccgtctctccacctaggcggcaatatcctcaaagctaaattctttctattggtatatacctacacatacacacacacattctatgctatgcctatgctatggacaaaacaaatcgtgaagcatattttgaacttgaactaaagctcgaggcagaaccatcgtggtatccataaccacctccagctatccagatccattccatattagatggactttgaaggcttattccgttagtgagcttgtgaaggcaaggcgtttaggcgtcggtttcttacgagataagatatgtatgccggtccaactaaagcaagggtggttttgagcttgggttgaaagctaggtagggcttttatgcttgaagtgcggtgccaagagtggaatatcaagttctgctagcaaagaaagaatcgaatgttggactggactatagtaggtctattagactattcttactagagggtcccctaaaactggcataaccgtcaaggtgcctggcaagtcagaagtcgcaggattgcattataaagggctaaatcgagttcacgtcatagtagagcaaattcttgctataaggtatatatacatacatcagcatggccaccgtagtagccagcccgaatgaagctgtctgcgttaacgcttggtatatagatgcgcgcctgctcatcataatagtgcgctctgaagatagtcattgccaaagacgagatcgttagc

SEQ ID NO: 7 - DNA, 4996 bp, Zea mays
cgcgaggtcgccgcctcctccagtaccgcgaactgactctccgccttccacaaatcccggcgctgctggctgattttctcatttgctccggcatgcttctccagcgtccggagttctgcctgaagcgtcagcagggcagcatgagcactgtcttcctgacgatcgcccgcagacaccttcacgctggactgtttcggctttttcagcgtcgcttcataatcctttttcgccgccgccatcagcgtgttgtaatccgcctgcaggattttcccgtctttcagtgccttgttcagttcttcctgacgggcggtatatttctccagcggcgtctgcagccgttcgtaagccttctgcgcctcttcggtatatttcagccgtgacgcttcggtatcgctctgctgctgcgcatttttgtcctgttgagtctgctgctcagccttctttcgggcggcttcaagcgcaagacgggccttttcacgatcatcccagtaacgcgcccgcgcttcatcgttaacaaaataatcatccttgcgcagattccagatgtcgtctgctttcttatacgcagcctctgccttaatcagcatctcctgcgcggtatcaggacgaccaatatccagcaccgcatcccacatggatttgaatgcccgcgcagtcctgtctgcccaggtctccagcgtgcccatgttctctttcaggcggcgggtctggtcatcaaaccctttcgttgcggcctcgttcgccgcctgcaatgccccggcttcatcgccggaacgctgcaactgagcaacatacgcaatctgctccgccgacacgttatggaactggcgagccatcgccgtcagccccgacgtcgggtctgtggtcagcttcccgaaggcttcagcgaccttgtccacctccacgccggatgcagaggagaaacgcgccacactctggctgatggacgcaatctgagcctcaccgcttacccccgccttaaccagtgcgctgagtgactcgctggtctggttaaacgtcagccctgccgcctgcccggctctggacaggaccagcatacgatctgccgtcagtcccgcctgattgccggaaaggaccagcgttttgttgaaatcggacagggttgagttgccctgataccaggcatacgccagcgcaccggtcgccaccgccagcgaggtggcccccaccatcggcagggtgatcgcaccggcaagccccctgaacatggggatcatcccgccgaaggagtccttcacctgccccccctgttgcagcaggatcagccacggactttgcccgcctgcaagctgcgtggccacgtcggtgaactgtgcaggcagcatacgcatggcggctttatactgcccgacggaaatccccgctttctgtgcagccagcgcctgtcggctcagcgactgttcaacgactgccgctgtttttttcgcatcactttccgtaccagaaaaatgacgcctgactctggccatctgctcgtcaaatctggccgcatccagactcaaatcaacgaccagatcgcctaccggttcagccataccggactcctcctgcgatcccttctgatactgtcatcagcattacgtcatcctccgtcatgtccgccacatccggggaagcggggataacttcattcccgtccgggccaaagcggacacctccggcaagccctgccgctttctgcatcagcacatcatcttcaggctcttcgtcagcctcgcgccggttcagcagactgaaatccagcggatgcatatccggatcgctgaaaaacaggctgagcacggtgtacgtcagcccggaaaagtgcatatccagcagaacatcatgaaaataatgggtactgtaaaagcggtgccagtcggcatactccgtggatgacatcccggcaagcatggcacgccagtcgggtcgccccatctcacgcgccagtttcagggcaaaactcagctcaccgtcgaacactttcccgcagaaacaggctctgcgggcccggcgtcctctgtctgttcaggggcattattcaccacaaactcatacataccagacagccggtacaccacgttttcagcatgagaaattgcctccgtgggccaggtggtaagcacttcctgctcaatctgtttaacggcttcattcatggacggcatctgcgtcttctgcggatggttatgccacagggacatcgccaccagaaacgcgccggttctgatggcgtcttccacagtaaacttccggttgctgtctgactccgcctgttctgcctgccgtttcatcagggcgagatgctcaatgcgctgcagggctgacagttcagaaagcgtgacggtcacaccgttatgttcaaatgattcggttttcaggaacatcgctgactctccggattaactggcggtgacggtaatttctgcaaccgcagcaaactcaccattaccggatacaaccggaatgttgaccttgcctgcagcaacgccgttcacggtgatggtcataccactgaccgacacggtggcttttgttttatccgcagacaccgcacgaaagctcttgtcggttacgccctccggctggaaggccacggtcagcgtggtgctctgccctttcaccaccgaggtgctggcaggcgtcacggtcatgccggttgccgctgttaccgtgctgcgatcttctgccatcgacggacgtcccacattggtgactttcaccgtgcgggtgatcacttccttcgccgtcaccgccttaccgatactgctgacccagccacggaacacatcgaccgtgccgttcgggaagcggattttataggcacgggtatcgccttcattaaaccacgccagcagcgcctgctgcccctgctctccgggcatccacgccagcgtgaagctggtatctccggcagatttctgcccctgcccggtcgcagtccagtctgcatcttcatcatcgagatagctgtcgtcataggactcagcggtcagttcgccgggcgtcaggtctttaacttttgccagacgcgaccagtcaacgtctgaaagcggattcgcgtaagggtcaccgctccccttataaacccacagggtggtcccggcacctttcaccggcattgtaggatttggtacaggcatagcgtcctcacatttcataggtaatgacataagtcagatcggctgaactccacaagcccgcatcatcgtcgcgccggtagtcatagccgctggccaccatactggtgatcaaatctgacagtgccgggatatcgctcatcaccggataaatccgggactccatccacgcatccagctctgaatccggcacctgagcaggcaggaaaacttcgatatgcagctccgcctgccaggtatcgctgtccagctcttcgcccgtgtattcagcgccggtgagataaacggcaactgccggaaaatccgcctcatcaaaaacagcggggcgaccatcaaaaaacgtcgccccggtgtcatgcttctccagtgcatccagtacggctgcacggagttcagtatgtttcatcgctttattaccatcctcagttgatgctgcagcgcatagcccagctctttcggaagacgttcacgccgtatccgctcaatattttgtttaaacgccgtggtcagcggcaccgccatcgggattttcaccacatcaatggggtaacggtttttcccagccacacgctgcatgacatgccaccggccatttttcagttgctgaataaacgcgccgggaatacgacggttacccaccacaagcacgctgccgccacctttcagggatgaacgctgcccctttttacgacgcctgcggcgcgaaaggacaacccgcgcattacccagcttgattacgggcaaatccccccggttaactttgattctggcctgcggatttttgaccgtggcccttttcagcctggccctttcctttaccagtttccggcgtacctttgtctcacgggcaacctgtgacgccgactgcgatatcgcggatgaagcaacgcggttaatggccattgcggcggcaccaggcaccgccgttttgctgatacggctgaggttttcaacggcctgctcaagaccttttatggccatacatccccctttcagcggcgacggttaacggcaggcggtacgccccgtccaagccagagatgacaacttccgccatcatccggcgaaacccgatctacccagaaattttcctcaccgatggtcagcgtgtctccacgccgcagctgccgcacctcatcagtccggacaaacagggacgggctggagccttcaacgcgcacgccctgtccggcatagctgatattttcagggtcatcaaaaacaccacgtatcaccgcacctgactgctcaccggatgtaatggtggctgacgttcccatgtacccgcgtatcgtttcatcggcgcgggcaatggcagcatcgaacaggttatcgaaatcagccacagcgcctcccgttattgcattctggccaggccgcgctctgtcatttcggctgccacaccggcagagacacgaaacgccgttcccggcagcacaaatgccacaggttcatcccgcgtggcgtgaagtgcatcagtatgcagcttcaccagtgccacgaccgtgaccagttcagacgtatccagaatcacggtatccggctgcgctgatcccacctcattttcatgtccggtcagcacattttcccggctgagaggggtgtcctgaccggcagtttcatccgtgtcatcaagctcctctttcagctctgccacacggagcgccagttcttctttcgtccccgtcaggctgacatcacggttcagttgttcacccagcgagcggagacgggcaatcagttcatctttcgtcatggactcctccacagagaaacaatggccccgaagggccatgattacgccagttgtacggacacgaactcatcagggtcagccagcagcatcagcggtgcgt

SEQ ID NO: 8 - DNA, 10355 bp, Zea mays
aaccgtaaactccggcactttaccatactggagaagggcttcactcgcaccttggggactgaactagagtacagaactagcttcctctgtacatattgttttcgggtaataatactatcattgagaaagaatagataacgactatcaggcatatgactgatttctatatgggtgtgggctcatactctcgttttatacttgctcgctgttcccgacaggaatacgtcacttaaaataagctattgacgtcttagttccgaccttgtctcctttctttcttttgttcaccggtgcaaggcaagggcggagctctcttatgttcatcttccacgcctgtccgcatcccaagcactaaatgagtgaaatccaatactttgtcccggagaaaggaatcagtctcttcagtccggcgcattcattcacccctcatttggttcactcgttcaactccttgatgtcatcatcctcccttcctcctacctacttattatccaaatggaatgcaaagacagctacttattaaggaacgaatgagactgactttccttctgccctcttagacttgtagtctaaatgctgtgtatctgacatacttcattctctgtgcagggtacgatttcactatggacatcctgatgtgttcgacaggatttttcacattacaagaggaggcattagcaaggcttcctgtggtgtaaatttaagtgaagacattttagctggtatgtgattctttatgtatcttcttaatgaaacacgtgctcaggcacattctcgaaagaagtgattcttcatgtatttatggctgttacccatttatgctctggaaggcatggagttgaatattgttttaaggtttcaactcaaagctaagacgtggaaacgtcacccatcatgagtacatccaagtgggaaaagggcgtgatgtcggtcttaatcaaatttctctctttgaggctaaagtggcttgtggaaatggggagcaagtactctgcagagaatctacaggctcggtcatcgctttgacttcttccgaatgctttcgtgctattttacaactgttgggttttatattagctcaatggtaacatatattatatagggcagtagcatgcattatattttttactgtacagttggctgtcatgctttctcatgttcttgtattaatgttgtgcagatggttgtcataatagtgtatgttttcttgtacggaagactttacttagcattaagtggacttgagtttgcaattatgaagcaagcacggatgagagggaatcgtgcacttcaagcggctatgggatctcagtctattgtgcagctaggtcttttgatggccttgccaatgtttatggagattggactagaaagaggtttcagaagcgccctgggggatttcataatcatgcagcttcagctctgttcagtgttcttcactttcccccttcccttgggaccaagtcacattattttggccgcacaattctccatggtggtatatagagcaactggcagaggttttgttgttcgccatgtaaggtttgctgagaattaaggaatgtactccagaagccattttattttttgaaaggacttgagctgatgttactgctagtagtctatcagttgtatggtgatgttgctacggattcgactgcctatatacttctgacatcatcaatgtggttcttggttatcacttggctattcgctccattcctcttcaatccatcaggatttgagtggcagaaaatagtagatgactgggatgactggaccaagtggattagcagtcgaggtggcatcggggttcctgcgaacaaagcttgggaatcctgatgggaggaggagcgggaacatttacagtctacaggtctactgggacgtttctgggggatcatactatctctcagattcttcctattccaatacggtatcatgtatcacctgaatatctctgctggcaacaaaagcatctctgtaagttatttatttcatttgagtttccttcttaaaaaagttcatagaacacaaggcttagtggataaaccacttgaatactgttcacataattatttattttgtttagaagcactatctaatgctattattgtattgtggctgtccactagaaatagaatttgtggcttcaggtttacggtctttcttggctggttattgttgctgtggtgatggtcctaaaggtaaattttcatttgcctgctagttttaaaattcgagtatatgttgatttcaatatatgtgaatcttgttactcttttttttaagttcttcaaaatggagctgcccttgctaagttgctgatcaggatctttctttaggtggtattcatgggaagaaaaaaattgagtgcggatttccagcttatgttccggcttcttaaattgttcttgttcatcggatctgttggaacgctggcagttcttttcaccgttctgcatctgcagttggtgacatattcgcaagcttccttgcattttcacccacaggatgggccattctgcaggtacgtccatcagcattgcccgtctaatttcatttctcaagcccctaaatgtcatctgctaggcctagtatcaagccataaaagttgtcagatgaaaatgcttttgaactattggcccacctggaatgtacctctgcaagagagtcactgcttttcttccttggattggaatacgcgttccaacttactgagctactggacaaagaggagtatatacccggtccaggaaagctagggatagttgttgatgcaagggaaaaacaaaatagcacatctgtttgcttggctgtcccaacaaattacctgctcttgactgagctgactgttcgtttcactagtcctgtagcaactgagccaccagcccatttcgctccaactttccttggtgcatatcaagctgtccctaggcattccactgtctcgcctgccttggaacctgcttaactaactactgctgagccaactagtgccttccttatcaccagaaaaagctacttgttatagtcgttcatgtagcactgtgctaccattcctttctacccaactaaactagtcatttactcaacacaccggttcaatataaaaatcccgatgagtaagttaattcactgggtccactaagtctttcaatgaactcgcataaataaactattcgaagaactcagtccagtccaataagtagattaacttgaaggtaaaagaactccaacctggaagtacacgcatcaagtaagtagcagcagctgaatgacctggaacccgcatcaaagccagacaggtacgagattcactctcccgagcctcctctttctttattcagaaatgaaaccaagccatctgatctaaccttaggaaggcggtatggattgactataactatccaaagccagtgagtgggatctcattggtagcctagcctgggatgggataagcaaggagcgcgcatcacaatccatatgagggtggagtcgttggttcgaacccaacttgtatattctatatatatataggaaagaggaatctctagaaagaaaaagaagtctcttagtagagaagatagagattttctctattgatgtgagcctatagagttgaagagattgaaggctacccacaaatctcatatatagacgagtggaattcacaaagtcacttcgcttcactttacttcaaagtctattgatcgaagtaatgcggttcacatcctcatcttcgggttggttgcatatttttttcctgtgtccaccaggagttctcgctacccttggtgtgtgtcttggtggagttatggtggcaaagaatgcattcatatagttgatgtctttttggggagaggtgagatccctgtttttttgtaggcttggtctgagtgagtctgagtttgaagagtaagcactctcactttcaaataagaaataagccaagcacagttggaaattctcaatctctttctgcactttcacacaacataaaattgtgaaaaacgctgaagaaacaatgcactccacttatgctgattcaaacatgctaacaagaaagcaaacccgaagcgaggtgaaataggatagggagttggagctttcatcaacccggaacgatagtggaggagagcccggatccagagtttgatggaaggaggaaagggtgaattcaaccggtcttttaatgccatcgttcctaaatgttaatcctcatgctgtctacgatctgctcagagttgaattcaagagataggaatataagacaaagtttagattgaccgatcttgtagatagattggataagaagatccaacaagctcgccatgagcaattagttctcaaactagccaccgcctacgaggggtatgtgttatactccccctcctgacttgagctattataagaaagggacaggatcttgctccataagtatgaggagagtcggtacagtaggctcatacaccaatgctttttccctacaaccggatcctagaggaaaacctaatgcacaataggtagctcttaacttcgtctggttatgctcataagtcatcatgaatgcgataatgcccaagagttcacgtaaaaaactagattctaaggttaggataagagcactctaatctaggtagatgagggagatccacctaagcccaccgtctataaagaagcacacgatctaatctagtcttattgttagtctctctataaagatgatccatcatctaaagggcggactctggacagaaactgaggatttgctataggaaagaccctataagttaagacaatatgctacattctatgatatcctattcaatcccccggttagcatgcgatgctcgtcgtgctaataaatcctctcttcttaaagcccaacccaagtaggacaaagaaatgcaagtaaataccctcgattcattccttttatgcgagtgggaaagctagctagaaatcaatgacaaggagtagagcctagagcaaaagggccagacgtcaggttagttaaagcaagaaagtcaatggtgctcacttattcaatccttttttctctcctcctttgtgctaatcactagtgctaagaactaggtcaaaaggaaagtcagcccttaatacggagttttctacttgttcttacttgtgttagtgaagcctgatagttcaacttgcctgtccaaagtcaatctatgaaaagtcttccttatagacgcacccagctgtaagagagtagaagcaatcggagtaaataaatcccatagtgaaatgagcgttagatgttgactagacaaaactagctaatacatgtagtagggtaactttgccttttttctcggttatgtgaaaaggtagaaaactcgctacactttataggaaatgaactactcttaatgcaagctagtcaagctggatgagttgttaggaatggctcaacccaggcagcgctaaccctgtctttccctaaaagtatcgtctttccctagggaggacaaagattaaccaatagtagtcccgaggattgtatgagcaaggtccgaactgtttctattagtagcaacatgaggagccccgaagggagaataagaaagattaaccgacgccgcgttttcagaagaagcaattggataagaatcatacgctgtgaatgagcagacaaatcgaccgagggcttacacacaagaacagaacctaactctacttctttttcctcctctcctctttactgcccccgctatcaacaggtcagtaaataaatatatgtagtggagaaagaagagtagccccccaggtcatcaattagtaatagaataatcccatcccagtagtagtcctcttgccaacaagatttgatctacttagactaacggaaaccatggcctagttcctcgagtagttactcgttctaaactaaatacgttcgtagcagtagctgaagaaaaaagagatcactagaattcccaaggaaatctacattacttggccgaggaagaactagagttggcaaggttgacctcagctctgagaaataagaaatccggcacctattgattgagctccatctaacatatcgatatcgagacattttcacgcttttgatttctttgctgctctttcctctattgcggcgcatggataggataggcggctaggaataagtgattttaaacctgaggcagaagacgaagctaccgactccaatgttgatgcacattaactaggagtttttgagatcaagcaatcaatcctcgcctcgaactggtataaaggaagaagctggtggtgcaggtttgtatcaagtcagatgcagaatatttactttacataaatgggttgcccaagggatacgatttccggagttcaggaataaaaactagttcgattcaaggaagaagttagaagcgggtggaaaagaatctcgtgccggtttacgttcgcatacagtcgcaggtgcggaagaagtagaagcaaggtcaattccaggcagaacgtcattcgatgctatttcgattcaagcagaactagacccggccacaatagtagttgaagtattagcactcagaaaaatcataagtagaatcgggcatgaagaaatgctttggttgaaccaggcctattagcatatgcattagcagatcttctcactctagcgatttcaagcggacccatctcccttgcaaagcgttagcgctagccaggtcaatatcaataattcatctctattggtcttacttcacccagcttccatatccaactcagacgtagctgccttctggcactttttgaactatatcccatgacttgaccttgcccgaagtcaacaatcaaaggtcagaatgaaaccgtatccacccacacaagaaacttgccctgaaacttaaaccggcagaaccgactatggttagagctggatcatgatcttcctcgagaaaagcactgatcaaacctggaatgccttactagcaggaatgaaaaggtatgtatgaaccaacaaaggtcaagtttatatatattagacaagatttaaccttccttcaccgtggcttacttggatgggaaagtcgtagatacgcgttctattctagtctagaataggatccatgtataaaccaacagtcctagatggacacgaaaagtaaggtgatgaacgaacttcagaatacaataaacagaatcaaaacaagcaagagaactcttaaaagaaagaaatctactgctctatcattgacagatatcttttagtctatagcccgccctacctagggggaactcacactcgctagaaggcaaaagcacttgaaacagtagtgaggtaagaaatcaaactactcgcttattctcaatatgaaaaaacattctaagtactattaatcctgaattactaaaatccttcttagaaaaaggtggcttaactaacgaaagaaagatggaacctgatgcttctttaaaagaaagcgctttaaatttatgagaagcaaaactaaactaatgagaatgagtaccactatttcttgggataagaatgcttcttcaccagcaacggcgaaactacactaccaataacaataaagtaaaggagaaaaaactttattgggatgggataatgtgctatcattgggatcgatctccaatcgatgggaagagataacgggtcaacccgactccagctcttggctagataggctgcgaaactacgccgtccaaaacaaatggactacgccatccagaatttgcaagaaaaaaggcacctaatctttaccgtctccactgagatttcagaccagaaaggagtagactctagtttcaattgcgttgcgtatagaaagagattcgtcttgtaagagcgagcaggttgaagcgcttaggctacttcagctatatgcttaacacatgcaaatctaacgaagtgctcctggacgactctttctttgagatttcgtaagtaacctagtgcatgtgcctttgaagaaaatgaaatgaaagcttttgaagcgaagattttttataaatcatagccgggaatcaatcatgggcagatgaagtccacgtgctgcttttcaaaataaggcagaaatgcgtacaggaaggatgggctccgggtcactctcttcactgatgcttcgaagcttccacctttaactcgtcaaagcaaacctactgaatgttgaatcttgatcgatgtaagaaaccaaccgtagaaagagaggtcgaagcacctgatcactcgttcagctcgtttttcgctcgtgcctgtatgaattgcatcagtcattgtgttttggcggtggagaagtacagaagtaaacagtgtgttagtatttagttgtgcgaagcgttgttgacaagacttactcaactcacacctgcttccggtgacaactaccactctcttatgaatgggagggtagagtaccaagacatagggattagccagcgaaggcggtttatttagtaccaaatatacgtattttgaattcttttcagtcaggaagagataaggaaaactgaaaagcttctcaaaccagagtaggaattcgatcaatcgctatcaatgccaggaggcagatcaagattcatgggaacaagaaccttttccgagaagagtcaagcgagggataggatagatgaataggtttaagcctttctccgcttttagggattcatttacaatttctaaggcttcgtttttctccggcaagcagctagggaagcatttattcccaagcgatagggcttatagttcagattgatgccttagtccactcggaagatagaactaataatggaaaaagatatgcttaagaactccaacagtaagttgatcagttattaatagtatagttcggtagggacgggagacaaaactgccactgatgagaaagcgataagaagcctgaaagcgattcttacacaagatacgatgacaggaagatcaggaatggaaccgaagaatatgaaattggctctcgacccagaccttgctttgtttacctgtcctatcgtgtcgaataaggtttcctagcctagcccatcacgatgtctgctaccgaaagagagaataggtctaagggcagcatctactcgttcatcgcttgcctcacctcgaaagaggcatggcttctctcttcactcactcgcctgttcgcctgcttcaatagcatggaagaaggtgttctcagagcatagtttcacatatctcttgatcaataattcacttatagcttatagaaagtagaaagactcttatttcgaagatccatatctaatcccacttcgttcatagcgaccacacttcccatgcgcgctctactcttcactcttgctcacctctcttcttcaacaaggatttgccgttcctatctgtttttcaaggtaaaagaaggagccggcctggggctgctgtgccctttctaatggtttcatagcttttgcgcgtatcgtaggattcgtacgtctataaaacgtagtcctctatggctattcctgaatcgtgggaaaaggtatgcgtatacttaaattgaattgatcgtccgggtatagaaatgtgttcagtctcctttctcttttgggagcagagctgaaaaagatgggaaattccaatgattcttcgttcattagaaataaaattaatgaaactcttgggtaatttttttatttttcccgaactttcattattcctccttcagattttggttttcgtatcacggatgttggttcatttatggctgcgttccccgtgggggcagcccgcatttttgctacttttgtggtttttactcatttgggtgaggtggcacacgccgcgggtcacgacccttatccgaatgcgggtgctgtaggtccttctgttcccgctgctccgcccttacctcaaaggcgggcgggggcgcattttccaactatcttattgccccctgagcccaacgaacctcctcaatcgggggtcgggcgctcagctactactccgccagaaccgaaaacttccatagcatgtttggaagttgtgaaagccctcctgaatggggctgtccgggggtgcaccgggagttggtgtatggggatatggaacgaactaaaaaacggatgtaattgttgctccccgtcctcctgctgcgatgaggggtctgccgtggattgattaggattcaacttaatgtttgcatcgtttgactcaatgatggcctttctgatctcattcgtattccgagttccatttttcttttgcctcaatgatggcctttctgatctcattcgttttccgatgcataaaaagtcatatttcttggtgtaggtatctctctttgcaaatagagatgccgaggcccctacttaccttctcttctaagttt

SEQ ID NO: 9 - DNA, 9233 bp, Zea mays
gcgacaccagtaccaagccaaccccactcgatcccaactccatttctcattactcccgaaatgaagatctgggcggctaagacaacaccagccgtcaacgtccacaccgcatcaacagagttcgctctctactggcgcgagaacggcaacaagaaaatcaactgggaagccacatggaagaacgacatgctcaaaaagcaacagtggcgcgaaaaggatggatggaagccaacccccggaactgaagctggggaactcgatgtggacagcattcttggcgtggactactggacgaaaccgaatccacccgaaggtctcccactccatgaagaagtcgcatggatgaaagagtctcgacgcaaacacaatgaagagcgctaccaactcgcactagcaaagatcggaggccagaatgcaacagaggtttgatcttgacgcagaacgggcgctgatcggctcggtgctactcgatgaacgtgtgctcgatgaactcaccgtgaatccggatgacttctttcagccagcccacgaacaactctggaagctattcacccaagagcggcgcaataacaagccggtcaacccgatcacgattagcaaccagcttgtcggtgacggcatcggtggcatcaagtccgactaccttcaccaatgccttggaatgatcacctcggttgcagcggctccacactatgcagaaatcgtcaaaggactagcgagcctacgacgcatcggagacgttgctggagtactcaccaatgcatctgagacggcgcaatgggaatccgccgaacaagtcctagataacgctcgctccgaactcgaccgagctgcatcaaagactggcggagttcgcgtgcgcacattctcggacgcgctgaagtcatcgctagacgtgtggacaaatccacggccacaaggaatcaacaccggctggcctgaacttgatcacacgctcaacggtggatggaaacctggacagctaaccgtggtgggcgctcgaccggctgtgggcaagtcactcgttgccggttgcgcggccgtagctgccgccgagcacggtgtgggcttcttcagtctggagatgcgcgaagaagaggttgtggcgcgaatggctgcggcatctcagggagtgatgttggagcacttcacaacctcacgactcacgagtgaggatctgcaacggctcgaagctctaagtgagaagtcatcgcgctggcccatgtacatcgaagacaactcgaccatgagcatgtccaagattcgcgccgccgtaaggacgtggaagcggcagggcgatttgaagttagtcatcatcgactatctccaacttgtcgaacccgccgaccgatcagaggcacgcgagcggcaagtgtcgcgcattgctggagactgcaaggcgctcgctaaggacttcaatatccatgtgttggcacttgctcaagtcaacaggaattcggcgagcaggacggacgcgaggccggttgtgtcagaccttagagagtctggcggcatcgaggcattcgcggacaacatcatcttgcttcaccgaacgtcagacaaggaatcggaaatcgagttcatcgtgggcaagaaccgccacggccaagaggcgaatctgcgaatggtgttccgtccgcacttcgcatccgtcaacagtatggcccgcgagggtcaagcagccagatttggaatgtagggaatatgccactcattgctgaaatccaagacataaccgcttactacgacgcatcgagagtccgccaagacgttgactacgtgcaattcttcggtgagcttgacctgaagcttgaccctccgaagcgctggccggttcggaatcgtgagctacgagagccgattgactcggtgaagcgcgcaatcatccaccagcgcgacggtgagttttgccgagactgtgggagtcatgcgcggttcgctgttgatcacatcatcccgcgctcagcattcctcgctgaagatgttccggtcatctccgataggtcagacaacctggtgagcatgtgctgggactgcaatcaatccaagagcaacttcgagcatcggcagatcaagaagatgggcgttactagacgctgctgggactgcatgaatccgtggtactcgcatgatgactatcacggcgacgatgaccctagacctgattgctcattgatcgcatattgcggaagttgtggaatcaccacggttccgaatatcaactggattctttagataaaccaaaagcgccgtccaactagggcggcctttttcatgagagggacaccatgagcctaaaagcagcactcgcaaagcaagccgagccaatccgcacactatgcgcgctggaaaagatttacgccacgctcgatgatgacgataagcaagcgctacgtgaggcggtcgagaatctagctattggccctaccgtcatagccgaagcgctcaagtccgttgggcatcatgccagcatctcaatggtcaagaccatgcgcgaaaagctcaaggcgggtcacacttgggagcgctagaggatcggctgaggaagaaagctgcgaacgaggttgtgtccacatctggcacgggaccactgaccgattcgtacaccatcagtagcgaggttgcgtggggctatgaggacttctgcaacttcatccgcgctaaaggccaggatccagaaaaggtctcgttcgactggggtgtgacgacaaaccccagcggcggcgtatggaacaagctgaatcgcgtaaggccgaaagttgagacgtgggcggatcttgtatcggtggaggaaatcgaagccgcgcaggatcggctcaggtcttactcactgccgcgcaaactgagtcaaaatgattccgacgctccgtgcgcagccgttctcaatctcgcggacatgcaattgttcaaggctgacggcgacgggctggaaggaacattggatcgtgttgagcgtggcattgagaacttccagcgctacatcgacaagcagatagcttcgggcctgaacctgaatgaggttgtcattgtcaacaacggcgacccatacgagggcatcgccgggaactatgcgaatcagctgcacaccgtcaagggtggcttgagggatcaaatgaacatggtcattgacgtgtggacgctcatagctcgcgagttcttcccgcagttcgagtatgggcaattcatcaccatgcactgcaaccacacccagttcgggcggcagggcggcgcaaaggaatccattacgggtgacggcgacacgggatcggcgctactcgcggaaatgcttgagcgcattcttcatgggcgcaaagagtttgagcatgtgaacttcaccatccccggcgaggagatgaacgtctacgcggacattgctggcgtaaagacgggcttcaatcacagccacaagatcccaggttccggcgcagacggcttcgagaaatggctcaacggtcaagttcgatatgacccgcgagcctatgaggtcgaggtctgggtcacggcgcatcggcacagcttgatgttctttgatcttggctcatgctcggtttttcagtgcccatcgtgtgacggcggctcgaagtggcttagcgacaagacgggcaaacattcacggtcgggcattctcgccatgaccatcggcaagcacgctccacttggctggtctgaccatgcgttcctatgagcgcgccgtcattggcgcaaaaacggctcactgagccacgaaaaccactccggcggggaaatactcgccgggggaaagatcgagccttaggcgaccgcctgaggctttcgtcatgaaagggaaagaaatgtttacggaagaagaacttgaagcggcgtgggactccactatgggcgacgagtgggcggaatgggaaagggtggttgttgatgcgcgtgcgcgttacacgagcttcgccaacgccctccacgccaagcgcgagggtgagccgattgacgcgaagaatgtgcgcgaaggtgaccgggtgcgggggaagctcgcacggctatgtagcgattatgcgaggggcgggatcgtcgagggtgtggcgtatcagccgggagtcgccggactttgtgttgccggatgggacattaatgcgctcgacgatcttcgcctcctccaccgtccagcgccgaagctccccaccgaacggccagcggttatcctcgcgaccgaggtgggcgggaagaggggcaggtgggaaatgatgctggactatcgcggccactggatctctagcgacgtgatcaacggctgcgtgcgccactacccccacgaaatcaccgcatggaagcccgccgatttcgtggtgcgcgaggaggaatcatgagcgaggagacctgcaacttggacattgttcctagcattcctgagcgccatgacgctcccagcttcttcaagcgcctcgataatgcggttcgcgagatcgaagcgatgaagctcaaaagcgaggccgaaatgatgaagcttcgaaatctggaggagtcatgagcgagccaacctacgaagaactactcacccgcaacaaccaactcgcccgcctgatcgtgaacatgaccgaccggcttgaaggctcgaagaaagagcttatggcgacggcttgggtcaatggcgtgcgggcactgcaagacatgactcaggaatcagaaacgaccgtggccctctgcctggcaacgaatccatatgccgaaccagtcgaggagatggggcaatgaacgcacgagccgagcttgactcactgaatgcgagattgaaccgcgaggcagaaacgcgtttcggcaaagcaatcctcgacgtgaagtacccacacgatgcaccgcactctgaagatgacgtcaggcatcacaggatgaaagagacaatgcaggccatctcgcagaccatcgtgagtattggggaggcaagaaagagcatcgggtcaatccttggacttgcctcaagcacttggggacacaccgggcacactaaacagcgcaaggagcgtggactgtgaacaagcactatgacaatgcaatggagatcattgaaacagccggggaaaatttcatccaagacgaggggtggactgagacaacggcaatgatggcaaccatcgacgccaatacgcacgccaccctcgcactcgcctacgagcaacgcacagcgaacctgctgcacgcgctggaaatctcagcacgagcacaggggacgttcgaccgcgaagagctagagcttcaagtcaaggaaaggttggggttgtgatgagcgagccaaataagtgggaaattgtgtcaacgccaccacctcgtcacgagtgcaaacttccacctgctgagaatttccaagtgggcacagtgatcaaatgcacggtttgcaacaagaagcatgtgtgccgtcggttgctcggagggcgagaagaaggcgtgcattggctgggtgtatcggaatgacaactttcactgagtcaactcaaggtgcttgcccggcaaacttctgcggttgcttcaagcgcgacggccgcagacgtttgccatgcgggccattcctggaaatttacttcagcggagaccatcgcatgaacagcgtgcatattgaagcgtcatacctgcgcaggatggcgccacgcaagctcgcgaatggctcgtggagtgacggcgtaggccgtactaggcctttgcgggacttcgacttctatatacggaatccgagccgaatctacgtggtcaagcttcaggagcagtggcacccgtgcaaaggagcggagctgctcaccaacgacggcttccgaacccacgccgaagcaatcgcctacgcagacaaggtggcgcgctttgagcactgaacgtatccagcttgacccgagcatgggcggcagaagcgtggcctacgtgaacatccccgaagctgagcactacgagtacatcactattgatcgcgactggtgcgaggttgagtggacgcatgtcggcaggggcaccgcgaaagaagctctctcgcaactcgctgaacgccgcaagaagcatcgtccgatcattgatgggatgacactcacctacgagcacgacggcatcaagtaccggatcacctatgaggacgtgacggaatgagcgcatctagagacattcccacatctaatgtccgcagcctacgacataaggcagccatcaaggcgaaccgggataagtacatcaccgaggttcgcgacattcgacggatccagtgggaagttttagggaggaagttgtgaccgagcaaattgtcatcattgcggtgggtgcgctaatgatcattggttttaccattctgctcgccggtattatcccgccaagcggaaagccaacacccaaaaagcggcactacgagatagtcgagtttccgccgaaggagcataaatgcaagcttccttgggcatggcgcttcaaggttggcacggtaatcaaatgcacaacatgcggctatgagcggaaggccgcgcgactaccacgaaggccccatgtcaaaatctgggatgggcacgatgaaggcaactacgaagagattgatggggtggaatcatgaccgagcaagtgccagaagcgcaagagattgaaagcattcgcgtatatgggtgtgacgtcgagttgcatcacggagcggacagcggcaccgtgtcggacgtgatcatcatcagccgccgaatcagcttcggagacgacgggcgaccatatgacgaaatcatgctggacatgtcgaacatggcgactggcatcatccagcgcggaatgatcgacgcggcaaaggcgtctattgatgacgcatggagctggggagattgggacgatgacgacgatgacgactaaaccccgcatctattggtgcgcatcagaatccatgtggcgcgtcgagattcgcatgagtcgatacatgttgcaccggcgaccattccacgactggcacgatgcgctgcaattcgcactagatccgaaagggtctttttttatgcccaattacggaggtaggccatgaccgagtttctagctgctgtggggattatgttactgatcatcctccccgcgtggacgttcgcgctgtggagagaacggcaagacctggatcaagaatggcgcgcactcaccgacgaaatggtggagcacgacggacgagtacgacgcgaaacggccgagctaaatgcgcggaagttggctttgtcgaggatgggggaagcggagtgagtgtcattcaatggattctcttggcagtgttgctttcctcgatacttgtgacgccggtggcattgttctggcctacagcgaccccgcgcagatggccatcaggggacaatgttagcgggaatacctgcgagctacccgactactacaggcttaaggcattcgacctcattgagtgcccaaagtgttcttcgcggtggacattttgggtgagcaatacatggcttggtgacgtctgccactggatgctaattagtcccaccagagatctatgcgggggtgatgccaagtgaccaagcgcgtaaccctaggctcactaatcgagatgctgacacgcgagcacatgcgctggcgtgaggacggacttgttcaagtgccggcgctgttggatgaacttgatgcggcggtgacggattcgggagtagcggcggcaagtggtggcggaagttcatcaccagccattccgataaacctaggtccattcgacttgcgcatggatatccacgcaaccgcataccagcaatgggaagaagtcgcgggatattcacacaatggttccgccgtgcaaaccattgctgatctggagaagctggagctatccgaagaatgggtgtcgcacttggagcgcgtgttactcgaatggtgtgaccgcatcgagtctgaacttggacgcactgcacctgtgagaaagttggtaggcgttccatgtccagcgtgtcagcttagcgtctatggcgaggatcgtaagcctacggtttacgttagttgctacagtctcgacggcggaatgctgccaccatctgactggctcgcggggtgcaagtcttgcggcgccgaatggatcggtgaatcattgaaaataattatccctttcttgcgcataaatgatgcaaaagaatccgatgacgtggtagcatagtcatcaggacaccttaggtgtcgaaacattcagatcgcttcggcggtctttttttatgcccgcggtgagtttcccttcctttcgcaccgcgggcattccctaagctaccgagagtccgcacccacacaagagcgttgcgcacgactccgaccgaccgcgtaccgggcgaatagtacgcgtcaaactttaggcggcgcgatgagtgtcatcagcgagcagggctgtgatagatgcggtgtccacgttagggcatacgcacgactagacacccgtgacggcgcactctacttctgccaccaccactacagcctgtactcaatcatggcgtgctcagcgtttggtgagtgggcttggacggtgacagtgaacgtgggggagttaggtaaccacgcttagttcacgttgacgttgcttgcacgcctgcacgaacttcattgccttagctgcatccttgcggtccacctcaagaagccatgagaaatccggcgaggttaccgacaaccaggattcgccgccgctcttctttttgagtgccaatgcgaacacgccggtaagtagcacgcgagatgccgttacgcgcttcgagagtgccgcgccgtcctctagctcgatctcagcgccgataagggattgacgacgctcaccctttggcttgctgagatcttcaatgtcgccgttcttgtacaacaagagcgtgccgaagttatccgttggtctgtccgagaaaatgcccatgcggtaagtcttggctatctggtggatgaatgcaaggggtgttacgtgtcgaggactggaaccgctaagtggaagcgcgtgcgcaacgaagcgctaaaggaagcgctcgaagttggattattcaactgtccactctgtcgcgtcccacttgactgggaatactcgcaacgcccaaacagccccgaggttgaccacattattccgcacgcaaaaggcggtcgggattcgctcgataacgtccgcgtgatctgtcgcctgtgcaatcagaggcttggatcgtcaacgcgccgcgacacgccgacaatcgaggcgatcgaggttgagtcgtccgggatttggtgagaaggggtggcgggttaccctcacccaccggcgtgggctagca

SEQ ID NO: 10 - DNA, 8715 bp, Zea mays
gaacgcctactttgctctcttatagagtagtaaagacttcacctttggatcctttacctttggcttaatgaagagttttacagggaccggcatgcaaaacctaaagtcatatccgcttaaaaaagctagggatccgtgaacagtgtacaggtcaaaacaaaagaaagaacaaaaaaaacggcacacgacgtcaatcactctcactgcctctttccaccctgttgtagactgccctttctgccgatatatacccagcacaggatgccgcgactgatcggtttcccgagctgcacacatgggagcacgcgctcgcactgttcgctcgctacccacctccacacctgccgctctccacactgctgttgtcgaggcgtctttctccgatcgtatgtgccgagctcctcctgcctgcagtctgcctcaccttctgttttgcttgcacttgaatagccaccttctgcttcgtgccatgcgtatatcttctcttgcggtggctttattgtacatcctgcgggccttcttgcgtggatgctcctctcttggctagttgtgtgtttcttgcagaggaatgtagtgttgctcagtgcttcactaccagcagcagcattgggtgtctagcaacgatgtagtactccatgatagttactgtatatacgagtttcacccataaacaattcgatgtatcccttggcatcttcaaattcagctacatgctatagctgggccgcaaggatctcgttccaggtgtcgggcacgtcgggaaggcaccagtgcaggcaatcctgaacgccaggagtggccttgatgctgtaccgtgaaatatgtccttcgtccctcagccgcgacagggcagtgacgtctaggagcctgaccctggtgcccctcacggcgccctccgaacggtcgaggtggacgccgctccctcccttggccagagggctggtgttatcgcagctgcctccggtgtcctagtcctcattgaagaagtgtcggggcgatatcgacctgtagaacgccttcagctcagggtggcggggaggttacgcgtccacccacctgacgacgctgtggacggtgaagttcttggccttccagatgaagccggtgttcctgtcgttgttcggcgctccaccgagatacatctcacacctgttcgccctcagttttccccggttccagtggtggccagtgttgagaaccaggacgaggagcctgtggaggttgctcttcagaaaagcaggcgggcggtccaggtgcatggcgtaactggtcgctcggtctgatgggttcaggggcttcaaatcacagagcgttgatgaccagtggtatagaattgttgtgttggtgctcggaaaccggtaggcccagccgtttggcctttttgcaaccggcgctaacacaaagtcatactatgcgccaacatcttctacatctagcctctcctttccacctgtgaccatacacattatcgactgaaacatctgcctccctagagaatcgcccaggtaagcgatggttttatcctgcattctgaaacatatccggattagtgtttccgtgctgtgctggctcaaagatttagccaaacagcgtggcatacaccatctctaaattcatcagaggttggctatgtagtatgtaccttctaaagaactgggaggcctcaaactctggcatctcacaagctttaggctgtcatctaaatttttcaacgcgaaatatgttcgctgcgttagtttgcaggaccaactctctgaaagtcactgcttacaaccaaacctaagtatagtggtctacgattgtcagaaaaccacttttcattcttgtactcgcattctgtagaacagaaaaacgaacataacatacagattaaagcaagataatctgtgcgccagctaatgcacaagtaaactgaacaaatataatcttctgaattttgtgcaaaggcaatatgagaaatttgtcaatggagaaaacaagcacatttgtatgctcgcaaaataaataaattcatgtttttttagcagccacaaagataagtatacctttattttttgggagcagggcggaggcaattctttccttcttggccggcggcggcatggactgggcagcggcttccgggtctccgtcgtggggcgcgacggcgacagaccccggcccgaccatgctgtccttcgaggggctagacagagggacggagagctcaccgctgcttggttcatagggaaggaaggggaaagggaaattcagacctcttgtcctaccgattctatcccgtcgggaggggtgcgtcgtgctgagataagagctccgcacaccgccgtggattactgccctcctacgcgctcgccttccacagtccacaccgagggccacgcacgagcgactgcacgatggaggctaaggcgtcgagaaagcggaggtgaggttgatacttgggagaactccccagtgatgcatgcaacatggacgaccgaggggagggaggctcgctctgcggtcaggggcatcgccaccgcagcctccgtgccacaggtgcatcgatctggggttcaacttcgagccggcccccacggggtccgtctgcgcgacgtgcggctgtctcaatcgccagctccccgatggcctccttcttcgcgagtctctccattaccagtcgtgatttaatctctcgttcggtagcctttggttcgggcgaagctgtctggcggagagatggaggagaggtgtttgtggatcatccacgagtggggcaagggaagttggcagttgtctcgctgaagggggcggcacctgtctcgggcgagcggggtgccgctactaactcggtggaaggcgtgggtagggtgcggacgacgcaggaaatgcgttgcggttgcggagggagaggtagaacgagagtgagacagaaccaaggagaggcagagtacccttaggttcttaatctctactacttcttaagacgctactgtagacgtccacagtatatattgatgcacggttctgccgagggctccccgcggatccccccaccctccccctctgatccgcgattgcggggaaccgaggccgcaatccggaaggtgccgtggatgctgttgatttcttgccgcggatggaaggtgccacggatcccccaaccctcctccccctttgatccgcgattacgaggaaccgaggccgcaatccggaaggtgccgcagatgctgttgatttcttgccgcggatggaaggtgccgcggatccccacaccctcctccccctctgatctgcgcaccttaaatgtatccgaggccgccatcaacgcgctcctcccccacgacgtcgatggatccgcgcaaaggctttaatgcgagtagccatttagtgtcgccagtcgctacttctttctcgtcttcctctcctgtctcctcgcagttgcgtagaagggtgctggaagaagtttctggttgggagaatccggttgaggttgccatttcccaacttcttccagcagttcggctcggaggcgaactgagatgtcatgttcgtgatcggattgtttttgcaactgcagacagcttgtcgattcgttgcttgaggagcagccatggacagaagaaaccgaccagctccgttggtgagtctctctctctcgtctcctcttcctctcctggattatatatattccttgattatttgcattcatgccatatcgttgggttgctttagttgagcttgagcaggtcgtttggaaatcactgtcgcctccgcttccacgcgacccgcgacgaaatcctggagccgcacctcggcgtcggcggcggaggaggacaagcctgcgaaggacagcatggttgggccagcatccgtcgtcgtcgcgccccacgacggagacccggaagccgttgtccagtccatgccgaccaagaaggaaaggagcgcctctgccctgctcccaaacaagaaaggtataatcatctttgtgactgctagaaaaaccatgaatttatttcttatgcgagcatacaaatgtgcttgtttctccattgacatatttctcatattgcctttgcacaaaatccagaagattattttttatttcagtttacttgtgcattaactagcgaacatgttatcttgttttaatttgtatattatgttcgcttttctgtcctacagaatgtgagtacaggaatgagaagtgggtttctgacaatcgtagaccaatatacttagggtttggttgtaagcagtggctttcagcgagttggtcctgtagactaacccagcgaaaagatttcgcgtatgaaaaattcagatggcagcctgaagcttgtgagatgccagagtttgaggcctcccagatcttgagaaggtacatactacatagccaacctctgattaatttatagatggtgtatgtcacgctgtttggctaaatctttgagtcaacacagcacgacgacactaatccggatatatttcagaatgcaggataaaactatcgcttacgtagacgattctctagggaggcagatgtttcagtcgatgatgtgtatggtcactgatggaaaggagaggctggatgtagaaattgttggcgcagagtatggttgtgttagcaccgagtgcaaaaaggccagacggctgggcctaccgattcccgagcatcaacacaacaattctataccactgatcatcaactccctgtgatttggagcccctcaacccatcagaccgagcggccagttacgccacgcacctggaccgcccgcctgcttttctaaagagcaacctccacaggctactcgtgctggccctcgacaccgaccaccactggaaccgggggaagctgagggcgaacaggtgggagatgtatctcagcagagcgccgaacagcgatagtaacaccgtcgtcatctggaaggccaaaaacttcaccgtccacaacgtcgtcaggtgggtggacgcgcagctcccccaccaccccaagttgaaggcgttctacaggtcgatatcgacccggcacttcttcaatggggactaggacaccggaggcagctgcgacaacaccagccctctggccaatggagggagcggcgtccaccccgaccgttcagaggacaccgacgccgagggcgccgtgagaggcaccaggatcaggctcctggacgtcactgccctgtcgcggctgagggacgaagggcatattgcgcggtacagcataaaggccactcctggcgttcaggattgcctgcacttgtgccttcccggcgtgcccgacacctggaacgagatccttgtggcccagctatagcctgtagctgaatttgaagatgccaagggatacatcgaattgtttatgggtgaagctcgtatatacagtaactaccacggagtactacgtcgttgccagagacccaatgctgctgctggtagtgaagcactgagcagcagtacattctctgcaagaaacaaacaactagccaagagaggagtatccacgcaagaaggcccgcaggatgtacaataaagccaccgcaagagaagatatacgcatggcgcgaagcagaaggtggctgctcaacagatgcttgcaatttgacaaatcttttttagatgacagaacatattggatctttaaaaaagacaattcagattgacacataaatgcaatgacatgatcagaaaaagaaaacagggggatgtgaccagccaaaaacaagccccatatagtatctgatctctagtctggacacatgtcacacatgaatagcacgaactgagtcggggacaatggtttgatgtgacactatactaccattacacaacataacccctacaaatttcgtttcaagtgagaagagtcaacatgccccttaagaatactttgttcagccctactaagaactggaggttgagttatagcaaccaccatgagaccgcgacaagaaacgttggagaaaaatcaaagaaaggaacaaactgggaccaagccctttttgaaaacaaaaggagacagtgaatgcttccacaaatgacaaggtgagctcgtgcaagtataagctcgtttccagcctagtgattgtgtagtccctgagaaaatcaacccaagagaccttccaatcatggatacccagaattaggacactcaacctttatgaagggcatggcaatatgtgacaactctaagaataagctgaggtaataactcttgcagttaatcaacacaatgttatttttcttaatttaggtatgatacagatggcaaaattaatcatctcagtatgaagtggtctgcaaatttaatcacaagcaaaatatagtttaaactttaaaggaacaacactgatctggggcattactacattgactacagagcatccaccacaactcgcatatattttgttttcttaggatatggcacaaaccgatcaacatctattctttccattaccaacagagatggaaccaatattactttgcatttgggaatacaagagagaagatatctgatgcaatctaactctatctaaaagaggaggtagaaagataaaaactatagctaaacatactttgaatcagtacacttttctaacaattagttgcacatgtcaatgactttcacagagatctagttttactgctgctacatcatatgccaactaacaatggaaggtcaaattctttctgaatgtaacttacttgattccaacaggcgcattgagaacaatttatccaaatgcattaaggaatgctccttaaatgggtgggggaaaaagatgtgtagtaaaatcagagaaatgaaaataggaaaaataaacatatcctatataactcacaactaacagtttgattgttgttcggtttcatggaacattatgaggggcaaacagccttcactttcacctaaatttgcaaatgaaacattatgttgtcacctcatggagttccatcaacaaagcaaaatataactaactgatttatgacatgagtcaatagcaatatatagaaaaaataccacaaaaggaatgtccacaagcaagccgctcaatgaaccattgtagtaaaatctaattggatcacctacatctatttttcaaaatttgagcaccatcctgcacaaaagagaataatagcctactgcatgtttgtgcatataattttgtatcaatgttcaaactaatcatactacagaagaagaggttacatctgcttacatgaggagatataatttgttagagaatgttgttttccatgatcgaggatggcacccagaatgcagctatgacatgtactgtattttcagtcattgaaatagttggacgcaaaatcaaattgatatcgttacctgcttcactgttttttagatgccgacaacaaggatgctactatgcttcttttagctgagatactatgctatattagttgagtaaaacatgcaatcatcaatgaatataaactcccctgcttataatgaattaggcttataacagtaaatgataatatgaaggatttacttaacttcagttttcttcaagggtttttattgtgtcatacattgtgcagcttcaagcactacctgtacatgtttcctctaattcatggattcacaaacactatttgtaccttcagaaacaccaattcaaggcttcaggtctaaacttattttcaagaaaaaataccttaattattcacttattttaatgtcacagcaagaaatacaatataaaattcagaagcatattaatggaatggatattgagaaacatgactaaaaatgtaaggacgaacatgaatcggtcgcgctgctcaactacgacacagctggtgtcatcctttagccagcttgttttcagagcttgctgcatggacattgaaatcagaaactgagccaaccatacctgcaccattcatggacacagtacaaccatcaaccatatagcacaactcctttgctaccgtgcagcgaaatttagcattttcaggagccgatgtaggcgacaaatccaactacacaacagataagtcaccactaccactcgcatcaaaaccaccaccaactatatccaaatcgggaacagggggcagaggggatcgaggcactcactgctgcagggcatcgacgtgctccggctctgcccagctccaggttaaagggcaataggactgtataataaaattttgatctaggttaatggttttacgaactactaaattggaagagtgaagtcaagagataacgaaggatagccacacctttacggtctgctctgcagactttctagcatggtcaacatgttccactctcctcaactcattgtacatcttcaaagggaaggtaaccacatcaccaatggcatatactccaggaacacttgtttcaaagaaagctccagtttgcatgaaaattatgagcatgccagatattaaggtataaatagaacaaacttggtagttgagtattattataaaaaaaagaaccaggggcaatgagtgaaaccaaaataaacaagtcattatactatcaaaaccatcacatgccagaaatgcctcaaccatgaatcatttacagtattgtaaagttgtacccttttcttatctgtactaacaattaagagcggtgtgtagaccgccccgcccctgaaaaccacgccccactacaccgaaaccccgcaaaccgcccgccaaccccggcagcccgaccttcgtattcatcgctgccgcaaa

SEQ ID NO: 11 - DNA, 8604 bp, Zea mays
gaacgcctactttgctctcttatagagtagtaaagacttcacctttggatcctttacctttggcttaatgaagagttttacagggaccggcatgcaaaacctaaagtcatatccgcttaaaaaagctagggatccgtgaacagtgtacaggtcaaaacaaaagaaagaacaaaaaaaacggcacacgacgtcaatcactctcactgcctctttccaccctgttgtagactgccctttctgccgatatatacccagcacaggatgccgcgactgatcggtttcccgagctgcacacatgggagcacgcgctcgcactgttcgctcgctacccacctccacacctgccgctctccacactgctgttgtcgaggcgtctttctccgatcgtatgtgccgagctcctcctgcctgcagtctgcctcaccttctgttttgcttgcacttgaatagccaccttctgcttcgtgccatgcgtatatcttctcttgcggtggctttattgtacatcctgcgggccttcttgcgtggatgctcctctcttggctagttgtgtgtttcttgcagaggaatgtagtgttgctcagtgcttcactaccagcagcagcattgggtgtctagcaacgatgtagtactccatgatagttactgtatatacgagtttcacccataaacaattcgatgtatcccttggcatcttcaaattcagctacatgctatagctgggccgcaaggatctcgttccaggtgtcgggcacgtcgggaaggcaccagtgcaggcaatcctgaacgccaggagtggccttgatgctgtaccgtgaaatatgtccttcgtccctcagccgcgacagggcagtgacgtctaggagcctgaccctggtgcccctcacggcgccctccgaacggtcgaggtggacgccgctccctcccttggccagagggctggtgttatcgcagctgcctccggtgtcctagtcctcattgaagaagtgtcggggcgatatcgacctgtagaacgccttcagctcagggtggcggggaggttacgcgtccacccacctgacgacgctgtggacggtgaagttcttggccttccagatgaagccggtgttcctgtcgttgttcggcgctccaccgagatacatctcacacctgttcgccctcagttttccccggttccagtggtggccagtgttgagaaccaggacgaggagcctgtggaggttgctcttcagaaaagcaggcgggcggtccaggtgcatggcgtaactggtcgctcggtctgatgggttcaggggcttcaaatcacagagcgttgatgaccagtggtatagaattgttgtgttggtgctcggaaaccggtaggcccagccgtttggcctttttgcaaccggcgctaacacaaagtcatactatgcgccaacatcttctacatctagcctctcctttccacctgtgaccatacacattatcgactgaaacatctgcctccctagagaatcgcccaggtaagcgatggttttatcctgcattctgaaacatatccggattagtgtttccgtgctgtgctggctcaaagatttagccaaacagcgtggcatacaccatctctaaattcatcagaggttggctatgtagtatgtaccttctaaagaactgggaggcctcaaactctggcatctcacaagctttaggctgtcatctaaatttttcaacgcgaaatatgttcgctgcgttagtttgcaggaccaactctctgaaagtcactgcttacaaccaaacctaagtatagtggtctacgattgtcagaaaaccacttttcattcttgtactcgcattctgtagaacagaaaaacgaacataacatacagattaaagcaagataatctgtgcgccagctaatgcacaagtaaactgaacaaatataatcttctgaattttgtgcaaaggcaatatgagaaatttgtcaatggagaaaacaagcacatttgtatgctcgcaaaataaataaattcatgtttttttagcagccacaaagataagtatacctttattttttgggagcagggcggaggcaattctttccttcttggccggcggcggcatggactgggcagcggcttccgggtctccgtcgtggggcgcgacggcgacagaccccggcccgaccatgctgtccttcgaggggctagacagagggacggagagctcaccgctgcttggttcatagggaaggaaggggaaagggaaattcagacctcttgtcctaccgattctatcccgtcgggaggggtgcgtcgtgctgagataagagctccgcacaccgccgtggattactgccctcctacgcgctcgccttccacagtccacaccgagggccacgcacgagcgactgcacgatggaggctaaggcgtcgagaaagcggaggtgaggttgatacttgggagaactccccagtgatgcatgcaacatggacgaccgaggggagggaggctcgctctgcggtcaggggcatcgccaccgcagcctccgtgccacaggtgcatcgatctggggttcaacttcgagccggcccccacggggtccgtctgcgcgacgtgcggctgtctcaatcgccagctccccgatggcctccttcttcgcgagtctctccattaccagtcgtgatttaatctctcgttcggtagcctttggttcgggcgaagctgtctggcggagagatggaggagaggtgtttgtggatcatccacgagtggggcaagggaagttggcagttgtctcgctgaagggggcggcacctgtctcgggcgagcggggtgccgctactaactcggtggaaggcgtgggtagggtgcggacgacgcaggaaatgcgttgcggttgcggagggagaggtagaacgagagtgagacagaaccaaggagaggcagagtacccttaggttcttaatctctactacttcttaagacgctactgtagacgtccacagtatatattgatgcacggttctgccgagggctccccgcggatccccccaccctccccctctgatccgcgattgcggggaaccgaggccgcaatccggaaggtgccgcagatgctgttgatttcttgccgcggatggaaggtgccgcggatccccacaccctcctccccctctgatctgcgcaccttaaatgtatccgaggccgccatcaacgcgctcctcccccacgacgtcgatggatccgcgcaaaggctttaatgcgagtagccatttagtgtcgccagtcgctacttctttctcgtcttcctctcctgtctcctcgcagttgcgtagaagggtgctggaagaagtttctggttgggagaatccggttgaggttgccatttcccaacttcttccagcagttcggctcggaggcgaactgagatgtcatgttcgtgatcggattgtttttgcaactgcagacagcttgtcgattcgttgcttgaggagcagccatggacagaagaaaccgaccagctccgttggtgagtctctctctctcgtctcctcttcctctcctggattatatatattccttgattatttgcattcatgccatatcgttgggttgctttagttgagcttgagcaggtcgtttggaaatcactgtcgcctccgcttccacgcgacccgcgacgaaatcctggagccgcacctcggcgtcggcggcggaggaggacaagcctgcgaaggacagcatggttgggccagcatccgtcgtcgtcgcgccccacgacggagacccggaagccgttgtccagtccatgccgaccaagaaggaaaggagcgcctctgccctgctcccaaacaagaaaggtataatcatctttgtgactgctagaaaaaccatgaatttatttcttatgcgagcatacaaatgtgcttgtttctccattgacatatttctcatattgcctttgcacaaaatccagaagattattttttatttcagtttacttgtgcattaactagcgaacatgttatcttgttttaatttgtatattatgttcgcttttctgtcctacagaatgtgagtacaggaatgagaagtgggtttctgacaatcgtagaccaatatacttagggtttggttgtaagcagtggctttcagcgagttggtcctgtagactaacccagcgaaaagatttcgcgtatgaaaaattcagatggcagcctgaagcttgtgagatgccagagtttgaggcctcccagatcttgagaaggtacatactacatagccaacctctgattaatttatagatggtgtatgtcacgctgtttggctaaatctttgagtcaacacagcacgacgacactaatccggatatatttcagaatgcaggataaaactatcgcttacgtagacgattctctagggaggcagatgtttcagtcgatgatgtgtatggtcactgatggaaaggagaggctggatgtagaaattgttggcgcagagtatggttgtgttagcaccgagtgcaaaaaggccagacggctgggcctaccgattcccgagcatcaacacaacaattctataccactgatcatcaactccctgtgatttggagcccctcaacccatcagaccgagcggccagttacgccacgcacctggaccgcccgcctgcttttctaaagagcaacctccacaggctactcgtgctggccctcgacaccgaccaccactggaaccgggggaagctgagggcgaacaggtgggagatgtatctcagcagagcgccgaacagcgatagtaacaccgtcgtcatctggaaggccaaaaacttcaccgtccacaacgtcgtcaggtgggtggacgcgcagctcccccaccaccccaagttgaaggcgttctacaggtcgatatcgacccggcacttcttcaatggggactaggacaccggaggcagctgcgacaacaccagccctctggccaatggagggagcggcgtccaccccgaccgttcagaggacaccgacgccgagggcgccgtgagaggcaccaggatcaggctcctggacgtcactgccctgtcgcggctgagggacgaagggcatattgcgcggtacagcataaaggccactcctggcgttcaggattgcctgcacttgtgccttcccggcgtgcccgacacctggaacgagatccttgtggcccagctatagcctgtagctgaatttgaagatgccaagggatacatcgaattgtttatgggtgaagctcgtatatacagtaactaccacggagtactacgtcgttgccagagacccaatgctgctgctggtagtgaagcactgagcagcagtacattctctgcaagaaacaaacaactagccaagagaggagtatccacgcaagaaggcccgcaggatgtacaataaagccaccgcaagagaagatatacgcatggcgcgaagcagaaggtggctgctcaacagatgcttgcaatttgacaaatcttttttagatgacagaacatattggatctttaaaaaagacaattcagattgacacataaatgcaatgacatgatcagaaaaagaaaacagggggatgtgaccagccaaaaacaagccccatatagtatctgatctctagtctggacacatgtcacacatgaatagcacgaactgagtcggggacaatggtttgatgtgacactatactaccattacacaacataacccctacaaatttcgtttcaagtgagaagagtcaacatgccccttaagaatactttgttcagccctactaagaactggaggttgagttatagcaaccaccatgagaccgcgacaagaaacgttggagaaaaatcaaagaaaggaacaaactgggaccaagccctttttgaaaacaaaaggagacagtgaatgcttccacaaatgacaaggtgagctcgtgcaagtataagctcgtttccagcctagtgattgtgtagtccctgagaaaatcaacccaagagaccttccaatcatggatacccagaattaggacactcaacctttatgaagggcatggcaatatgtgacaactctaagaataagctgaggtaataactcttgcagttaatcaacacaatgttatttttcttaatttaggtatgatacagatggcaaaattaatcatctcagtatgaagtggtctgcaaatttaatcacaagcaaaatatagtttaaactttaaaggaacaacactgatctggggcattactacattgactacagagcatccaccacaactcgcatatattttgttttcttaggatatggcacaaaccgatcaacatctattctttccattaccaacagagatggaaccaatattactttgcatttgggaatacaagagagaagatatctgatgcaatctaactctatctaaaagaggaggtagaaagataaaaactatagctaaacatactttgaatcagtacacttttctaacaattagttgcacatgtcaatgactttcacagagatctagttttactgctgctacatcatatgccaactaacaatggaaggtcaaattctttctgaatgtaacttacttgattccaacaggcgcattgagaacaatttatccaaatgcattaaggaatgctccttaaatgggtgggggaaaaagatgtgtagtaaaatcagagaaatgaaaataggaaaaataaacatatcctatataactcacaactaacagtttgattgttgttcggtttcatggaacattatgaggggcaaacagccttcactttcacctaaatttgcaaatgaaacattatgttgtcacctcatggagttccatcaacaaagcaaaatataactaactgatttatgacatgagtcaatagcaatatatagaaaaaataccacaaaaggaatgtccacaagcaagccgctcaatgaaccattgtagtaaaatctaattggatcacctacatctatttttcaaaatttgagcaccatcctgcacaaaagagaataatagcctactgcatgtttgtgcatataattttgtatcaatgttcaaactaatcatactacagaagaagaggttacatctgcttacatgaggagatataatttgttagagaatgttgttttccatgatcgaggatggcacccagaatgcagctatgacatgtactgtattttcagtcattgaaatagttggacgcaaaatcaaattgatatcgttacctgcttcactgttttttagatgccgacaacaaggatgctactatgcttcttttagctgagatactatgctatattagttgagtaaaacatgcaatcatcaatgaatataaactcccctgcttataatgaattaggcttataacagtaaatgataatatgaaggatttacttaacttcagttttcttcaagggtttttattgtgtcatacattgtgcagcttcaagcactacctgtacatgtttcctctaattcatggattcacaaacactatttgtaccttcagaaacaccaattcaaggcttcaggtctaaacttattttcaagaaaaaataccttaattattcacttattttaatgtcacagcaagaaatacaatataaaattcagaagcatattaatggaatggatattgagaaacatgactaaaaatgtaaggacgaacatgaatcggtcgcgctgctcaactacgacacagctggtgtcatcctttagccagcttgttttcagagcttgctgcatggacattgaaatcagaaactgagccaaccatacctgcaccattcatggacacagtacaaccatcaaccatatagcacaactcctttgctaccgtgcagcgaaatttagcattttcaggagccgatgtaggcgacaaatccaactacacaacagataagtcaccactaccactcgcatcaaaaccaccaccaactatatccaaatcgggaacagggggcagaggggatcgaggcactcactgctgcagggcatcgacgtgctccggctctgcccagctccaggttaaagggcaataggactgtataataaaattttgatctaggttaatggttttacgaactactaaattggaagagtgaagtcaagagataacgaaggatagccacacctttacggtctgctctgcagactttctagcatggtcaacatgttccactctcctcaactcattgtacatcttcaaagggaaggtaaccacatcaccaatggcatatactccaggaacacttgtttcaaagaaagctccagtttgcatgaaaattatgagcatgccagatattaaggtataaatagaacaaacttggtagttgagtattattataaaaaaaagaaccaggggcaatgagtgaaaccaaaataaacaagtcattatactatcaaaaccatcacatgccagaaatgcctcaaccatgaatcatttacagtattgtaaagttgtacccttttcttatctgtactaacaattaagagcggtgtgtagaccgccccgcccctgaaaaccacgccccactacaccgaaaccccgcaaaccgcccgccaaccccggcagcccgaccttcgtattcatcgctgccgcaaa

SEQ ID NO: 12 - DNA, 8460 bp, Zea mays
gcgacaacttgtccacggaatgaaggtaaaattttgtcggaattgtggaatgtgtttggaatgtaagatggctgattatactatcctgtccgatatccaggtgaaaaaattgtggttgtattattgcaatagacaaacacttcatttttggaaggcagacatatatagtttatatcataaatagaagggtggcccatgttctcagataatgcaataatcctgcccatcagctctaaatttgcatgtttcactatcttctgcaggatagtggtggtgaacttgctgaagtaaagggcggcattcaggagtgcctaatccaaggtctcaacactgggacgttggatttacaggtcaatggctggggccataaagtaaggctgttatctttaactccaaaagtaaagccatttcctcacaagcacgaatgccatcgtgtgggacctgatcacctctacgcttctttacaaataggctgcactagaaggtgagttaaaggagatctactcagaaaaggtttgggcaaagttcagcggaaactggctgagaacgaccgggcagccacttggtataaggtaagttgaaccacgaatacgagcactatagattttgttcagttttggttgcaaccctcaccctcggtgtcactatgttcactgccatgccagagatactttgatgagccagatggagatgatcccgttgtacttgacatgagctcaatgaaactggtaaattcagttaatacacttataccttggtttccctatgaaatgcaaggataattttgatgaactttcctttgacttccttttgtagatctgccatgcaactttttcttgcccaccatggttttcttctggagaaggaagtttattaattgcattctcgatcctaaccatgatactgtaagttcgaattaagacgtgccttttcattatctgtctcatctctttcatttatctgttgtattcttctttcaaaaaaaatttatctgttgtattgttgtcaccagattacaaccagtgtcactgttatcactgttggataaatgggtgttgtattcttgcagaggataaaaattgcagaaattttggaagatgaatggttcaaaaaaggctataaaccaccacattttgaacaaggcgaagatgttaaccttgacgacattgatgctgcattcaatggttcagaggtattatatagaccaaatgttcattttgaatctacgactatcttgaaaatcttcccagaaatattacgtgcttcaaaagcatttttacattctattttatgttcacattatcattcaggttcatagctgctataatgtgaacttttttgtttcttcgtttttggaagaccaggttgagaaattctaaggacttgatgacacaatagatttcttgttctttttttggctactcaaatgtctcatcgtttaaacaataagctctcatcttgaatccaaacatatcaacagtagaagtcttgaggctggtgcaccttgtgggctgccacaaagttaagatatagtttttttcagtccctaatacatgttatcgtcatgttcattttgcacttaaaaatgatattaattaaaccaatgcatggatagttgaagttgtttttcttcatgttttaccatgttcctatatattactaatagggtcttggtacagagctatcaacaagatagctgatttagtgtcttggtacagtccctaatacatgttgtctgtttatatgttgtgcagccaaatgtgtcagctgagtttcggtctcatattggtggagctgctgtatctgcagcaaaggtgaatgtttctgaacattagtatgtgcttagaagacaaatgtgttgctctcagttcactattgttggttaagatcttttcattatctacctgctaaattttctgcaccaatatagaatgacaaatgcgcaagcaatttgcttcacatgaatgccaattcaaagttatatgtattatctaatggatcattttagtagaatttttttctaataatactcaacagttggcaagctacctaacattttcatgctatctatcataaaacaagtggttctttctttgttttctctgttgatacctttttagcaattattctgtttaatccttctatttcacatatagggtcatttattggattgtttgtgttgaaggcagttggttactacaatgctggaacagtggagtttattgtggacactctggttgcaagagtgtactaattattcgttctgtgtttccaggtcttatttctgatgtaccattattttgctggttctgagatatacaatgcaatccgtgtgttcattgcttgctatgtctggatgactggatttgggaatttatcatattactatatcaagaaagattttagtattgcaagatttgctcaggcgcctatgctacctcatcagtattattttgtgctatgtcctaattagtttagtctcctgtatttcttgttaccgccttttaagcactagaccaataactatactttccatgcagatgatgtggaggttaaatttctttgtggcattctgttgcattgggcatatataatagagcatgagatcattgtcaaggatcacttggtctgtttaacacatacaatgaggtaccatcaatcatggctattaagattgcttgctgcttcttgtctgtaattttgatatgggaaatccctggggtatttgaattattgtggacccctttacgtttctgctaggtaagttattgatgtagttttgtatgacattctacctaccagtcatgctcaggagttcaggaccaaccttaattattttctattcaggctataaagatccatcaccatccaaggcacacttacccctgctacatgagtggcatttccgatctggcctcgatcgatacatatggattattggaatgatttatgcttacttccatcctaatgtaagtatttcagatatggacctatattaccctgatcaccctctgagactgtatcagcgagattttattggatacatctcgatatattttccctaatctctatatatattaagcatcgtttcttttgttcagatcatgctaaccttaacatgtagcttttgacgtaaacaggttgaaagctgtgcaaaactgaacatccaaatccactaggtcaagccttggtgggtatgcaatgcgtcaatgaaaaaaccatttcttcagtcctgtaatgttgttccgattgcgtcaatgaaaaaactataatttttgaccggggagatggtagcactagcatgtggggattaaagttcctaaatgttcagtactgtcctaaacacttgttctatcttttttgagtggatgtccttgaatcattgatggatactttttgttgtatttctgcaatctggttggaagaacaactatgctgtagctgaattagaatattaattttggttaactgactatatcaatatgtctacagaatgggagatgactttgcaatacatcgctgttttaagcgttgggctggtatgtagtacttttgacagatagcttatttgtttgttcaatatggatgcatctgcttcctagaagaaatgcatgcatctggatttctagaaaacaccaatataactcaggacttctagattactgttaactgcaaattattattaattagcaaaatgtggcagcaacacagtttggctgatattctgtttgattctggatagactatctacttgcgattctctacatacgaggacttcgaggatttggagagtaagttaccctgaatctcccaccccattggttttgttgtgcttgtatcagaatatccatttcggctggtttttaagttttagaatcgccgcttgaacgacgaaaagattttacaagtttttctcctgctctcttggcttaggctgttgctgtctccagtaagagtaggcacagacgccttgtcatgggcagctaagaagatagagccaaacaaggtgggcctgccaacgtctccttccacgacggcggtcaaggtgaattaagtaaaaatggtccgtggtccaagtccagccccacaacttggctgtcaggtgatggatttggctcaacactagagatgagtaaacaaaaccttttatgggtggttagccaaatgcaggtcatcatggagcgttatccatgctggtagggctggcttcatcgtcgccttcacgtagggctggctgctgaccatggtcatgatggcgtccattccaccgctcgtcctagcgggcgcggtcatgtacaacgtcgtgactaaaatggcgtccttgggctaggtggcatatgtggatcgatggtggtggagcagaccattggttccatcaagacggtgagcacgcaacccaatccatcccatccttacaatagacacatgacccctccccctgaagcgctctcaacggatccatgtggccatgactgacgaaacctgttgctactaggtgagaaatgggcgatggagaagtacaacaagttcttgaagagcacgtacaagtccgacgtccgagaggggctcgccattgggcttggcatgggcacagtcatgctgctcctcttctgcggctactcgctggtgatttgatatggctctaaggtgatcctggagatggtgtacaccggagccaaggtcacaacatgatctttgtagtcctcactggttctctgtaagttcattatttatttctaagccgcatatagttcagtcctatactttcagtttaacactaggttccatagtttagtcattttcttatttcgtgatatagtagacatgtttacatatttagtgtgattaagcaatcttgagtttctattttcgaccctccgatgttgtggggaatgaactctgcttcagccttgattagactacatattatcatgcaaatttccctgctatagttttttgagcttccaaccaaatctgaaactaatatttctctctatttcttcctattaactggagactgagctatctactaacattcatattgcttttgttatgctctcctgtcccctactttacttactgcagatttgttttcacctgtcgcttcctctaattgtttgcaagaaaagtggctattgtctcactattttctttcaattcagtttctcaaattgaccatggtgttgtaaatttgatcaatgaagaagattcaagaattaccgttttactggattgccatgggatttcgccattcagatttccaatgcaaatgatgaggtcgtttatcactatggttcaagaaaactacccgaatcgtcttggggtattgtttgtcatccgccttcctccagttgtcagagttattgcacagacatttcttcaagtaagataatcattacaccctacttggcatctaatgccattagttcttgtgtgtccacctcgcctgttttatttaggtgatgaatattttaattggcttttcattgtcttgtgatgttgtatagataagataataattagcttttcatgatcttgtttggtcagttatggttagtgggactggtacctgattccttcatgagcatgtctgttgtaaattttgaacctcactatttatctacttcaacttctgtatgatgccaaaattttcctgcaacacttttttttaccaaaattggtaacctaatcaggatacaaaccaaccaaggctgactacaagttaaagatgctctgtaaaaaggaaggatcagtttgactttatcttttgctggtagattgcaatatcacatggtactcatagcttaaattctacacaggtcttgaaaccagctacaaagcagaagttgcgttttgagggagattcgtacaagaaggcattggcggagttcctgcaggctgtgccagcgtttctgggcggtaaatgcagctgcctgcgatgtgagagtcctcgtgatgattcagtgatacaggcaggggaagggagcaagaagcagccccgcttggtcagcgttgatgacgggtcacctgtcacagacttggacttcgacttggatgaagaagagatcccatcaccttatagctgcgagaacgccatcagggctgcgataatcggcctgctgatggtgtgcatcttcgtcgcgtttctggctgggatgatcgaccctgcatccattccagccagtgcctgagagcttgtggaatagagcatgcacgtacatgtgttgctaattaggatgcagggtgctgtatttcttggcaggcttcttgtatgttgttgtcagacgccatagagcgctttctcctagaaaggaaggtatatgcgtatctgccatttatataaaaagcaaatattgtaacatttgcagctgctaccgtccttaaaccagcaccgaataagtggactaattgttaacttacgtagcgaagcacggacacataactagtagtttataaagcaataaacaatcaccagaaaagccaccgcttggcagcaacaagactctcttgttaacctgacttctaacagacgacaacattaccatcgaacgacgacgcgacaacttctcagttcaagcgtttggccgagcacttggcaggcgctgcacggacttcacccgcatttttatccaactctaggatcactcttcgggtgagggtgacgaagtcgacgacgagcaccatggagggatcgacgctgctgctgcggaagtcgtacgattattggttccggcgtttcgtcgaacatctagcggacgctgtactagggctgcttctcttcaccaatcctcgtggatttctcctctgaaatctaacagaggatcaatccacgggtgatttacgggtcgatatagggctgtggcagtcatggcgatgggagcagggacgactgctagcgcgcatacctcattgcaacgcaggcagggacgtcatgatggagctgcaaggacaagaccgaggatgggcgtggcgctgaggaaaacatcgaccaggtcacagcgagtcgacgttgtagcagggaccgacggagaactcccgtgctgagtacaacgaacaacgacgtcgaggcgaagattggagacggcagccgggtgaggcgagcccgcggcggctggcgtgctcgaccaccacggacgcgactggggagggagcaggaggccggggcggcatccctggcagcgcagggccgacgacggagctgagaacgatgggcgcaggcgaccagcactgaggaacaacggcgaggtcgagtctggggcaagctcacacagctgctagcgggatcgcacagagaggaatacccagggcgttgatcgaagagggcgcggtcgagccacacgacggcgtccagcgtacttgtgcaggaatgagcagctggggaagaagctgggtgatccaagcgctggtgaggggcgagctgtaggagggagcagggagaacgccgtggagaagtagctgatggaggctgagcaacatcctttctggaagacgatgggtgacgagagaaaaaaaaaatcaggtgaggcggtgctgaagcatctgacgtttggagagaaggacgcgtgggaatgtagctggtgtgaggaagaaaatcttccaggtgagcggctacaagttaatgaagagaggggttttgttttttttatcagagaatacatcactaaccgagtttagaagttaaatacgactacaatatatcgaattaaatgaaaatttgattttaggactaagatttgaggggtctaaaagatgtataaaagggtcaagccaaaaatgatattgacaacaatatttaaaatggattgatatggtgaatactcttggagtcacatgaacttttagcagttatttatatccaaagatttagaactagcaagaaatatacagaccgaatcaaacgagatcgacattggtattttagactgtatttaatcctgtcaaatttttacgagtctcacctgctatcagtcatttgactaaagaacaattcaattattgagctggcgcattgtttttatcggacaacatgtgggctccaaattttacattaaatccgatgttttctgatttttatattcacttgcacgcgtgatccgaacagctcaaaattcgccaacaaatgagattaggtaaccccaaagttcatgaaacctttttaattgtttaaattatggagatgaatacgacaccgaacttgagcttttgagagatggttgaattccaaatttgtattcgcttaatcgataaattttaattaggcacacgactcaataattcaaaagattaactgaagtctgaatttcatgaatttttttggtagtatagattcatggagagagatacgatatcaaaatcatgatagacaaaaataattcgaacttagtgacctttatattcaccaacatctcgtgcttaaatccatactcgttgtcgcacatgaaaaaacacctgaggtgttac

SEQ ID NO: 13 - DNA, 7840 bp, Zea mays
gagaacgaccgggcagccacttggtataaggtaagttgaaccacgaatacgagcactatagattttgttcagttttggttgcaaccctcaccctcggtgtcactatgttcactgccatgccagagatactttgatgagccagatggagatgatcccgttgtacttgacatgagctcaatgaaactggtaaattcagttaatacacttataccttggtttccctatgaaatgcaaggataattttgatgaactttcctttgacttccttttgtagatctgccatgcaactttttcttgcccaccatggttttcttctggagaaggaagtttattaattgcattctcgatcctaaccatgatactgtaagttcgaattaagacgtgccttttcattatctgtctcatctctttcatttatctgttgtattcttctttcaaaaaaaatttatctgttgtattgttgtcaccagattacaaccagtgtcactgttatcactgttggataaatgggtgttgtattcttgcagaggataaaaattgcagaaattttggaagatgaatggttcaaaaaaggctataaaccaccacattttgaacaaggcgaagatgttaaccttgacgacattgatgctgcattcaatggttcagaggtattatatagaccaaatgttcattttgaatctacgactatcttgaaaatcttcccagaaatattacgtgcttcaaaagcatttttacattctattttatgttcacattatcattcaggttcatagctgctataatgtgaacttttttgtttcttcgtttttggaagaccaggttgagaaattctaaggacttgatgacacaatagatttcttgttctttttttggctactcaaatgtctcatcgtttaaacaataagctctcatcttgaatccaaacatatcaacagtagaagtcttgaggctggtgcaccttgtgggctgccacaaagttaagatatagtttttttcagtccctaatacatgttatcgtcatgttcattttgcacttaaaaatgatattaattaaaccaatgcatggatagttgaagttgtttttcttcatgttttaccatgttcctatatattactaatagggtcttggtacagagctatcaacaagatagctgatttagtgtcttggtacagtccctaatacatgttgtctgtttatatgttgtgcagccaaatgtgtcagctgagtttcggtctcatattggtggagctgctgtatctgcagcaaaggtgaatgtttctgaacattagtatgtgcttagaagacaaatgtgttgctctcagttcactattgttggttaagatcttttcattatctacctgctaaattttctgcaccaatatagaatgacaaatgcgcaagcaatttgcttcacatgaatgccaattcaaagttatatgtattatctaatggatcattttagtagaatttttttctaataatactcaacagttggcaagctacctaacattttcatgctatctatcataaaacaagtggttctttctttgttttctctgttgatacctttttagcaattattctgtttaatccttctatttcacatatagggtcatttattggattgtttgtgttgaaggcagttggttactacaatgctggaacagtggagtttattgtggacactctggttgcaagagtgtactaattattcgttctgtgtttccaggtcttatttctgatgtaccattattttgctggttctgagatatacaatgcaatccgtgtgttcattgcttgctatgtctggatgactggatttgggaatttatcatattactatatcaagaaagattttagtattgcaagatttgctcaggcgcctatgctacctcatcagtattattttgtgctatgtcctaattagtttagtctcctgtatttcttgttaccgccttttaagcactagaccaataactatactttccatgcagatgatgtggaggttaaatttctttgtggcattctgttgcattgggcatatataatagagcatgagatcattgtcaaggatcacttggtctgtttaacacatacaatgaggtaccatcaatcatggctattaagattgcttgctgcttcttgtctgtaattttgatatgggaaatccctggggtatttgaattattgtggacccctttacgtttctgctaggtaagttattgatgtagttttgtatgacattctacctaccagtcatgctcaggagttcaggaccaaccttaattattttctattcaggctataaagatccatcaccatccaaggcacacttacccctgctacatgagtggcatttccgatctggcctcgatcgatacatatggattattggaatgatttatgcttacttccatcctaatgtaagtatttcagatatggacctatattaccctgatcaccctctgagactgtatcagcgagattttattggatacatctcgatatattttccctaatctctatatatattaagcatcgtttcttttgttcagatcatgctaaccttaacatgtagcttttgacgtaaacaggttgaaagctgtgcaaaactgaacatccaaatccactaggtcaagccttggtgggtatgcaatgcgtcaatgaaaaaaccatttcttcagtcctgtaatgttgttccgattgcgtcaatgaaaaaactataatttttgaccggggagatggtagcactagcatgtggggattaaagttcctaaatgttcagtactgtcctaaacacttgttctatcttttttgagtggatgtccttgaatcattgatggatactttttgttgtatttctgcaatctggttggaagaacaactatgctgtagctgaattagaatattaattttggttaactgactatatcaatatgtctacagaatgggagatgactttgcaatacatcgctgttttaagcgttgggctggtatgtagtacttttgacagatagcttatttgtttgttcaatatggatgcatctgcttcctagaagaaatgcatgcatctggatttctagaaaacaccaatataactcaggacttctagattactgttaactgcaaattattattaattagcaaaatgtggcagcaacacagtttggctgatattctgtttgattctggatagactatctacttgcgattctctacatacgaggacttcgaggatttggagagtaagttaccctgaatctcccaccccattggttttgttgtgcttgtatcagaatatccatttcggctggtttttaagttttagaatcgccgcttgaacgacgaaaagattttacaagtttttctcctgctctcttggcttaggctgttgctgtctccagtaagagtaggcacagacgccttgtcatgggcagctaagaagatagagccaaacaaggtgggcctgccaacgtctccttccacgacggcggtcaaggtgaattaagtaaaaatggtccgtggtccaagtccagccccacaacttggctgtcaggtgatggatttggctcaacactagagatgagtaaacaaaaccttttatgggtggttagccaaatgcaggtcatcatggagcgttatccatgctggtagggctggcttcatcgtcgccttcacgtagggctggctgctgaccatggtcatgatggcgtccattccaccgctcgtcctagcgggcgcggtcatgtacaacgtcgtgactaaaatggcgtccttgggctaggtggcatatgtggatcgatggtggtggagcagaccattggttccatcaagacggtgagcacgcaacccaatccatcccatccttacaatagacacatgacccctccccctgaagcgctctcaacggatccatgtggccatgactgacgaaacctgttgctactaggtgagaaatgggcgatggagaagtacaacaagttcttgaagagcacgtacaagtccgacgtccgagaggggctcgccattgggcttggcatgggcacagtcatgctgctcctcttctgcggctactcgctggtgatttgatatggctctaaggtgatcctggagatggtgtacaccggagccaaggtcacaacatgatctttgtagtcctcactggttctctgtaagttcattatttatttctaagccgcatatagttcagtcctatactttcagtttaacactaggttccatagtttagtcattttcttatttcgtgatatagtagacatgtttacatatttagtgtgattaagcaatcttgagtttctattttcgaccctccgatgttgtggggaatgaactctgcttcagccttgattagactacatattatcatgcaaatttccctgctatagttttttgagcttccaaccaaatctgaaactaatatttctctctatttcttcctattaactggagactgagctatctactaacattcatattgcttttgttatgctctcctgtcccctactttacttactgcagatttgttttcacctgtcgcttcctctaattgtttgcaagaaaagtggctattgtctcactattttctttcaattcagtttctcaaattgaccatggtgttgtaaatttgatcaatgaagaagattcaagaattaccgttttactggattgccatgggatttcgccattcagatttccaatgcaaatgatgaggtcgtttatcactatggttcaagaaaactacccgaatcgtcttggggtattgtttgtcatccgccttcctccagttgtcagagttattgcacagacatttcttcaagtaagataatcattacaccctacttggcatctaatgccattagttcttgtgtgtccacctcgcctgttttatttaggtgatgaatattttaattggcttttcattgtcttgtgatgttgtatagataagataataattagcttttcatgatcttgtttggtcagttatggttagtgggactggtacctgattccttcatgagcatgtctgttgtaaattttgaacctcactatttatctacttcaacttctgtatgatgccaaaattttcctgcaacacttttttttaccaaaattggtaacctaatcaggatacaaaccaaccaaggctgactacaagttaaagatgctctgtaaaaaggaaggatcagtttgactttatcttttgctggtagattgcaatatcacatggtactcatagcttaaattctacacaggtcttgaaaccagctacaaagcagaagttgcgttttgagggagattcgtacaagaaggcattggcggagttcctgcaggctgtgccagcgtttctgggcggtaaatgcagctgcctgcgatgtgagagtcctcgtgatgattcagtgatacaggcaggggaagggagcaagaagcagccccgcttggtcagcgttgatgacgggtcacctgtcacagacttggacttcgacttggatgaagaagagatcccatcaccttatagctgcgagaacgccatcagggcttggataatcggcctgctgatggtgtgcatcttcgtcgcgtttctggctgggatgatcgaccctgcatccattccagccagtgcctgagagcttgtggaatagagcatgcacgtacatgtgttgctaattaggatgcagggtgctgtatttcttggcaggcttcttgtatgttgttgtcagacgccatagagcgctttctcctagaaaggaaggtatatgcgtatctgccatttatataaaaagcaaatattgtaacatttgcagctgctaccgtccttaaaccagcaccgaataagtggactaattgttaacttacgtagcgaagcacggacacataactagtagtttataaagcaataaacaatcaccagaaaagccaccgcttggcagcaacaagactctcttgttaacctgacttctaacagacgacaacattaccatcgaacgacgacgcgacaacttctcagttcaagcgtttggccgagcacttggcaggcgctgcacggacttcacccgcatttttatccaactctaggatcactcttcgggtgagggtgacgaagtcgacgacgagcaccatggagggatcgacgctgctgctgcggaagtcgtacgattattggttccggcgtttcgtcgaacatctagcggacgctgtactagggctgcttctcttcaccaatcctcgtggatttctcctctgaaatctaacagaggatcaatccacgggtgatttacgggtcgatatagggctgtggcagtcatggcgatgggagcagggacgactgctagcgcgcatacctcattgcaacgcaggcagggacgtcatgatggagctgcaaggacaagaccgaggatgggcgtggcgctgaggaaaacatcgaccaggtcacagcgagtcgacgttgtagcagggaccgacggagaactcccgtgctgagtacaacgaacaacgacgtcgaggcgaagattggagacggcagccgggtgaggcgagcccgcggcggctggcgtgctcgaccaccacggacgcgactggggagggagcaggaggccggggcggcatccctggcagcgcagggccgacgacggagctgagaacgatgggcgcaggcgaccagcactgaggaacaacggcgaggtcgagtctggggcaagctcacacagctgctagcgggatcgcacagagaggaatacccagggcgttgatcgaagagggcgcggtcgagccacacgacggcgtccagcgtacttgtgcaggaatgagcagctggggaagaagctgggtgatccaagcgctggtgaggggcgagctgtaggagggagcagggagaacgccgtggagaagtagctgatggaggctgagcaacatcctttctggaagacgatgggtgacgagagaaaaaaaaaatcaggtgaggcggtgctgaagcatctgccgtttggagagaaggacgcgtgggaatgtagctggtgtgaggaagaaaatcttccaggtgagcggctacaagttaatgaagagaggggttttgttttttttatcagagaatacatcactaaccgagtttagaagttaaatacgactacaatatatcgaattaaatgaaaatttgattttaggactaagatttgaggggtctaaaagatgtataaaaggggtcgtacaaaaataagatcgacaacaatatttggataggatttattttgatgaatactttggagccagatgaattttcacctgttatttatatccgaagttttggatccgggcaagaattgacggcccgaataagattgatttcgtcttcgataatttgctccgtaagattcgactaaaattagccgaaaccatatgtgctaatgcatacatgattccttcgtcgccaaaacagcgtgctgaaggataatttggatcctaacctcgcgtaagatttcgcgcgagtcgaattattttactccgaacatttcagttgtcgagttcaaatgaatttgtccgggataaaatcatccaaatgagtcgagcttctgaattcgtattcacgcgagcgatgaattttaaataatcaccggacgcactgattttcggaacagctatgttccgaacatcacaaaaatttcagaagagcccgaatagatagaaataaaaacgatgccgaactcgcgattgacgagacagttgcgatattaaaatcgcgagaggcgaagatgtttagagtttagcatctgttttatccactgatataacgtgcttaaatccgtactcgttgtcgagcggaat

SEQ ID NO: 14 - DNA, 6926 bp, Zea mays
tactcctcagcgcctcggcaggtgtcgtcgggcccgaccccagcggaggttgaggcgatgaggcgccaggtggagaggaaggtggttatggacgagacgcaggcgcagcggtgccagggctcgtcgtcctcgcaagcaccggcgccgagaccagcaatgcaagataaggcgcccggtccgttggcacccgcagggagcccgttgtcgatcccagcgcagtctccggcgttctttcaggcgcctgcggtacgaccggccatgcaagcgaagccaccgggtcaggtcgcacaggcagcgagttcatcgtcgtcgttcccaatgctcgcgacggctcaggcgcctaggcccgggcgacctgccactgccctgcaagggaagccgccggggcaggtcacacaggcagcgagttcgtcgtcgtcgttcccaatgctcgcgacggttcaggcgcctacgcccgggcgacccgccactgccctgcatgggaagccgccgggtcaggtcgtaccggcagcgatcccatcatcgttcccagcgccggcgccggttcagggctctacgcccgggcgaccggccatgcaagcgaagccgccgggtcatgtcgcaccggcagcgagttcatcggagcgacctctgcaaatgcaagggaaggtgccggatcaaatggcgctttcggcgcctgcaggtacactgcctccagcttcgagcaaggcgatggtgttcccccctcggccggggtacggaaccgtcgggcggaggtgccaggtgcgcgccaaccatgtagaagtcaagctcggggacaaggatatctaccactacgatgtacgtacgcacggcccctatctgtgtcttggtgtgttattcttggcttcagcgccttgcaaatagtaatccaacaaaaccctacatgtttcaagaaaggaaccacaaatatcatcataatttgcatccctaacaagttcaagcggtatatgtttttgtttcgcaggtgacaatcaaaccggaatcgacctcaagggcaagaaatagatggatcatcaaggagctcgttaacttgtacaagcaacacttggacgggcggcggcctgtttatgatggaagaaaaagcttgttcacggcaggtccactgccattccaatccaaagagttcgttctcatgctaacaaaccatgagagaggaaaacaagggtgtgtttgaatcccttaccatccaatcaagctctatgcaatccccattatgtttatatatgtgtgtttatttgacaacttgcagcgagaaagagtataaggtggcaatcaaggatgctgcaagaattgatatgtacagccttaaaatgttcttggctggcaggaatcgggatctgccacaaaacactatccaggctctggatatcgctttgagagaattcccaacttctgagtaatacatccacacactcatgcaaaagctagggcgtgaagtgtgatgcatcatatattcatatttatcagccacttatgaactttatatgaatgttttaaattgtttacttcaactccggtggcaggtatacaccgatctcaaaatcgtttttctcacgaaaggaatttggagatggtcagtctctaggaaatggtgtggaatgctggaggggttactaccagagcctacgccctacacagatgggcttgtcacttaatataggtagagttgtgtcttgtgcagttgtgcctaatgcttcctgcctttattgttttcttttgatgtatatgtattgtaacttttgcattgacctatagctacaaacttgccttgaatcgctttcaaaatgcctgcttctgaattacaaagaatcttttcgtatatttaaagtcccttctatacctttatcaatagatatgctagtttttgttatcatgctaaatgttagtctttgtactgtatgaatacactacaaaatatttgaactccaaagtgtagctagtgcctggttgaacatttttctaacaaactggcacagacagtgcccgtttctaataaagaaggcagcaggccgggttaacaacaacacacatcacgccccatgtcaacaaaactctacaacaccactgtccactacagcaatcaccacacaagccatgtgaagtattttaaccaaccatgcaaagcattttattcacttcaaaatctaatttctgaataaatcaagtaatcaacaatgtgatcagattagcttgtgttattaaagcagtaataatttatagcatatttttcctttttcctgcttactgtaacaatagggttttatgtattttgagttataacacatctctaatctgatgagctccatgcatgttgttaattgtgttattatttattaaagatatgttcgttgttgaaaaccttacttctgattttgatgaaatttatatttcctcacagatgtttcggcaacgtcattttacaaggctcaacctgttattgacttcgtagtggaatatctgaaccttcgtgatacttcaaaacgtatttctgatcaggatcgcataaaagtatggactatatagcatttatcttaccatactcattttattatctgtatgattatttcaccacgcatcatgatgagttcttttttttgcaaaacagctgaagaaagcacttaagatggtctgggttgcaaccaaccatatgcaagataaatgcattcactacaggattacggggctaacctcaactccattaaaggatttgacgtatctattctactatatatcttgttgcattccatttatgcaatcacattatatctttcttattgtgcatacaggtttgatcaagaaggcacaagggtgtcagttgtgcattactttaaacaacgatataactactacttacaatacactcactggccatgccttcaagctggccgtgttgacaagcagatctatttacctatagaggttgcacttttatgtttttttatttgccaattcgataactctaacctttttttggacaactatttgcatgaataaatatatcaacctcctagatatatcaatttattcacatgttattatatcatttatacttatgcaggtttgcagcatagttcagggacaacgctactccagtaagctgaatgagaatcaagtcaggaacatcctgcagtttacctgcgagcgaccagcagataggcaaactagaacttttgaggtggatagtcactaagcctatccgtgatgtcactttgtagtttgtacctttttgtgtatatgttttttattttttcaagttttctttaagtgaatactttgtgtgcattctcaggtattcaagaattacaaatctgatggatcaacttatgcagaagaatttggccttacgttgatggatcaacttaccttggttgatgctcgagtgctcccagctccaagggtaaatgtgtttcttatttttgagtatgaaagaacataagtgttttagttaccatctaacaatcaaacaatatttttagcttaaataccatgattctggaagagagaaggtttgcaacccttccatcggacagtggaacatgattaacaaggtatcatgtcttgttcttctaatcttgtctaccatacttggtttagttgactatttggttggtaatacttgtatattttctagttgcgtcaacaaatgaaacaattatgtaacgactgcaaagaatctattagatctgtagtctctctctatatacacacatgctattcgtcacttacgtgaagcttcaccaaggtataattactgaaagtcgatcaatcattaccataaaatgactgagcgatcttcagtaattatatcttggtgaagtttcacctaggtgacgaatagcgctgccctatatatatatattattttggaatatttggtgaaattttcagagaatggttgatggaggatctatcaaatattgggcatgtataactttcgcctctcgtttgaatctgaatgacgttgtgatgttttgcgaggctcttgttggcatgtgcaataacattggcatggtaagtctatctcgatggcacttctcacaccatcaaatttggtggttaaaagtaaatttacatgtttttgtagcaaatgtgtaccagaccgtgtgtagaaatcaggaaagcacaccaagacaaattagaagccgaaatcaggggtatccattcgcgttctgcgcaagtgcttgctcaacaaggtctaacagcgaaacaactagagttactcatcataattctgcctgatatgagtggtttttatggtaagttgtttaaatcgatcttcaagctgaagattcttcgatattttaattaaccttttccatattaaaatataatttcttgaattttacctaatctgtaggaagaataaaacgagtttgtgaaactgagcttggtttaatcactcagtgctgcgcacctaagaatgtaaggaaaggagggaatcagtaccttgagaatctttccttgaaaatcaacgtaaaggtagggcgaagctttttaagtgctatgttactgtctacttcaatatcaggttgaaagaattatgatatcatttcattttccaattaggttggtggccggaacacaatgcttgaagatgctttcaaccggagaataccgcttctgacagattgtccgacaatagtctttggagctgatgttacgcacccatctgctggggaaagttcatctccatctattgcagcagtatggattctctctgggtttcactattttctttgtcttactcttggcttttagttttcatttggacagacacactactaattgaatgtatttgtttttggtagttgtagaatcttgttaatttatttggtttcaatgttatacctccttttgaagtattctttttggacagatctttagtaacatgagtttttaaaatgaaaatgcatgtcatttccaatcttgtgctactaattctttaaaacttctgctgcagatgatgcatgctgtgtttgtgatttaaatgtattctaattcatatccatttaggtggttgcatcaatggattggccacaagttacaaagtacaaatgcttggtgtcttcacaaggtcaaagggttgaaattataaatgacctttatacagaagtggaagatccacagaagggcattgttaaaggtggaatgattaggttagttaagacagattagtattttgtttttttgttgttgtaggaatgctgacatttatgtattgcagagatttgcttatgtcattcttcaagtcaactggccaaaagccttcgaggattatattctatcggtttgtagagatggtttcatacttttacttgtcttttgtttgatacttatatggcagatcttccatttttgcagtgatggtgttagtgaggggcagttcagccaagtcttgctttatgaaatagatgccattcggaaggtcattcctgctgaacctgctttagtcatttccatctcctgcatttgatggctactctacttgacatgcatgttgtttgtgatcgttctgccaggcatgtgcaagtttacaggataattatctcccaagggtcacatttgttgttgtgcaaaagcggcatcatacccgcctgtttcctgaaaatcatcgttcacgagatcaaacagacaggagtggaaacatcctgcctggtatgcaagtcgcatagctgctaggcagcagtaaatattgatatgcgttattatttaaaagtatcaagtcttgtgaacctactttgaagtttcaagtaaaccttgtcatcaggaactgttgttgatacgaagatctgccaccccagcgagtttgatttttacctctgtagccattctggtattaaggtatatatactgcattatgaatcatgcttatcagcctagtccttactgcggattgtcgagtagtaatttgcacaatattaaaatattattcgatttttttggtcttgcacaggggacaagccgcccagctcattatcatgttcttctggacgaaaatggtttcagtgctgatgcactgcagaccttgacttataatctttgctacacgtaagcttcattgatgatgtttcctcaatttgcataaaatatgtaccattttgccatggttgaccttttttttgtcatatttattgatgtcttacttgctcgcaggtatgcccggtgcactcgttcagtctctataggtgagcactaatgcagttattacaaattacagtaactgtttgttcatcagtcaaattttctcttgaattttatgtcttttttcggctttgcttaaaaattgtttccgcttttcgtattgaataacagttcctccggcatactacgcacacttgggtgcgttccgtgcccgttattacattgaggacgacagttctgatcagggctcattgactgtggcaactcagacggatgatcaatctgtcatagtgaagcaactccccaagatcaaggagtatgttcagcagttcatgttctattgctaaagctggagtgtattccaaatagttcctgaaaagcgtgcatgcgacatttttcttggattgatctatgatgtcgtaactgtgaactcactcactcttttgtctgtttcgttccatcatcatgcttaactgattcgaaacggaatccttttgcttttctgaaatgcatggttctggttgctgcattaagatgtctagagcctttgggtctactttgtctgagcggcaggtcgcctccacgctgccttgagcctcgttaaggcccagccgggtaaaatcgtatgcgtggtgcttgttggcagagtagaacctcacagtctggtttatatcctcactgtcggaaacttaaccgatggcaggttagcagtgaactggaaccgtactgttgtggttgcttgaatccgtcagtgttgttaatgc

SEQ ID NO: 15 - DNA, 6045 bp, Zea mays
tacatcaatctctctgaccgttccgcccgcttctttgaattttgcaatcaggctgtcagccttatgctcgaactgaccataaccagcgcccggcagtgaagcccagatattgctgcaacggtcgattgcctgacggatatcaccacgatcaatcataggtaaagcgccacgctccttaatctgctgcaatgccacagcgtcctgacttttcggagagaagtctttcaggccaagctgcttgcggtaggcatcccaccaacgggaaagaagctggtagcgtccggcgcctgttgatttgagttttgggtttagcgtgacaagtttgcgagggtgatcggagtaatcagtaaatagctctccgcctacaatgacgtcataaccatgatttctggttttctgacgtccgttatcagttccctccgaccacgccagcatatcgaggaacgccttacgttgattattgatttctaccatcttctactccggcttttttagcagcgaagcgtttgataagctaaccaatcgagtcagtaccgatgtagccgataaacacgctcgttatataagcgagattgctacttagtccggcgaagtcgagaaggtcacgaatgaactaggcgataatggcgcacatcgttgcgtcgattactgtttttgtaaacgcaccgccattatatctgccgcgaaggtacgccattgcaaacgcaaggattgccccgatgccttgttcctttgccgcgagaatggcggccaacaggtcatgtttttctggcatcttcatgtcttacccccaataaggggatttgctctatttaattaggaataaggtcgattactgatagaacaaatccaggctactgtgtttagtaatcagatttgttcgtgaccgatatgcacgggcaaaacggcaggaggttgttagcgcgacctcctgccacccgctttcacgaaggtcatgtgtaaaaggccgcagcgtaactattactaatgaattcaggacagacagtggctacggctcagtttgggttgtgctgttgctgggcggcgatgacgcctgtacgcatttggtgatccggttctgcttccggtattcgcttaattcagcacaacggaaagagcactggctaaccaggctcgccgactcttcacgattatcgactcaatgctcttacctgttgtgcagatataaaaaatcccgaaaccgttatgcaggctctaactattacctgcgaactgtttcgggattgcattttgcagacctctctgcctgcgatggttggagttccagacgatacgtcgaagtgaccaactaggcggaatcggtagtaagcgccgcctcttttcatctcactaccacaacgagcgaattaacccatcgttgagtcaaatttacccaattttattcaataagtcaatatcatgccgttaatatgttgccatccgtggcaatcatgctgctaacgtgtgaccgcattcaaaatgttgtctgcgattgactcttctttgtggcattgcaccaccagagcgtcatacagcggcttaacagtgcgtgaccaggtgggttgggtaaggtttgggattagcatcgtcacagcgcgatatgctgcgcttgctggcatccttgaatagccgacgcctttgcatcttccgcactctttctcgacaactctcccccacagctctgttttggcaatatcaaccgcacggcctgtaccatggcaatctctgcatcttgcccccggcgtcgcggcactacggcaataatccgcataagcgaatgttgcgagcacttgcagtacctttgccttagtatttccttcaagctttgccacaccacggtatttccccgataccttgtgtgcaaattgcatcagatagttgatagccttttgtttgtcgttctggctgagttcgtgcttaccgcagaatgcagccataccgaatccggcttgtgattgcgccatccccatagcagccatcacatcagtaccggaaagagagtcagaagccgtggcccgtggtgagtcgctcatcatcgggctttttggcgaatgaaatttagctacgctttcgagtctcatgcgccttctccctgtacctgaatcaatgttaggtttccgcagaacactgcgccggtatcgatatacatttggttggcaaacttgagtggtttcactgctggcgtatgaccaaagatgaacgtgtccgcgcctttgatttctttcacgatcccgttttgtgagttgctgattcgttcgcggttccagattacctgctgatgatcaactggctttccaaactcgtattcgtcaaagggataatcggcgtggcagataacatattttttatctttgctcaccagttcgatgattaacggaagttcatctgctttatgggcaagagctttagccagaatttctttgtcgtaatcgagattaaagaaccagccaccgccattaagcagccagtgattaacgtttccacgctctgataagccatcaatcatcatttgctcatggtttccacgtacagctctgaaccaggggaatgtgattaattccaggcattcaacgttctctgcaccacgatcaaccaaatcgcccaccgagataagcaggtcttttttgttgtcgaatccaatcgtatccagtttgttcatcaggttcgtgtagcatccgtgcagatcgccaactacccaaatatttcggtatttgctgccatcaattttttcgtaatagcgcatctctttcactccatccgcgatgaaccatgagaacgtcgttgacgatggcgtgcattttcccgtctttatcatcaacgtattttctgaccgtaccgcgactacatttcagtctgcgtgctacttctgtctgatttccgtatgcttcaacgagcatgtctggaatggtttttactgagaacgtcatgcggcctcacttctgctatttcgcaggtctttgagtttctgttggtactctgccttgatcgccttgcactcttcgatagtccagcgatggcggttatggtttgattcgatttcgtctactgcttcctgcccgatgcggctaatcagttcgacgcgatacggaacgagatttccgcttttgtgctggttgcacaccacgcattgcttgtgaatattgcgttcattaaatcggagttgaggtgccgcagcagttgtccggtaatgtccggcatcccactgagcagacgtgagcgttccgcacgagatacatggtaagtcgcggtctctttctctgatgaaggcgtttacggcttgttgggcttgtttaatccagtaactgcggggctttaaggcgagttttcgaatcttaagtttatctttctgtttctgctcctctcgtcgtcgtttcttctctgctgctttttccgctttttcgcgttctttacttcgtcgttcgagtgctatcttggttccacactctggagagcaccaccactgattagcgaatgcagggtgaaaccattcccggcattcatcgtttttacatcgtcttcgcgctggtttagccatcatcttcttcctcgtgcatcgagctattcggatcgctcatcagttctgcgcagcagtgctcacacacgtgaacttccagcacatgcagcttctgaccgcagttagcgcacgttaaagctcgctcgacgctttcttgttcgtaacttcgattttggtcaatcaccttgttttcctcgcacgacgtcttagccaccggatatcccacaggtgagccgtgtagttgaaggtttttacgtcagattcttttgggattggcttgggtttatttctggtgcgtttcgttggaaggtatttgcagttttcgcagattatgtcggtgatacttcgtcgctgtctcgccacacgtcctccttttcctgcggtagtggtaacacccctgttggtgttctttcacaccggagacaccatcgattccagtaaggttgatttggtcggaagcggttatcttctttgcattcaccgcaccgataacatcgcatcatgcagcttccctcccgaagtcgaaatcaagctgccctccaaatatttcgcatgactcagaacaagagccggtatcgaatcttttagctcgtaccatgtcctgatacagggcttgataatcattttctgaatacattttcgcgataccgtccagcgacattcttcctcggtacataatctcctttggcgtttcccgatgtccgtcacgcacatgggatcccgtgatgacctcattaaaaacacgctgcaatccctcctcatctttgcaggcaagtccgattttttgcgttgattttttaatgcagaatatgcagttaccgagatgttccggtatttgcaaatcgaatggttgttgcttccaccatgcgaggatatcttccttctcaaagtctgacagttcagcaagatatctgattccaggctttggctttagccgcttcggttcatcagctctgatgccaatccacgtggtgtaattccctcgcccgaaatggtcatcacagtatttggtgaagggaacgagttttaatctgtcagtgcagaacgcgccgccgacgtatggagtgccatatttctttaccatatcgataaatggcttcagaacaggcattcgcgtctgaatatcctttggttcccataccgtataaccatttggctgtccaagctccgggttgatatcaacctgcaatacggtgagcggtatatcccagaacttcacaacttccctgacaaaccgatatgtcattggatgttcacaacctgtatccatgaaaacgtaatgcacgtctttacctgcccgtcgcttttgctccattagccagagcaaatatgctgacgtcctgccaccggagaaactaacgacatttatcatgcagccctgtctccccatctcgctttccactccagagccagtctcgcttcgtctgaccacttaacgccacgctctgtaccgaatgcctgtataagctctaatagctccgcaaattcgcctacacgcatcctgctggttgactggcctattaccacaaagccattcccggcaaggttaggaacaacatcctgctgctttaatgctgcggtaaacacacacttccagctttctgcatccagccagcgaccatgccattcaacctgacgagagacgtcacctaagcaggcccatagcttcctgttttggtctaagctgcggttgcgttcctgaatggttactacgattggtttggttgggtctggaaggatttgctgtactgcgtgaatagcgttttgctgatgtgctggagatcgaatttcaaaggttagttttttcatgacttccctctcccccaaataaaaaggcctgcgattaccagcaggcctgttattagctcagtaatgtagatggtcatcttttaactccaaccatatcaaccagctcgctgacgtttggcagtccggcggtaacggatgcttcttcccggcaccatgcaacaaactgcccgggtgatggcagaaatggtcgattctgccgacgggctacgcgcattcctgcgttaacctgttccatcgtggtgatcccgttttcccgaaaagccagaacccactggcgacggatttcgttcacttcgttctggtcacggttagccaggctcgccgggaaagttgccagtaactggctgaacacaccgttgatgatctgcgctacctgctgtacctgcggcttttcgtcgtactgttccggcatgttgttggcgatccgacgcatctgctcacggtcaaagttaaccatctgtgcggcgatgtttttcatagatccaccccgtaaatccagtctgtgtttgtcaggtcgagttttggtttgctggctgtcacgcctgcctgttgcttgttacggttgatttcgagttgggtccacttatcgcggagtttggccgggctcagcacgttaccggaccagaagttgtcgcggccgcttctatagtgtcacctaaatactagtgactccagcgtaactggactggccacagttaggccgcaaatgtaatcacactggc

SEQ ID NO: 16 - DNA, 6729 bp, Zea mays
caaatcaagagcttatccgtggcctatgctgctctgcctggcttctaattcttaaacgatctcttcaccggaactcgtaaaagatagggctcctccaggcctagagcaacgatcgactcatctgttgaatttcattcatttctgtgcattgctttttgtttaggaatggggatccggagtcttcatttgaggcaaagagtagttcttgttttggattaagctggtagaaattcgaatcataagatttgcatgatttgtaatgtaatttggcccaggctgattcctctttctatttatcttgggcttaaccccgcttctcttcaaaaccgaggtattccccgtagataatttaagccaaggcttaggcgtagagctcaacaaagacagtctaggctcaaaaataaaaagtcaagtcaggatatggaatatgagtgggccgccaaggcaagacttctattctcccaactcctgagaactaataacaggatgaaaccggagaccaataggcgggcatcttaccaatagatctacggaaaaactagctagatccggagaaactagctagctatatgataaccggagaaaaagagagttgtctttctctttaccagattcccgagtgagagtccgctctggccccagggtagatatggacattgccaatcccataggcagatggaaacttattcattcgagaactctccaccaacggaagatatggaaatgcacgatacaacacttagcccttagcccgagaaagagatctgaatatagatagtggaatacttccctccgaaatccaaaaagtgccacgacttcctaaacccacctttcaagttgcgatacaggaatagttcgatttcgaagaatggcttgagcgagtcctttccaattccaatttgaatttctcttaattaatacgttctcctaattaatacgattctctttactcctttactctatgataaattacagtaattagcgaatggtccggacttgtccgaacggcactaatcaaatatcagttcccagctcgcgcggagacggggtcccactttaaagagtgtgtatagtttttaaaggtacctcggttgtttagaagaggccctgctggtgaacatcattattcctttcttgaaatccttaatccggtcaatatatctcggatagagctgcaaatcaaagcaaatacagttctacgtctctttatttgtgagttctctttccaccacccactacccacgccacgttctgccagcggtccggcgtgtccttgtcgtatgtcgctagtgccctctcgaacaacttgttctgcttcgtcgtccatgatgaactcatggttcgatttctctcaatatatgttcaaggaaaagtttaaggtgttctgtaatggctgcaactgctactactttagctataaggtcactggctagcttgtgtttgtatgcaagaagagggagggacaatgcccaaatgggaagctttactggactctgaccttcaaataaggtgctgctaactactaatattagtaatcctcataggcaaaatataccagaaagactacttgaagaatacaaaacaaggcactaggcagccctcccgacgagcatttctttgcccttcagcccatagccatgtcctgaatgagtggtatcaccaacttgcattgaggaatactgcgcataacaaaaagctgcaatgccggggcattttcacgtacattgatggaatgtctgttggagacatggtgcacagcacaatatgcaccatcagctgcagcccaataccacgaattatctgtacgatgattccaatttctaaaagcaggatcatattttggaatcacaatgcagattattgtacctcaaaggtaggatgaatgtcaatagaatacatctagcttcctacctttacttgtcttctctttacttgactagccgttacttcaacccgaaacgaagcaatacttctgctacaaaaggcaacaattacttgttacttattcctctattggtttctcaaaactagacataatgacaccaaaacgaaccgccatccgagtatgggctagattgactttcgatttacagaactgctacatcttttttgctttgatgccggtgtgaatctacccacatttcttatctaggccagtgctttccataaaacaacagtctgaggaatcaaagatcctaatagaagtagaagatggctattgcgctaaggttgacgtgagagaatatactacagatgaatacctcgtctatataaatccaacctgcaagaagtgacacaaaaaagaaagatgaactaccggagatacgaatcacaaacgcgcgagcagtttgagcgttatcttaatgatgtgcataaatgctatcgtggtgaaccgcgatatgtaatgtcgtatgaggggcacgtcattgcggtacaagactttgaggagccctatcctaaagcaggggcggttaccatgcttgcttcagcatttatggaattgttaataaatagggtttacccatcaatccagggttccgctaagttcacactccaatatcgattgaatatagacggtaatcccattaatattactttatcaaaagcaattaagcttacatatgctgatggtactcgcattgctaatgagttcatattaaaagaaataataaatgtgttgaataagtacacagaaaagtaccaaagttgcgatgttgaagcaatcagtgtcagggcttattcagagggtagtatagatttgaatcaagcttcaattccaactaaagatgaatctttgaactatctgaagggagcacttattaaatacagcgacataaataatttacaaatacccaagatgggtcgacgttcaaaaagacgctatcagtcatatatccctgtcgataaaacagaaattaaaaacaaaactatattttttgttgctgatctagaaactcttttattaaaaagacgagacggatgtcgacaaaactcacgtgccctacgcagggggtaaggaccatattacgacgttctatgcacatgactactcaaaagtagtattagggaagactctttaacttatcttaaacaagatattgtaataacagctattgttatgcaacgcgctaaagccattatttgggaagagtatgtgattgatatccgtaaagtattaacaatatcagcattggccctaaaaatatttagacgtgtctactataaggatgatgatgataatcggatctacatttctgacgataatgaggctcaatttattagggaaggctactaaggtggtcacatggacgtgtataagccatacggggagaatttgtattattatgatgtaaattctctatacccctcatctatgctagatgatatgcctataggcaagacccgctcgtttagtgatctaggatcaaagaaatcaaagattgtgttgaatgatatgtttgggttcattagatcttttataatttgtcctaagcatattaaaaagccttttctaccttataaaaatgatgatggtacgataatcttacccactgggagatttctcagtgtttatttttctgaggagcttaattagtatgcagtaagtttgggctacaaagtatacccgatctgtggatatatttttgatagaaaggaatcaccattcaagtgtattgtgtatgacatctacagcaaaaggcttgatgctaaggctaaaggggtgaaagctctggatttcatctataaaataaccatgaacagtctctacgggatcagcccagaaagcacatcgagtcaaattgtttatacagaaaaaagtagaaaattagctctccataatgatgggtttgttcaaagttatgagcttagttcagacaagtccctagtaacatgcaaaaatgtcagaagtttggtttggatttactgaagcttagttcagaccgccctacttatgctgctgttcaaatctccgccgctgtcacgggttatgcccgcataagaatgcacccattcatttagagggatgactgctattacacggatacggactcagtcgttgttgagagggaacttcctgaagaagaggtatcacctaccgctttgggtaagtttaagcatgagcactttgtcgaatatggcatctttttagcacctaagtcctatatgcttaaggtatctagtgtggaccaacccataataaagtttaaaggagcgggtaaagatgaggctgatgaagaatggttcatcaaccagctggctgaccctagggttaaaaaagtgatttcatatgtccgaaagttcagtagaaacttccgtgaactgttggttcaagagaaaatgtgtaagtataccatggggttagaaagtaaaaagagggagtatgtgttcgacgaaaatggagtatgggttgatactaagccctgccatataggtgactttgatgcgaaaagtatcaatccggcctcctatcggataattctgaatttgttagaggagaatgaagatctccaaaatgcattttctaattcggaaatcatgattgctaatcagaagattaaagctgatgctgctaaaaagaggaaagcctctaagagggggagacaccccttctcatattgaaaaataggcatggaatgcattcccgagctctatagtatagaccattgctgaaagtcttatatattaaacgataataaatcatatagggatttccgcagataaacttcaatgagttgttcacactgtatactaattgattagcatcgccctaatccctagtttttttctacaacccgagtcaagtgtgcttttttcgccaataacatgctaaaagcaggagcctttgaggctggcaacccttacttgtatcactaaaggcagtcattactcatatcactaaaggcaagatttacaactctctaaaatagaggaataaacctagcaacctatcaagtccacttggcaatacccttcaggcatcaagcgaggttccactcatcttttctgttcattgcagttctgttctttaagttgcttagctttacttagcttgtcattgctttgcagtgataccccatttcagaaacaatatacgaatcaacaattacaactgcttctcaagctaataccaaatagagcccgaaaccactcaactaaagcacaagctgaaaccaacgaacctgtgcaggctaggccacctttactagtcagctacaaaacagaggaatagtgaggcatcttcccggaaaccagatatggtccaacctttcacttacaagagtcaagccaaggagaaggctaaacccatttctatatctgatccgccaggtcatgtcatgtcttgtgtcaaacagatattggtattcgtatggtatgggcttttatgagccaacactagcctagtaactgatgtcataataagaaaaactagatgaactaggctgggcaaaccagacaacaatgagatcctgggccttccctaggaacgaatggaatctccttttgctagaaggagccgattgttattatactaaaatactggagtttacttgccttgccagtacttgcctttctaatctgttagtttccaatccgttctaatccgttagtatcctttcctttagggagatgatcagcccatcactttctggattagggctcgcctttgaagtttatcacttctcactagtattgatgctaggtaccctgtcttagacaacgtagtagacttgcaggggtgtcccattctgcatctcaatactaaagctaccattcaaagatagcaaaatccctgactgagcaggctgtagctttgaggcaacaactgtgctcagagggcaccattgatcagtccagtcgccacggaatgtccctgaggctacatggcttgtacttcagaccccaggcctacatgcgccccgaagttcagaacatgttcgtgcttaagccctaatatgagctgaccattgctgctctatattgagcacactctaaggcattagttttcaccagaaccctcacaaccagaatccttagtacacgaccatgcatgagtttaacgagcctcaagagtgcataccgcattgagtggattccttactgcatatgtgtaagaatacaatacatcatatgtgtaatggattcaactcgaaccctcccggttcactacctatttaagggtagttggcttgtgtttggtgtcgtggcaaccgacaacactacccattagttgtgatctttggtgattgtcttgtacagcacagtacagacgaagatcaatacatcggattccttcttgtttgattggaagggatggattgtgctttggctcatgtaccctataagggttagtaaaccagggaatgcctttgattatctttttactttctataagggtcttgttatgtcctttgtctctctctctgctctataagggtcttgtttagtggtatactctttgatccttactctatttactacgcaaataaattgttcatttagaaagaggcagggaaaccggtgaaaatgaagaatctgggttcgccattcggcatggttcttttggtcgatgaatcgaatcttccatccaatacgctaggctagtttctttccacaactctcgttctttacacgactgattggctgcttggcctgtagtagggatctggttcactgctttaggtattagtactatggcattcaacctaaatggtttcaattccaaccagt

SEQ ID NO: 17 - DNA, 6623 bp, Zea mays
aagacatgtatatttagaagcttctgacatttgccattggaagatgctggattttttcacttctgtccatgggatctataactcctcattttggcacttcatttcagcaacatatttacagcattcgagggaggatactggaaaccatattaagcctgaggtttttcattttccaattcggagttgtttaccacatgaatgctagcggaggaagtacagctttattggtatgttagtgtttcagttcccattttcttgttgacgtagatgttctgaataatagtagtaaattaatccttggccctgcaggtgtattggatttcttgggctgtgcttggtggccttttcatcctcctcttggtaatatatttctttgttgttacatttggcacctgctgagcagggcactcattatgttaatttgtattactatgcaggtctttggtttaaaccccaaggccatggtacatttccaattgttcctgcgtttggtcaaaagtgtagcgttattgatggttttggctgctctggtcctggcaattttgtttacgaaactcagtgtgagagatgtttttgcttccattctagcatttgtgccaactgggtggggaatcatttcggtgagcttctaatgccagctttcatattcatgaaatgatgaccatatgttgatttgccttttctttttgttcattccgcaaacgcttcacagttccattgcatccttattatatatttctgttcagtgcattagcttttctcttgaccagtcaattcttctcatcgttttcatctcttttgcactcgacattgtagaggttggctaaaattttacgatttgtcttttttttccacagattgccatggcatggaaacctgtcgtgaagaaattgggtttgtggaaaactgttcgtgccctagctcgcctctatgatgctggaatggggatggtcattttcatacccatagccatttgctcgtggtttccattcatatccactttccagacgcgacttctgttcaaccaggcgttcagcagaggtttggagatatctctgatccttgctggcaacaatccaaatgctgggatctgatggtggcagttccggccttgcttcattaatctgtggacctttcgtacttgaattaatcctcacttctcagttaacagtagcgatgtacatatctgatatctctatgttcaccggagttgtttgccgtgggtataaatatcaacggctatatttctagagttcaccggcttgtacctgtatttttgaacgggtgaactttgtatggcccttcttttgacattgacatgtgctgattacgtggaaaaattgcttttttaggtcgcttcgaacttcgtttttagcaggatacttcagtatccacatgtttttcccgaaatcccggatgggcttgagtaattatttttctagcaacttttctaaaaatataaaaactatgttttcatgacaagtattaatgcctccttggtaagaacataagccagatgatggaacgaggagccctaggatgtagatgaacacaacatgagcagccctaggatgtagatgaacacaacatgagcgattcggcggatttggattccttttttatatatctactcatgtggtactcatcatacgattcatataggatctatctgtctagagattgttatatacgtctagaaagttgtatgctcttgaagaagcttgtaaagtttgggaaggggtttttaaattgatataagatctatatctgtctagagatagttatatacatctagaaagttgtatgctttggaagaagcttgtacagtttgggaaggggttttttgagaaaaaagaagaatctacttcaaccgatatgcccttgggcacgaccatacataacatagaaatcacacgtggaaggggtgggcaattagctagagctgcaggtgctatagcgaaactgattgcaaaagagggtaaattggccactttaagattaccatctaaggaggtccgtttggtatcccaaaacatcttagcaacagtcggacaagtgggtaatgttggggtgaaccaaaaaagtttgggtagagccggatctaagtgttggctaggtaaacgccccgtagtaagaggggtagttatgaaccctgtggaccacccccatgggggtggtgaagggaaatcccccattggtagaaaaaaacccacaaccccttggggttatcctgcgcttggaagaagaactaggaaaaggaaaaaatatagtgatagttttattctgcgtcgccgtaaggtaagtaaatacgtaactaggaatatggaaaattgcatttttggaatttgcaataatgcgatgggcgaacgacaggaattgaacccgcgcatggtggattcacaatccactgccttgatccacttggctacatccgccccttatccagctaaaggattttctcttttttccattcattattattctatttattctgacctccatacctcgatcgagatagtggacataggatgccactctttaaaatgaaaaaaaggagtaatcagctgtgacacgaaaaaaaacgaatccttttgtagctcgtcatttattggcaaaaatcgaaaaggtcaatatgaaggaggagaaagaaataatagtaacgtggtcccgggcatctagcattctacccgcaatggttggccatacaatcgcgattcataatggaaaagaacatatacctatttacataacaaatcctatggtaggtcgcaaattgggggaattcgtgcctactcggcatttcacgagttatgaaagtacaagaaaggatactaaatctcgtcgttaattgaattcagaatagaaagattcagaataaacaaagaaatacccaatatcctgttggaacaagatattgggtatttccggctttccttccttcaaaaattcctatatgtttaggagaaaaaccttatccattaaggtaaggaacttcaagagcagctaggtctagagggaagttgtgagcattacgttcgtgcattacctccataccaagattagcacggttgatgatatcagcccaagtattaataacgcgaccttggctatcaactacagattggttgaaattgaaaccatttaggttgaatgccatagtactaatacctaaagcagtgaaccagatccctactacaggccaagcagccaagaagaagtgtaaagaacgagaattgttgaaactagcatattggaagattaatcgaccaaaataaccgtgagcagccacaatattataagtctcttcttcctgaccaaatttgtaaccctcattagcagactcattttcagtggtttccctgatcaaactagaggttaccaaggaaccatgcatagcactgaatagggaaccgccgaatacaccagctacacctaacatgtgaaatggatgcataaggatgttgtgctctgcctggaatacaatcataaagttgaaagtaccagatattcctaaaggcataccatcagagaaacttccttgaccaatagggtaaatcaagaaaacagcagtagcagctgcaacaggagctgaatatgcaacagcaatccaagggcgcatacccagacggaaactaagttcccactcacgacccatataacaagctacaccaagtaagaagtgtagaacaattagctcataaggaccgccattgtataaccattcatcaacagatgcagcttcccaaattgggtaaaaatgcaatccgatcgccgcagaagtaggaataatagcaccagagataatattgtttccataaagtaaagaaccagaaacaggctcacgaataccatcaatatctactggaggagcagcgatgaaggcgataataaatacggaagttgcggtcaataaggtagggatcatcaaaacaccgaaccatccaatgtaaagacggttttcggtgctagttatccagttgcagaagcgaccccacaggcttgtactttcgcgtctctctaaaattgcagtcatggtaagatcttggtttattcaaattgcaaggactcccaagcacacgtattaactagaaagaaaatagataatagaaggcttgttatttaacagtataacatagtctatataccaatgtcaaccaagccagccccaacgattggattttcgtataacttcatttaccaaatccaaaaatttgggaaattaagttagtaaaaatgaaaaactcagattgctcttttctattttccatatgggttgcccgggactcgaacccggaactagtcggatggagtagataattcttccttgttacaatagaaaaaacccctccccaaatcgtgcttgcatttttcattgcacacgactttccctatgtggaaatagccaatttctattccgaagaggaagtccactaattttgagaatttttaattagttaaagtgattcacctactatggaacatttcagaatggaaaatgtgcaagttttatcttgatatcgatcttttctagtttattaattttgtctaatgattaattaagagtaagaggattcaccaggtcattgatacggataatatccaaataccaaatacgctcactgtgtgatccatggaaagaaaagtgaattgttttggtgaacatcaaagaaaaaacttgctcttcttccgtaaaaaattcttctaaaaataccgaacccaatcgttgcataaaagttcgtaccgtacttttatgtttacgagctaaagttctagcacatgaaagtcgaagtatatattttagtcgatacaaagtctgttttttcgaagatccactatgataatgaaaaatatttctacatatccgaccaaaacgatcaagaatatcccaatctgataaatcagtccaaacgggtttactaataggatgccccgatccagtacaaaattgagcttttgataaggatccgacaaggggagttgcaaggactgtggtatcgaattttttcattcgagtatctattagaaaagaattctccagcatttgattccttactaacaaagtatttattggtacacttgaaaggtaccccagaaaatcgaagcaagagtttgttaattggtttagacgaatcctttgtggttgagtccaaaaagagaaaaaatattgcgagaaattgacaaggtaagatttccatttcttcttcaaaagaagagtgccttttgatgcaagaattgcctttccttgatatcgaacataatgcataagaggatccataaagaaccatatggttttccgaaaaaaccccgggtacattacaccaaaatgttccatcttcccagaaaagatgattcgttccagaaaggttccagaagatgttaatcgtaagcaagaagattgtttatgaagaaacaacaagaaaaattcatattctgatacataagagttatataggaatcgaaatagtcttttattttcttttttcaaaagaaaaatggatttcattgaagtaataaaactattccaattcgaataatagtggagaaagaatcgcaataaatgcaaagagggaacatcttgaatccggtattcaaggagttgaaccaggatttctaaatggataggatagggtatttttatatgtgatagataatgtaaatgcaaaaatttgtcttctaaaaagggaaatattgaatgaatagattgtaaattttgaaaatttggtatttctttttcttccggacaagatagttgccctagcgagagtgggatttctacaacgatcgcaaacccctcagatagaatctgagaataaaactcagaataaaaataattacggtgatccaacaatcgatcttggttaggataattaaccgaattaattaaaaaattctgctgatacattcgaataattaaacgtttcacaagtagtgaactaaatttcttgttattacaaccaaaaatttccacgggttcggaaccatttaatccataatcatgagcaaatgcataaatatattcctgaaagagaagtgggtagacgaagtagtgttgacgagatttctgtttttctgaatacccttcgaatttttccatttgtatttctacttgaaatagagaaaaaaagcatttctcggtttatcaaatgatgatacatagtgcaatatggtcagaacaaggtgttgcataatacaaacccaggaaagaaagggagtctaatccatagaactttttccactccttttctatctaattagtttatgtttgttctaattataaaacaaacaagaacaaatcttttatttttgcaggccaatcgctcttttgactttggaatacagtctctttatcaatatactgtttcttttacacattcaattcataacatctcttttcaatccataatcaagaataattaggatttctaaaaaaaaaaagtaaagggtccattcataggaaaacctaacctttccccacattaggcactaatctatttttaacgtctaattagatcggggaatccttccaattaaccaattaagaagttaagctcgttgctttttttttattttaccagaattagagccaggctctatccatttattcactagacccagaaaatcag

SEQ ID NO: 18 - DNA, 6399 bp, Zea mays
cttatagagggggtagagataagatgtgaaccttaatgaatctaattgtttattttctttacgaaatttatcttgttttgtattttaccatagcattagcacggacacactactagtgtgagaaacagtgtagaacatacaaaacttaaattttatggtctgtatcactgtatgcataaatcccagatggaaacattgcattttactgatgcaatttcatgtgctacataaacactataacactcagatggggagatgacatttttttaattattcaatttactgatttatgcatgaaatcccagctggaaaataattcaagtcgatctttatggcagaaacaccacaaatggtatatgtaaccatgtcataccagccggttgatctagaaacctgtaccagtactagtatagctatatggattatatgaaaattccaattgccaaactattgctttatagtagatctttgtacaaaaactagctaattctgttcaacatgtctatcaaattgacaattaatctcatctttacgtttggaggatgtagcatcaaggtatttattatcaacattaaataaagctgtttcaaaagtttccaattattatcatactcaacactgtggccctttgctttcctgtttctagtaggatattaagtttctgccaggtcaattgaaggcaacaaaatgttaaaatggtccgcaaagatatgaaagtgcagcatacatactcttttgagaacgctgaccctatcatgcaaactgtccagagcttgatcattctcatgctcatgaatttcacgagaagaataagctggagctctcaccccaccttcttcaatgccatcaaataaagcagctctatggctacggaagtccctgcaaataataaaaatggataaatgacatcattaccattttgctaacaaccaaagcagtgcaattatctactggttgtctgtacttccaatgactgcagaaggaatataggacaaagtagccatttttcatggcatccgcctattcttttctcagttctgtataaaatagggcactttgtagatgtctagtctcatatcttatgtatcttgtcaaatttaacatagatggcaagtaaccacaccttttgcttagatcattaatggagaaaaggtaactttatacaaagtcattatcacaaagccgatatgaaattgacaggaaagagtggtaaattggaaaattaaggatgaggtacaatctaatgaggaaactggaaggctgtatgcaagcacttgctagttgctgctctgttaattttcttgaattacgattagactgcaattcaccaattacacagaacgaatgcagagcaattgcagtaggtaagttaaactaccagtagaccaagacctggcacagtgacagtcttaattagtaagcctgtgcaattagatagtatcgccattggcttgcaaaatgactagtgttgggaaatcatgacaaactaatgaaaacaacatttacaaacattgccacaactgaatgtaacaatgtatttgcatgtaaaacaaaagaacaggaatagacaagcttaacttagtaaggggatgaaacagaagattattatatcctacacaactgcgatctaggaccagaaaacaaaaatacagcatttagctttgaattagttcaatgaaaatgacatacgactaaaacttgtctggctgccctggagaagggatcatacatgatggtcaatatttttcgtggatgtgcatatttcataagtggctcaggcagcacagaattcaaaagtaatcaatacatgcaaggaaccgaagaatcaaaatcaatacatgatggcggtcgattaatggaaccgaagaaacaacccaggcctagggtaaaactaaaatgaggactatccatcagaattcaaaactgccaaaaaaaaaactcctcatggtcatggtttgacagaactgactgctaaagtggggcttcaagaggggtaaatggcattgaattcgtaattccgggaaaccaaccactggtaccgggaaattagctgaggcgtcacaagaacaatgggatttacttcaccaggcacaaagggacaagcgggggcgcagcagatagtactcagcaggtcaggtattggaagctgggtaacaggatccaccgtatggtgcaacgaacggtataaactacacagatttgcatggggaaaattgttcggcaccaatacggcaataccacattacttcgcgtaaaaaaacgccacattcctaaacacgcaagctcacgttatgacatgaacctgtaaaaaaaaggcggaatagttcgttctacccactaataacagtcgagatagatagatatgtcctggggattgctcgctagggttgagctattaaggatcctgaccttctcgagttcatcggacgcgaccttcactggccgaagagttctcacgggtgcggagaagccgacggagcctgcctgccggtgtgggtgggcggcgagatctgatgaaagcttgatgcgcctcctccgtccttctggagcaagaccacgcaaatggggttggagtcagtgggcccaaatcgtaaccgatattgggcgggcgggcggacctgcgacacctgccttccggttttcgggttgggtggcaaccgtggcatgcacactactgctacagatgggcccatcgcctgtcggttacggcccatttcaatcaattggagaagatcagaagaagttccatttctgcgcggcgaatcgcccgccttggcttccggcgatggacgccgccgggtggcgggtagggggagccctctcgcgtccaagcaacgcagtctccagccccgatgccctaacgagatttccgctccaccaggtaacgcgcgacctcaggctgtctagcagcaggtgcaaaatacgagccattggcaattttgccattatcatttgtgggcttcgtcagtatgctatcggacccacaaatcatagacacagacggtcctaccagtcatagacacgggatggcataataacagacagtcaaatttgagagtggcaaaacagcaaatttctcgcaaaatactgtagatagcattttgaaataagaggtgagataggaaatatgatagaagagctgctggaggtagcttcactcttacggtggcattgctgtccaatgatgctgtgttggtgctagtttgacatcggctacgcccaacacatgctcgacaatatacttcatcagacacgtatatagtatggcacattgacatgtcctgtttggtacaactgctgtttgcagtttgttggaaaagcagctgagaagctcgtgaaaagcagcttgcttattatttgcccttagttcatcagaagtgtttttatttggtataacttctgtttaaatttataaagaagctatgaaataggtgtgccaaacagggtatgaacttcagtgtctgacaactagatgtctatcattgcctgcgtcttattgtggtcgaccctgcttagcatggagaagctgcttatgcgctgttcagcatatgacctgctgtgaaacgagactccctccctcaaaatctgtaacttagttgggtgacttttcaataagaaacaatcaaaacagcttatcctgggtgatatacggcttgctctgatagagtgtttaatggattgtttgaatgcactagagctaatacttagttggctaaaaatttgttagtggaattagctggctaacaaatagctagtcaactattagctaatttgttaaaagtaactaatatctttcccctactggacgagtttttttttttaaaaaagtagctaatatctgaaccattaactagaatgtttagatttctttaactaattttagcagttaattattaactctagtgcattcaaagaggccctaaatactaaaaataacccacaaaaagaccagactaaataatacattatgggttattgctgtaggtaagactgaacgagaagtgaagttgacatttaatataaacacgaatttcactgatcctattactactagtttacagggttttatagtttacatatgaagagactttcgtcagaaaagaaaaacttgagtctgcttttagttcccctttcttcaggttcacataatgttcttgattttttgagtccatactttattaccaccattgttatctttttgggaaaaacgagagagataagcaatggctaaatatacttgcttacagagttaaacagatgttcagtacaagcactaaaattacaattatacactcaagaaccttttggtctccacataacagactgaaatgcaataccgttacggtctatttcgtttcaatcttctatttatctgcaccaaatgatgtgtttcttattgaacaattccaatttaattcttctgcaggaatcatcatgaagaaactaggatttctaaactacaaaagtgcagtttgaagttttagttatgagtacatcaacacacagcttcttcagtaactcaatgcccatgctagaaaacttgattgacatctgtaaggtattgttaccaaaactattcaaacttgtacaataactatcaaattcctcgttttgtcaagcattgtccagatatgcaaaggctactgattgaagctcatcaatatcatgatacccactcccttgcgtggtccaagaaggattgctgttgttgtagtagtcaggcatgcatatatctggctcataaccttcagaatgttgagttgacgttgatgtgaagcaatcgtttgcaaagtataactgcctctcactctttactgaagaattgtttgccattgttggttggtaaaagagctgcccgtcttgaatataaggtgctaatctttcacagttttctttctgagggtttgatgtcaaggacccatctccacatccttgtattgctagagctttgaaagactctagttctgcttgcagcctgaccacctatgaaatttcacaaatagtacactttgtaaatgttgatttctttgcagtgtgaattattatgattgagagacctttttaaataatctagaatactataaatttatgcattgttaaaaaataacgaagtagcggtctcataataagataggaagatatgtttattatatcatcacacttagtggatagctcttagctgcatttatgaaattatatgatactccaaaactttttcatgttatagttaagtttgttgtaagtgttatttcctatgagtctacagattgactgctcgagtgacatttaccctttctatattgaatgtgaaccaaacacatcatttatgcataactttatttttggaaatgagtgctaatgtagaatcttgttacctgttgttgcagagaaaagatgtgagcaacacagccatatattggatcttgaagcctggcttgcgcctcatatgacatagtgactgcagcctcgcaacggtcacttattggcagatgcattaggagctttgaggcattgctagccccaaagaccttatggatagcagcaaagtgcgcagccccgtgctcatgacagaaatatggagcgaagacacaccccttcacacacttcctgcgtaggaacttgcacgcaccacatggtgagccaaggcctgtcatcttgggtcttcttcttggtgctgttgttagtcttatactcttattcttactctttgatgtgaatgctatgaatcatggggtcatcattctctgctatttatagagactagcttatgctgtgagtaactcagtatattgaataattaatttatcttggtctccctagtggactacaagttcaattattttaatcatggttgttccactctgaattctgcttcagattccttccagagtggttaaatgacaaacgatgtaacactccaaattacttataattttcttgttgattgtttattagttgataaactttacattcatctcccggactagggactatgcaggagtggtagttgccatttcatcaagaggatggaaaaaataagagagaggctgagacatctccctgaacacccattttctgataaactttactcatatccaagttatgtcttaatcttacttccttctgctagttcagtaaggacagaaatatcaaaatctgctgaacattttttttcatatgttgttgtcatctctaagtacatgcttagaagcttggcattttgtccccgagatgcatcacttatgattagattagaattagataatcacttcgcataaagtttgtgtaccacctatatggctaaacgggtggacctctcatgatatttattctaccctactaggctgcctagaccatcacaattcacaaatattagctttactcaatgtcgctattttt

SEQ ID NO: 19 - DNA, 6230 bp, Zea mays
acaccccaggtgtttatattccgctcgacaacgagtatggatttaagcacgtgatatcagtaaataaaacggacactaaattttaatcatcttgcaaaagttcgagtttggtgccgttttcatttcgataatttacacaattaaaaagggttcgagaaacttttggattatcgaatcttcgtttgctggcgaattttgaactgtttggatcgcgcgcgtaagtgaatacgaaaatcagaagacttctgattttatgtaaatttggagccccgcgctatccgaaaagaacaatgcgcacagcttctcgcccacatgtgcaatgtgtgacgtcgcttccggaaaggatcgcactttcgatgacgcatcgatctcgcgtacttatttcgcgaaatgtgagtctcgtgtctatttaaaaattatggattaagagaaaatgagattggaaatttagttcagctctccaatttcataccaaacagatttgatataactcaacgactaagttttttgtgtaaaataatttagtcctcttttgtcatccgtgacatcgcgtctatggatttttaattaaattgttctctaattgagtgttcgaatagcgaacggaatttgtctaaaatcaactgaatcaaatgcagattgaaataccgaagccgaatccgtttaatttagtctgttgcttttcgcctcgatttaaatcttcaaaagtgaattaacagtacgaatttatccgagttcagagaattcgccaaatcaaatcgaatccaaggatttataattgagatctgattctgtaataaattctctatggtagagaaatcccatttctctcttatcctctacgtgcttatcccttctgtttcctagccgtaagttaatttctttggaaattttatccatcgctcatctccttgctttctccttacacgagcatttcttgggagttaagcagctgatcaggatttctccacgttatcttctccttatccccaccgctccttctctctcctctcgatatttcctgcgcgcgccgctcggctctggtgaaagaaaatcccgccgcccctgttgatcttttcagccgtcgcgggataaaaattgcgcgcacccggccagagctcctgcgcgccttcttctctgctggctcggccccttccccgcgcgctcgtgctcagcctccggtggaatctcctcgccgtctcctgctgcgctcggaccgcgcccctggcttcccatgcccccccccctcccccggctctgttgccgcgcgcaaccgcgcttctcccagcctccatgcgctagcgcgcgtcgttctccctgcgctcgctcggccttgaagctccctgacgcgcgctcctgtgccatggtcgccgtggagcttccccagccgcgccctgctcgcccctgttttcctttctctctctcccctgtgcgcagctcgccgagctctccctctcccatggcgcgctctgctctctgcgcgcagtgtgcacgtcgcgatctcccaagcttgccatggctgccgcatccatggtcctgctcagatttcgccaagccccagtgcccggctgctcggctcctcaacggcgacgatggtcgcgctcgcccagctcgcagagctcccttgtcgtggtcgtcgcgtccctgcgcccagcctctagctcagtccctgtgcgcgcgagctcgccggtgtgctgctgttctaactcggatctcgcccatgaccgccggtgttcgccctcttgcgtcgcgcagcggcccatcctgctcaccgtgaccgagcggtcgccctggtgtccttcccaagccaactcgccctgcgctgacgcagggttcagctcagccctgtccttcacgctccctactcgtcctcgactctctggtgtggactccctccgtcggcgatctcctctggcaccagctcgcgcgtctgctcgtcgtcaccgcgacgcggacgttctctgttcgcttcgccacagcacccagacctcctcttctgtgtcatcgacactagtctcgcagtccctccttcgatcttgctgatcgtcgatgcgttgcacatgtatggcaaggtaaagtcagctagctattggaacggtgagccgatttactatttttactattgattttactatcgtcaaataacatgcttagtttgcgtataaagtttaagttaaagatgccaccgatgcaaggtgtgcctcgaggagtttagttgttgagtatattcgaactagttttattttgcagagtatagtatttcggtaacgcttaggttaaattcagtattttatgcaactgtcgataaatctgcgatgctaattatgttcagtgcgcataagatgaagtcaatgtcctgcgctagtagttagtatcgtctatgtttgtgatcgataatgttggagtaggatatgatcgacgattttcttatctagtgattggtgtgatgatatattgtataaaatatgcttggtaaaaatatatgtagtaatatgattctgttaataaatcataaaagaaagtagagcgtgaatatatatatatatatacactattgttttgtgatatatgaaatacctttgaataggctagagaagcgtaattattgtgtgtagtcgtatattaataactagtgtttccgtatgaacttgtacaacgcctcaccgctaggtgtttaattcgctatcgtgtagcactatttaggtttgaaatattcctgtctatatgcattcatgtgcataatgcatttcattcatgtacgttaattaatcacatggtacgaaagacaagccaagtcgaccccaagagcgggctactccgcatggtgatgctgatggacgaacctgcctgataagtgctaggacaaactggttggaattgaaaccatttaggttgaatgccatagtactaatacctaaagcagtgaaccagatccctactacaggccaagcagccaatcagtcgtgtaaagaacgagagttgtggaaagaaactagcctagcgtattggatggaagattcgattcatcgaccaaaagaaccatgccgaatggcgaacccagattcttcattttcaccggtttccctgcctctttctaaatgaacaatttatttgcgtagtaaatagagtaaggatcaaagagtataccactaaacaagacccttatagagcagagagagagacaaaggacataacaagacccttatagaaagtaaaaagataatcaaaggcattccctggtttactaacccttatagggtacatgagccaaagcacaatccatcccttccaatcaaacaagaaggaatccgatgtattgatcttcgtctgtactgtgctgtacaagacaatcaccaaagatcacaactaatgggtagtgttgtcggttgccacgacaccaaacacaagccaactacccttaaataggtagtgaaccgggagggttcgagttgaatccattacacatatgatgtattgtattcttacacatatgcagtaaggaatccactcaatgcggtatgcactcttgaggctcgttaaactcatgcatggtcgtgtactaaggattctggttgtgagggttctggtgaaaactaatgccttagagtgtgctcaatatagagcagcaatggtcagctcatattagggcttaagcacgaacatgttctgaacttcggggcgcatgtaggcctggggtctgaagtacaagccatgtagcctcagggacattccgtggcgactggactgatcaatggtgccctctgagcacagttgttgcctcaaagctacagcctgctcagtcagggattttgctatctttgaatggtagctttagtattgagatgcagaatgggacacccctgcaagtctactacgttgtctaagacagggtacctagcatcaatactagtgagaagtgataaacttcaaaggcgagccctaatccagaaagtgatgggctgatcatctccctaaaggaaaggatactaacggattagaacggattggaaactaacagattagaaaggcaagtactggcaaggcaagtaaactccagtattttagtataataacaatcggctccttctagcaaaaggagattccattcgttcctagggaaggcccaggatctcattgttgtctggtttgcccagcctagttcatctagtttttcttattatgacatcagttactaggctagtgttggctcataaaagcccataccatacgaataccaatatctgtttgacacaagacatgacatgacctggcggatcagatatagaaatgggtttagccttctccttggcttgactcttgtaagtgaaaggttggaccatatctggtttccgggaagatgcctcactattcctctgttttgtagctgactagtaaaggtggcctagcctgcacaggttcgttggtttcagcttgtgctttagttgagtggtttcgggctctatttggtattagcttgagaagcagttgtaattgttgattcgtatattgtttctgaaatggggtatcactgcaaagcaatgacaagctaagtaaagctaagcaacttaaagaacagaactgcaatgaacagaaaagatgagtggaacctcgcttgatgcctgaagggtattgccaagtggacttgataggttgctaggtttattcctctattttagagagttgtaaatcttgcctttagtgatatgagtaatgactgcctttagtgatacaagtaagggttgccagcctcaaaggctcctgcttttagcatgttattggcgaaaaaagcacacttgactcgggttgtagaaaaaaactagggattagggcgatgctaatcaattagtatacagtgtgaacaactcattgaagtttatctgcggaaatccctatatgatttattatcgtttaatatataagactttcagcaatggtctatactatagagctcgggaatgcattccatgcctatttttcaatatgagaaggggtgtctccccctcttagaggctttcctctttttagcagcatcagctttaatcttctgattagcaatcatgatttccgaattagaaaatgcattttggagatcttcattctcctctaacaaattcagaattatccgataggaggccggattgatacttttcgcatcaaagtcacctatatggcagggcttagtatcaacccatactccattttcgtcgaacacatactccctctttttactttctaaccccatggtatacttacacattttctcttgaaccaacagttcacggaagtttctactgaactttcggacatatgaaatcacttttttaaccctagggtcagccagctggttgatgaaccattcttcatcagcctcatctttacccgctcctttaaactttattatgggttggtccacactagataccttaagcatataggacttaggtgctaaaaagatgccatattcgacaaagtgctcatgcttaaacttacccaaagcggtaggtgatacctcttcttcaggaagttccctctcaacaacgactgagtccgtatccgtgtaatagcagtcatccctctaaatgaatgggtgcattcttatgcgggcataacccgtgacagcggcggagatttgaacagcagcataagtagggcggtctgaactaagcttcagtaaatccaaaccaaacttctgacatttttgcatgttactaggcacttgtctgaactaagctcataactttgaacaaacccatcattatggagagctaattttctacttttttctgtataaacaatttgactcgatgtgctttctgggctgatcccgtagagactgttcatggttattttatagatgaaatccagagctttcacccctttagccttagcatcaagccttttgctgtagatgtcatacacaatacacttgaatggtgattcctttctatcaaaaatatatccacagatcgggtatactttgtagcccaaacttactgcatactaattaagctcctcagaaaaataaacactgagaaatctcccagtgggtaagattatcgtaccatcatcatttttataaggtagaaaaggctttttaatatgcttaggacaaattataaaagatctaatgaacccaaacatatcattcaacacaatctttgatttctttgatcctagatcactaaacgagcgggtcttgcctataggcatatcatctagcatagatgagg

SEQ ID NO: 20 - DNA, 5995 bp, Zea mays
catgcttgatttgtacttagaacatatattatattagtatatatttggtaatctatatatgtatgacgacaactaagacctggtcgatgacaaattgtagttagtcacctgatcagtcctattgcgactaggaatctaggattgactagacaacttgttaacattgatcctacctataccaaaatcactcacaagaggggggaaaacagccacgcatgcttctatttcagaatcactccagcattggagtatcattttcaaggtccattatatacagtaaaaggcagaataatgagatacaacattggagtatcattttcaaggtccagtaggcataaaaataaaatactggatatgcgcagtgtcttttacagagctcagtataactaccttcccttcccctctcatctatgcgtgtcttcaaaacctttcttctcttcggtgcggtggaggcaggctcaactgcagaatcctgtttcttgttactgacaggaggatcactgctgttttcttttaaagtaatcctagaatggttcatagtattgacagttttggttttacattcagaagtgaagtcagaatccacccccattgaggaacctttttcagtgttgggtacatcatctttattttccatgttcttttgatttactttagtgtcttcagcagtttcaataacagggtctgggtatgctgttttggtacctcaggagatgcaatgcttataatattatcaacttcctcatcatctgaaaaatcaaatactgcacttcgctttctgttatttgcattggtggattcccccttgtactttattccctgttcatcatcgctgctatctccatctgcttcttcctttgcacatatttgtgcatcaagagtagctgaacatattaacagcatgagatctacagtagcatgcttagaagggtttatatacaggactagatgtgtgctgagagttatacacaagaaaagcacggagaattaaatatgaccattagtgagatacctgcaacactttctacagctctagaattagtggtacttggaggcttaggtttagctgatgcacgaccccacatgttagccagagatccaccattattaggcatggtctttccattttgagctctacttttgcttgcatgggcatcaattgattgttctttgacaacaggagcattgccagctttatctaataatgtggaattatccttctcagacttattgcctgctccatgctttgaacttacaagcaaatctagctgcggagcagtaacaaatcttgctgcggagcagtaacaaactgctcctttgtaacaaactttggaatttcccagaatgggagcttctacgattgtcaagtagaataaatcaccctggatcgtaagccaagagcattattttgtaagagactaaatttagataacctatcattgaaatgaaaagagtgttgcatgaaaaaagtaacatcaggttacaattacatgcaataaacagcatgaatgtgttatgtggggcaagcaatacaagcggagagggaagatgccaactggcctggcagccaggaaagtggctagccacgggtttgaccgtgattgccgacctggagccgaacctagtctattggttaaggaaataagcaattaggatatttatttgattgtgacaatttaggcttcagttagggccagaggcctatgtaagccatttggcaacctggaatcaagattaagcaatgaatcaatttattgccttcatcttcaaaatagggagccaagaggtaaaacctcgcttggattctgccggcgagtatagcctggaagccaaggaactccgcctacacctttgctacctccttaacgacaccgtaacagaatgtaatctagcaaactacctgtaacaaatcatcttcgtattgcaattttacgcagttccatgcgtgcttgagagaacatatatacagtaaaaggcttgtgaacaccaatcaaaataaatatgtgcttaccaaacagaacagctgctatcttaagctgcttatcaggatacttggggaagaatttatattcttcaaaaagatttgagatcatacagtcgaaaattgatacctccctgtcaacaatagcattcaaataatacaattatgaactgggcacagaacagtgtaagcaaaattctactgaagcacacagatgacagatctacataagttattgcaaaatagaacagagtactaatcaggcagcaactttgaaggcaaaggaactaacagtaagcattgaaacttctagattatcctaagcttatgtcaaaaaaatgtgatcctaccaaaatactgccccaatttggaacaaataatgtctataaagcatacgcataccttaaatagaatatacagcataatatcaacaaacaaaaaagcaagtttcaaagaaatgatcatggctgtcaattagcactcgggttaattaaactgttgagcatatatcttcttcaatatttggtaagctgatccaaacttatttccatcaacaagtttttgcagcatgttgtgaatgattgtccaaaccacaggatgtcagaaaagcaacaaaaatcagtccaaattaattccagttatagcttaaatttgcacctcttattcgtagattctttgaagcgcccgagcatttgtatcatggaatcaacgcttatttgtccagagaacatgtgttgaaaatatgcattagcctctacttcaatgtcatctgaccctccctctgaattagtaagttctctcacaacagagctaggtttcctcgattcatacagagcacacaatttctttatttcatccagtattacatctgacaagagctgccccgagtgagattgaagaacctgaaaatgtgcatgacatgaatccatacttgtccccccccccaaaaaaaaatccaaaacagcaaaactgaaaaaaataataaccatgaccatacagacctttatgaagacacaacaagactcccaatataagtttttgacaatagattgaggttgtgacatgccctctaagacattatcagtgttgctcatagttgctttcaggaaatcaacacattcctgagtgtaggcgagttgagttaggaaagacaaaccttataatcaagcattgaaataaacgggtagtttgctaccagaattgaacaacatgatggatgtgggaagaggtcagctgaaatgtagcagcttacaagaatagattatgcatattacctcaacgaaaccttttccatataaagataacttttcagtcagccatttctcaagatgactatagtctttcctcaaggcagcagcagccaattttatagaaaatgcaaatggagtagaatcaaggacagaagacagaatctgtttaaagtagaaataaaagttgagtgaaacaaatttgtgagaaaatagtgttacagcattgaagtaatattgtagcatggtcccaataacaaacagatgaaaaaaaaagttactttcatgtggataagttttgatacgatacaatttcagaaaataaagtgcattcctcttatacaaaccttcaagtcatgacaaacatcaacagttcttagcaaacaatctggatcactatgagcatcaacaaaacctcgaagggtgaagtatgggtttgtatgccagagataattcataacattgtgctttgttggatccttcagtagagcaggaaatatgcaggacagtacttcatactgaaggagattatacacggtctgcaaagagacaaggggaatttatagcactgctaaaaacaaataaaaatagatgcgactcattatgtgggaccagaaatgcatacgtcgatgcagctaacaccaaaaagaaagagataaggggaacttaacactattaaagtcatgaaactagaggcaaacccattaggtgggaatagaaatacatacagtgacatggctaacaccaacaagtaagagttcagggcaatgtcccagtggatactcaagcattgatcgtacagatgtagcgtacccaacttcagctagttggcataaaacttctaaaaggtcaaggcaggaccaagcatgattgccttgactaggacctgccaaatcctgaaattcctacagtatatgacaactgttaggtgtgaattggatagaattttatcaagatgccagatgttgtcagaattaccaagtgcctggacgaatgagcaaatgtaaatttatcaggtgaagcagaaactgcatgcttcaagaacgatatctggccttctctgtttttccacaatgacccacaaacagcatgaagtggaaatggatcctgtataatccaattaatttattaagcagctagttgattttccaagaatagaaatgtttatatatacataccttgcaagcacgcgtgtatatagacatcaataggtaaaagcctgtttcatcaggtatattgaaaccctcgtgatcaagatattccattacacgcacccagtttgtacttggggcctgcgtgttaaagagagatagagcgtaagggtgcaagataaaaaaaagaacatccaataaaaaagcaagaagtcaatagcttacgagttcattgattgaatccacaagaacatctgcgttccatttagtcagctgagatgagtcgttcgtgtggctattaagaatagcagatacaaatgttgcatatctgttatgggcatctccaagaccactatgagtgccaacaacagccccaagcaacttagatatggcgacatcatcaagaggctcaacaatggaaagtatttccttacagcgagtgttgtcaacagtacatccataacccaactcagctacaatgtcagccatgcttatttctttcccgatttcagacagaagtgactcaaaatcatcatttgtgctacccaagtacatatccaaatgtctacatggcacaaaaaaagagggggagcatttgtgaataaataggaatgaagaagtacacatattcagaatttgattagtcagaaactgaataccttgaaagatttggttgtctatcaaaatctccattagtgacaggtgcaaaaaacggcctctctgtgacttttagtagagatacaacattatttaaagtgtccagatgcttcaacaggccatcatactgatgcagaaacacgacaatttcatgaatttgatcatttgatacagattggataggattcatgcacagctcttcaatttgagcaattgaaaaccattgccctggaacaagaggcaatgtcaatgatcatctgaaaataagagaagcggatatgatatcactagactcacagagaaatgtctacctttctgctttatctctgagttctcagaatctgagagcgcaagcccaacaccaattttctcggcaactgagagttccagcagatttgacagactttcaagaaaatcatccgtcaaggctattgttgtcagcacctcacaaaaactggttgtgaagcatgtcttgcgcaaacaatatctgaaaacatcagataaaagcctttgttgcaactgcaactggaggttcttgacctccccagcattcagcaacacttgattcagacatactcggagcaccaaaatgcatccatccaggccactgtcaactaactgaaaaggtggggaaaataattggaattagaaaacatcgagcagactcagtattcagtaattagaactaagatatgatcgaagccaaagaagaaactcattttatcaagcaagtaggtaaactgctctattttgcgaaactacagtaggtggttcaacgagaatttgaactaaaactgccaatgaaaagtcaccacgagctctgtgattgaggaaatgaaatagatcagctagtgaatggaatgagttttagctattcatacagagtttaagcgcggtcataagtccaaaaacccactaggtggttcaacgagaatttgaactaaaactgccaatgaaaa

SEQ ID NO: 21 - DNA, 5945 bp, Zea mays
gatatcagcactagtagttgtaagtgttggaaacaaccgcaccgtccgatggctaccgttggaccaaggcgttgctactgtgagatgaacaatgcgatcgtaatagttcgacacctctcttcgctaacgattagggttagcttcaaaagtatggtacgacgcctccaacgggacggtcgatgcctaaacccaagctttactttgtttcttcgtgatttttttgcgtctaacttagatttctgtggctagcttggtctccatctttaataacttttataatattcttttgtcaagatgttgatcttctcaatcactatttagcattcaactaagttcatgttgtatcctttaaatcatattcaaaaacactggtgaataatgttaatctaaatagttaaaagaacactggcaaataatattagtctaaatacttaagttgatcaaaacttaactatcatccattaaataaaccttagtcttcttatagacacaaatctgacaaaaaaaatacatggtatgccttgccgtccttgatccacgtagcacaactaccaatgaggtagggtgttgcaaaggtttcaagcgagacatcggataagacaatcctatgtcaagttggatcaaataacatcagacgatagaagtcaggagaatcaaagttgacaagaacggaaacaaattgccctcaaactaattatgccgcaggcaaataaatacggtccaactaatatagcagtaacaattatcaagagtcgatcttcatcaggctccctaagccatcatgatcaccatacagatatataaaaggtaccgaatgacttgcacaaaataaccacagcacatcgatctaaagccaccgtgatatcacaagtcgagttagaagcagccgaacgatatcaagagcttgcattgcgcatcaggttagcctcttctgctgcagcccagccaaaacttccttaaacttgcgttccacaccgctgcacagatcctcatacccgcaacattccgtcttgatactcacgacctctgcatctatttctcccttctcctttgcaattttctggctttcctggcgaatacggccaagttcttgctcgagccgagctgcagcttcatctttttcatcaagcagtgcaccggctctgaaagaggaagccatcttctctactaactttgatctcagcttgccaatttctccatgataactgatgcgctcagatttgagcttgaccaattcggtcatggcgctctgcatagattgcaaactaaatccatttgcctctagatgggagattgtcctgatcttgtcatcaaaccatcccatgtcgttgtctatgcttgcttccattgtaaccttcatcaagttcgcaaatgacaccatcatacctaatgccattccttcacacagtgttggggggagttcttggagtggaaggaaatgtggtcgttgaggtgactccttaaacacatgcattgcttcaactatatgccatatagatgagcgcttgacgaacaaagcctgctgtgaaggcaacaacaagctcccaaaagaagagcaactcaatggagaactgtcaatgatgcactgtaaacttccagcattctcaagacgtaaaactgacctcccatccacttccccacaggattgttgagccggacaatcaataggcaggatagctgttcccatcacatggttgatttcagctaacctggtagtagcagcatggtctgtgcgcatgtcgttattttcattcggttgaatatgactgttagtcatacccgttggctcttccacttccccacccccacaaagttgttgagccagacaatcaatagacaagatacttgtttctatcacatggttgctttcagtcaacttggtagtagcaacatggtctgtgcacatgtcgtcatttttattcggctgaataacagcatggtctgtgcacatgtcgtcatttcccttcagttgaataaggttgttagtcatatccgttggctcttccacttccccttccccacagggttgttgagccggacaatcaatagccatgatagttgtttccatcacatggttgctttcagctaacttggtagtagcagcatggtctgtgcacatatcgtcattttcattcggttgaataaggccgctggtcatatctgttggctcttcctcatgtagagtgtcatgtatgttagtacctgaacacagaaatccaatcattaatctactacatttatgtatgccttcagttatgtagcaaactatgcccattttgaccatgggtagagtttctgcagttcatacctttcctgttagacattgatttaaagctaggaagcagcatggataacaggttctcctcatttgataattcagttatattatttgcatcctccaaagttctgtcatgctgcccttgagcatcagatttcggacactccaactacatgtaaaatagtaaaaatctaagaagctgatggctaatataagtattagtctacaaaagaatcttcttactgctaagagacattcttccattggctctgccatttccttgcttcctccctgctggtcagtcctggtcatatccaatgagctatttagactgcacagtcctttcgatcctctcttagccactacacattgtacgacaactgttagatttaaattaccacctataaatatgaatgtgttccagagaaaacacttacatttcttacaggcaagaacctttgtacttgaagccctttttcttcctgttgactcctaatatagattgaccaaaaagaacagaacaaaaaacatgaatataaatacagaaagggtgtttaaaagccaatcataactcataagtctgtaccatggaaaaaaaaatagcgcgcaatagcggcttagactacatgacgcaacgatattccgtgttttcgcactaacgcggcccgggggctcaccgaacgcggctgcgcggcacagggtctcggcggctgggcgacggcggctgagtgaagacacctttacgcagggctggttactacttgaaccctttctattactatcaaaacaagttggctatagaggagaatgaaacatttagagatggtgtaatcacttgcattaccaggcttgttccaaatgaagataatcaagacaagattattgaagtgctgcaagtgtttcaggatgctgaaggatcctttggcaaagaaattgctagaaggcagtgaaaaaatatcaattttgatccaggtatgaaaaattgattaacaatgtcctagtttataaacaatgtcctagcaatgaatcattcatcctaaattcctaatttacattgtcctctgtttttcactttttccttagctaaatggtggctgaattatgcaagtagtgcaccaaacctcaaaaagttagatgcgagatttctaagtttgacatgcagttcatcaggttgtgagagatgctggagttcatttgaacaagtatgaatttcacacgtactgagttctttaatccattttttgttagacttattgaaataaaaaataatgaaatcaaacctatgcacgtccactcaaagagacgcaacaggctccttcatgacagaatgaaggatcttgtgtttgtcaagttcaactcaagactaaagcaaaagaaagacgacaaggataaagatcccattgagaaacctgtccatgatgttgttttagaagatgaagacgacgagtggatcactggcattgagccaacagaaggagatgaagagcaagaagaagaaactgaaacatcatcacaaggagttgcagctgcatctcaaagagaaagagaagagagaactaagagagttaaccagcagaaattaagaaacaggaagagaaataggttaatccctagtttccctacatttgaggaagaggagtcatctccaccttctgatggagaagataacaatgatattgatatgcatccttccgattctgaggctgaaccatagaagtcattgctctaatgctcttggattgtgaacctatggctgtttggtatttgcttatgtacttgattcttgatgccttcatggttgaattatgaacttaattatgttggctaaagattatgttggttgtgaacttgtggctgtggttatcatatattgtgtgttgtcctgttcttatgaattttgaataaaatagcgcgctatagcggcgcaatagcacgagcaagcagctaaagctactgcactatagtgcggctatagcggccagaacaggcttccgctaattttgatagcgccgcgatcaaaaacactggtctgtaccagtctatctggagatgaagtagtctggccaaccctatacatgcccaaatctaaaacaatgtccctagagaaattattgttttccttccactgaatctgcaccagcaaaaagatcaaaattagcagaaataataaattctatgcgggcattcttactcccccaacaacaaaacataatgaataagactcaaactattagagagacccacatttccctgaagttcttgaatagggtgtgttttcccgtctttactattcgatatacatttcttcactccgagcgatttaaaaagttgtccctctgtgtgttggacagcatgatttctgcgagatgaagctattttctttcttattccagcagtggaaacaataccatgggcatcaacatttcttccacacatagatccatgaagctcaccatccaaaacacccatatcagacaggatttcttggttgtccactggtgctgaatgtcctgaagaagaacaaagaagtccattcatttgaaccgaattcactatcccgtgtgaaccttgaggactgttcttttcagagagcaaagaattcggtgaatggatgctttcaggtgacttgcacatagctgacaaaggaatgcccatctcagagactgaagcatgttcagaaccttcaactaatgtggcatatggcagcttcagttctttcgtagactttttgatgaaagaagaatcaggatcgtgactgtcttcttcaccactggatgtcaaatcaattggtgagatttgattttctccacgcttagatcgcggcctcaagttagtctgtctctgcacaagaaaatatttagaacagatcatacaagttgaatgatagggtgttgtattgttataagctaaaaactgaaagattctttagcaatgtgctatatgcctatatacatattgcatgcaaatggttaagcaaatttcttaaactcgcaagacagccaatacggtagaaattctgcttggcttaatagatacccattgtgaaatattttccaggatccagatatattcatgatcaataatactatctctactacttttttaaggctggatccaatacccactagagcctatatcagttagtgtattatgtgtcttatcttgtaatgggccttggcccatatatttgactatatattaatatatctcctgcccaaataggttaggtttcactctccagcatgctatcaagcctctctccctccctcccaccctctcttccctaaggccctaacccaggactgttctccctgctcactgatagcgccggccacctccgccccccttccccgccatgggcgtcatcacctaagagccctcaccaccggcgcggcccggtctagcgtggctgcgctgccgcctccagcgcacggcccttaccacctgcccccgcgcgggcacgtaccctcagcccacgaacccgcatatatattagtcagatgttcgtgcatcgcaacgtttctatatgacatatgactttttttaataaaacataaaatatgtgttatgttggttaggtatgtgtgaactcccacttatgcacaattttactttattttttccataaccgtggaaaggttgtgagtgttcaagttgatgtttggag

SEQ ID NO: 22 - DNA, 5923 bp, Zea mays
  misc_feature (4026)..(4027): n is a, c, g, or t
  misc_feature (4101)..(4101): n is a, c, g, or t
  misc_feature (5033)..(5036): n is a, c, g, or t
  misc_feature (5134)..(5136): n is a, c, g, or t
  misc_feature (5235)..(5235): n is a, c, g, or t
  misc_feature (5557)..(5559): n is a, c, g, or t
aatgtttagaacaatagtttttacaaaaaggacccaacaaggtttgtcatcaaagttttcacaatacactgatttgggagtaaagggtcatgatttcgtgcatgttttctcgaaaagattgtggcatgaaccatgcgaaaactttgaagcttttcgaagccctaaattatgtggtagatttacagaatgatccaacatgttgtttcacacgctccaccatcaactaatattgaaaacaatcaataacgtgattgtgggacccacatagttagatggtcacatgccgattaaagttcagtgttttaaagaatgagataactttaaaagtatttgaattgctatatgcagatttttcaagataaactattttgcagagttacgacctctattaatggaaaaatagttaatggaagaaaatttatatttgcactttcattactgttttctaaatgtcgtactgtaggacatacttctttaggcatgttaccttaaaacatatatagtgctatttgcaatgttcctcagttgtgaacacatcaacccaagtttaaagccaatcaaaacatgagtatgggactaatgagtattaatttcatataagtttactgcatgatatattgatttctggtgtgcgtcaacttcgatgcattttgaagccctaaatgttgtattgtttagatagacagtttttatggatggacccaacttattatttcgcatgcaccatcattaaccaatgttcaagaaaaccataacatgagtatgcgaccctagattgctgcatgcttgcactagatttggtcatatgagggatgaggtgactgtagaagcgcttgaagcataacatgtagattttttcagatcatcactttactatagacgtgagctatccaacatgttgtttcacatgcttcatcatcaacccaagtgcaagacaacctatagcatgagtttggggcccaagatattggatgttcgaatgctgtcactagagtttgtagatatgaagaatgaggtaactttagaaatgtttaaagttcaacatgtatatttttaagatcggtaattttccagagttgagagctatatttatgcaatttttctttcattttgatccatgttttaagatactttgttatttatctattacaagtatatcaatgatatttataacaaaagaattaaatacagaaaaaaatttcattccaattttaattacaatttgctttatgcgtgactataaataacattagtttaggcatgctgttttaaaccatatgtagtgctattttgaatgattcttggttatgaacaacagtgcatgttttgaggccacccaaaaaacaagtatgggactcatgatatttatcacaatacaatttaaccaaggaaaattacattacaattttctcattgccaaactataaacatcacttgtttaagcacgttatctcataagatatgtggaaagatttaaatgtttcatggttatggacattattgtaagttagaagcggttcaaaggcctaaatgacgtaatgtttagaacgtcagtttttacaaaaatgacccaacaagatttatcatcaatgttttcgcaatacactgattgtgagtaaagtgtaatgatttcgtgcatgtttttttgaaaagattgtggcatgaaccctgctaaaactttgaagcttttcaaagccctaaattatttggtagatttacagaatgatccaacattttgtttcacacgctccaccaacaactaaaattcaacacactcaataacttaagtatgggacccacataattaaatggtcgcatgctgattaaagttcagtgttttaaagaatgaggtaactttagaagtatttgaattacaatatgccaatttttcaagataaactattttgcaaagttacgacgtctattaatggaaaaatagttaatggaagaaaatttatatttccactttcattactcttttctaaatgtcgtactataagacacacttgtttaggcttgttaccttaaaaacatatatagtgctatttgcaatgttcctcagttgtgaacacatctacccgagtttaaggccgatcaaaacatctgtatgggactaatgggtattatattcgtacaagtttgcagtatgatatatcgatttctgatgtgcatcaacttcgaagcattttgaagccctaaatgttgtattgtttagacagacagtttttacagatggacccaacgtgttgtttcgcatgtaccatcattaactcatgttcaagacaaccataacataagtatgtgaccctagattgtcacatgctagcagtagatttggtcatataaaggatgaggtgaatctaaaagcgcttgaagcacaacatgtagatttttttcaaatcatcaatttactataggcgtgagctatgcaatatgttgtttcacatgcttcatcatcaacctaagtgcaagacaacctatagcatgagtttggggcccaagatattggatgtttgaatgctgccactatagtttgtagatatgaagaatgaggtaactttagaaatgtttaaagtgcaacatgtatattttttagatcggtaattttttggagttgagagctatatttatgcatttcttcttttattttgagccatgttttaaggttctttgttattattctattacagttaaatcaatgatattcataacgaaagaattaagtatagaaaaattttcattccaattttaattacaatttgctctatgcttgactataaacaactatagtttaggcatgctatcttaaaccatatgtagtgatattttaaatgattcttggttatggacaacaatgcacgttttgaggccactcaaaaaacaattatgtgacaagatatttgtcacaaaacaatttaaccaaggaaaaatacattataatttgttcattgccaaaccgaaaacctcacttgtttgggcatgttatctcataagatatgtggaaaatttttaaatgttccatggttatggacattaatgtaagtttgaatcggttcaaagccctaaatgatgaaatgtttagaatggtagttttcacaaaaaggacccaacaaggtttgtcatgaaagttttcgcaatacactgatttgtgagtaaagggtcatgatttcctgcatgttttctcgaaaagattgtggcatgaaccatgcaaaaactttgaagcttttcaaagccctaaattatgtggtagatttacagaatgatccaacatgttgtttcacacgctccaccatcaactaaaattcaacacaatcaataacttgagtatgagacccacataattagatggtcgcatgtcgattaaagttcaatgtttcaaagaatggggtaactttaaaagtatttgaattgcaatatgcagatttttcaagataaactattttgcagagttacgacctctattaatggaaaaatagttaatggaagaaaatttatatttccactttcattactcttttctaaaagacatacttgtttaggcatgttaccttgtaacatatattgtgctatttgcaacgttcctcagttgtgaacacttcaacccaagtttaaggccgatcaaaacatgagtatgggactaatgggtattatattcgtacaagtttgctgcatgatatatcgatttctgatgtgcgtcaacttcgatgcattttgaagccctaaatgttgtattgtttagacagacagtttttacggatggacccaacgtgttgtttcacatacaccatcattaacccatgttcaagacaaccataacatgagtatgcgaccctagattgatgcattttagcactagatttggtcatatgaaggataaggtgactctaaaatcgatcgaagcacaacatgtagatttttttcagatcatcaatttactataggtgtgagctatgcaacatgttgtttcaattgcttcatcatcaacccaagtgcaagacaacctatagcatgagtttggggcccaanntattggatgttcgaatgctggcactatagtttgtagatatgaagaatgaggtaactttagaaatgtttaaagtncaacatgtatattttttagatctgtaatttccagggttgagagctatatttatgcaattctgctttcatttcgatccatgttttaatattctttgttattattctattacagttatatcaatgatatttataacaaaagaattaaatatagaaaaaaattcattccaatttgaatttcaatttgctctatgccagactataagcaataatggtttcgccatgctatctttaactttttgtagtgctattttaaatgattcttttttatggttaacaatggatgttttgaggccactaaaaaagtatgggactcatgatatttatcacaaaacaatttaaccaaggaaaattacaatacaatttgatcattgccaaaatgtaaacatcacttgttttggcatgttatctcgtaagataagtcgaaaattttcaaatgtttcatggttatggacattaatgtaagccttaatcggttcaaagccctaaatgatgtaatgtttagaatggtagtttttacaaaaaggacccaacaaggtttgtcatcaaacatttcgcaatacactgatttgtgagtaaaagagtcatgattttgtgcatgttttctcgaaaagattgtggcatgaaccatacgaaaaatctgaagcttttcgaagccctaaattatgtggtagatttgcaaaatgatccaacatgttatttcacacgctccaccatcaactaatattcaacaaaatcaataacttgagtatgggacccacataattagatggtcgcatgccgattaaagtttagtgttttcaagaatgaggtaactttaaaagtatttgaattgcaatatgcagatttttgaagataaactattttgcagagttacgacctctattaatggaaaaatagttaatggaagaaaatttatatttccactttcattnnnntttctaaatgtcgtactgtaagacatacttgtttaggcatgttaccttaaacatacaatttgctatttgcaacgttcctcagttgtgaacacatcaannnaagtttaaggccgatcaaaacacgagtatgtgactaatgggtattatattcctacaagtttgttgcatgatatatcgatttctgatgtgcgtcaacttngatgcattttgaagccctaaatgttgtattgtttagacaatgtgttttttcgcatgcaccatcattatcccatgttcaagataaccataacatgagtatgagaccctagattgtcgcatgctagcataagatttggtcatatgaaggatgaggtgactctaaaagcgcttgaagcacaacatgtagatttttttcagatcatcaatttactataggcgtgagctatgcaacatgttgtttcacatgcttcatcatcaacccaaattattggatgttcgaatgctggcactatagtttgtagatatgaagaatgaggtaactnnngaaatgtttaaagtgcaacatgtatattttttagatcggtaattttctagagttgagagctatacttatgcaattattcttttattttgatccatattttaaggttctttgttattattatattacagttatttcaatgatatttataacaaaagaattaaatatagaaaaaaaatcattccaattttaattacaatttgctctatatcagactataaacaataatagtttaggcatgctatattcaactatatgtaacaccctaaagttcaatcctgtgaaaatgaggaaaattctccaggggtttttaaatcaaaacacctttccttgagaatattcataatttcaaagttactactcccaa

SEQ ID NO: 23 - DNA, 5897 bp, Zea mays
cccggaaagggtagaagaatgggacctattctgggacatacaatgcattacagacgtatgatcattacccttcaaccgggttattctattccacttctagatagagaaacgaactaaaggagaatacttaataatacggcgaaacatttatacaaaacacctatcccgagcacacgcaagggaaccgtagacaggcaagtgaaatccaatccacgaaataaattgatccatggacggcaccgttgtggtaaaggtcgtaatgccagaggaatcattaccgcaaggcatagagggggaggtcataagcgcctataccgtaaaatcgattttcgacggaatcaaaaagacatatctggtagaatcataaccatagaatacgaccctaatcgaaatgcatacatttgtctcatacactatggggatggtgagaagagatatattttacatcccagaggggctataattggagatactattgtttctggtacaaaagttcctatatcaatgggaaatgccctacctttgagtgcggtttgaactattgatttacgtaattggaagtaaccaattaggtttacgacgaaacctagaaatcgatcactgatccaatttgactacctctacgggatagacctcaacagaaaactgttgagtaacggcagcaagtgattgagttcagtagttcctcatagaaaattattgactctagagatatggtaatatggagaagacaaaattgtttgaagcacgcacagaaccggaagcgccccttgtttcaaagagaggaggacgggttattcacatttaatttgatggtcagaggcgaattgaaagttaagcagtggtaattaagacccccgggtgaaaatagggatgtctcctacgttacccataatatgtggaagtatcgacgtaatttcatagagtcattcgatctgaatgctacatgaagaacataagccagatgacggaacgcggagacctaggatgtagaagatcataacatgagcgattcggcggatttggattccttttctatatatccactcatgtggtacttcatcatacgattcatataagatccatctgtctagagatcgtcatatacatctagaaagccgtatgctttggaagaagcttgtacagtttgggaaggggttttttgagaaaaaagaagaatctacttcaaccgatatgcccttaggcacggccatacataacatagaaatcacacgtggaaggggtgggcaattagctagagcagcaggtgctgtagcgaaactgattgcaaaagagggtaaattggccactttaagattaccatctggggaggtccgtttggtatcccaaaactgcttagcaacagtcggacaagtgggtaatgttggggtgaaccaaaaaagtttgggtagagccggatctaagtgttggctaggtaaacgccccgtagtaagaggggtagttatgaaccctgtggaccacccccatgggggtggtgaagggaaagcccccattggtagaaaaaaacccacaaccccttggggttatcctgcgcttggaagaagaactaggaaaaggaaaaaatatagtgatagttttattcttcgtcgccgtaagtaaatacgtaactaggaatatggaaaattgcatttttggaatttgcaataatgcgatgggcgaacgacgggaattgaacccgcgcatggtggattcacaatccactgccttgatccacttggctacatccgccccttatccagctaaaggattttctcttttttccattcattattattctatttattctgacctccatacctcgatcgagatagtggacataggatgccactctttaaaatgaaaaaaaggagtaatcagctgtgacacgaaaaaaaacgaatccttttgtagctcgtcatttattggcaaaaatcgaaaaggtcaatatgaaggaggagaaagaaataatagtaacgtggtcccgggcatctagcattctacccgcaatggttggccatacaatcgcgattcataatggaaaagaacatatacctatttacataacaaatcctatggtaggtcgcaaattgggggaattcgtgcctactcggcatttcacgagttatgaaagtacaagaaaggatactaaatctcgtcgttaattgaattcagaatagaaagattcagaataaacaaagaaatacccaatatcctgttggaacaagatattgggtatttccggctttccttccttcaaaaattcgtatatgtttaggagaaaaaccttatccattaaggtaaggaacttcaagagcagctaggtctagagggaagttgtgagcattacgttcgtgcattacctccataccaagattagcacggttgatgatatcagcccaagtattaataacgcgaccttggctatcaactacagattggttgaaattgaaaccatttaggttgaatgccatagtactaatacctaaagcagtgaaccagatccctactacaggccaagcagccaagaagaagtgtaaagaacgagaattgttgaaactagcatattggaagattaatcgaccaaaataaccgtgagcagccacaatattataagtctcttcttcctgaccaaatttgtaaccctcattagcagactcattttcagtggtttccctgatcaaactagaggttaccaaggaaccatgcatagcactgaatagggaaccgccgaatacaccagctacacctaacatgtgaaatggatgcataaggatgttgtgctctgcctggaatacaatcataaagttgaaagtaccagatattcctaaaggcataccatcagagaaacttccttgaccaatagggtaaatcaagaaaacagcagtagcagctgcaacaggagctgaatatgcaacagcaatccaagggcgcatacccagacggaaactaagttcccactcacgacccatataacaagctacaccaagtaagaagtgtagaacaattagctcataaggaccgccattgtataaccattcatcaacagatgcagcttcccaaattgggtaaaaatgcaatccgatcgccgcagaagtaggaataatagcaccagagataatattgtttccataaagtaaagaaccagaaacaggctcacgaataccatcaatatctactggaggagcagcgatgaaggcgataataaatacggaagttgcggtcaataaggtagggatcatcaaaacaccgaaccatccaatgtaaagacggttttcggtgctagttatccagttgcagaagcgaccccacaggcttgtactttcgcgtctctctaaaattgcagtcatggtaagatcttggtttattcaaattgcaaggactcccaagcacacgtattaactagaaagaaaatagataatagaaggcttgttatttaacagtataacatagtctatataccaatgtcaaccaagccagccccaacgattggattttcgtataacttcatttaccaaatccaaaaatttgggaaattaagttagtaaaaatgaaaaactcagattgctcttttctattttccatatgggttgcccgggactcgaacccggaactagtcggatggagtagataattcttccttgttacaatagaaaaaacccctccccaaatcgtgcttgcatttttcattgcacacgactttccctatgtggaaatagccaatttctattccgaagaggaagtccactaattttgagaatttttaattagttaaagtgattcacctactatggaacatttcagaatggaaaatgtgcaagttttatcttgatatcgatcttttctagtttattaattttgtctaatgattaattaagagtaagaggattcaccaggtcattgatacggataatatccaaataccaaatacgctcactgtgtgatccatggaaagaaaagtgaattgttttggtgaacatcaaagaaaaaacttgctcttcttccgtaaaaaattcttctaaaaataccgaacccaatcgttgcataaaagttcgtaccgtacttttatgtttacgagctaaagttctagcacatgaaagtcgaagtatatattttagtcgatacaaagtctgttttttcgaagatccactatgataatgaaaaatatttctacatatccgaccaaaacgatcaagaatatcccaatctgataaatcagtccaaacgggtttactaataggatgccccgatccagtacaaaattgagcttttgataaggatccgacaaggggagttgcaaggactgtggtatcgaattttttcattcgagtatctattagaaaagaattctccagcatttgattccttactaacaaagtatttattggtacacttgaaaggtaccccagaaaatcgaagcaagagtttgttaattggtttagacgaatcctttgtggttgagtccaaaaagagaaaaaatattgcgagaaattgacaaggtaagatttccatttcttcttcaaaagaagagtgccttttgatgcaagaattgcctttccttgatatcgaacataatgcataagaggatccataaagaaccatatggttttccgaaaaaaccccgggtacattacaccaaaatgttccatcttcccagaaaagatgattcgttccagaaaggttccagaagatgttaatcgtaagcaagaagattgtttatgaagaaacaacaagaaaaattcatattctgatacataagagttatataggaatcgaaatagtcttttattttcttttttcaaaagaaaaatggatttcattgaagtaataaaactattccaattcgaataatagtggagaaagaatcgcaataaatgcaaagagggaacatcttgaatccggtattcaaggagttgaaccaggatttctaaatggataggatagggtatttttatatgtgatagataatgtaaatgcaaaaatttgtcttctaaaaagggaaatattgaatgaatagattgtaaattttgaaaatttggtatttctttttcttccggacaagatagttgccctagcgagagtgggatttctacaacgatcgcaaacccctcagatagaatctgagaataaaactcagaataaaaataattacggtgatccaacaatcgatcttggttaggataattaaccgaattaattaaaaaattctgctgatacattcgaataattaaacgtttcacaagtagtgaactaaatttcttgttattacaaccaaaaatttccacgggttcggaaccatttaatccataatcatgagcaaatgcataaatatattcctgaaagagaagtgggtagacgaagtagtgttgacgagatttctgtttttctgaatacccttcgaatttttccatttgtatttctacttgaaatagagaaaaaaagcatttctcggtttatcaaatgatgatacatagtgcaatatggtcagaacaaggtgttgcataatacaaacccaggaaagaaagggagtctaatccatagaactttttccactccttttctatctaattagtttatgtttgttctaattataaaacaaacaagaacaaatcttttatttttgcaggccaatcgctcttttgactttggaatacagtctctttatcaatatactgtttcttttacacattcaattcataacatctcttttcaatccataatcaagaataattaggatttctaaaaaaaaaaagtaaagggtccattcataggaaaacctaacctttccccacattaggcactaatctatttttaacgtctaattagatcggggaatccttccaattaaccaattaagaagttaagctcgttgctttttttttattttaccagaattagag

SEQ ID NO: 24 - DNA, 5824 bp, Zea mays
  misc_feature (3807)..(3808): n is a, c, g, or t
cactaatcaaatatcagttcccagctcgcgcggagacggggtcccactttaaagagtgtgtatagtttttaaaggtacctcggttgtttagaagaggccctgctggtgaacatcattattcctttcttgaaatccttaatccggtcaatatatctcggatagagctgcaaatcaaagcaaatacagttctacgtctctttatttgtgagttctctttccaccacccactacccacgccacgttctgccagcggtccggcgtgtccttgtcgtatgtcgctagtgccctctcgaacaacttgttctgcttcgtcgtccatgatgaactcatggttcgatttctctcaatatatgttcaaggaaaagtttaaggtgttctgtaatggctgcaactgctactactttagctataaggtcactggctagcttgtgtttgtatgcaagaagagggagggacaatgcccaaatgggaagctttactggactctgaccttcaaataaggtgctgctaactactaatattagtaatcctcataggcaaaatataccagaaagactacttgaagaatacaaaacaaggcactaggcagccctcccgacgagcatttctttgcccttcagcccatagccatgtcctgaatgagtggtatcaccaacttgcattgaggaatactgcgcataacaaaaagctgcaatgccggggcattttcacgtacattgatggaatgtctgttggagacatggtgcacagcacaatatgcaccatcagctgcagcccaataccacgaattatctgtacgatgattccaatttctaaaagcaggatcatattttggaatcacaatgcagattattgtacctcaaaggtaggatgaatgtcaatagaatacatctagcttcctacctttacttgtcttctctttacttgactagccgttacttcaacccgaaacgaagcaatacttctgctacaaaaggcaacaattacttgttacttattcctctattggtttctcaaaactagacataatgacaccaaaacgaaccgccatccgagtatgggctagattgactttcgatttacagaactgctacatcttttttgctttgatgccggtgtgaatctacccacatttcttatctaggccagtgctttccataaaacaacagtctgaggaatcaaagatcctaatagaagtagaagatggctattgcgctaaggttgacgtgagagaatatactacagatgaatacctcgtctatataaatccaacctgcaagaagtgacacaaaaaagaaagatgaactaccggagatacgaatcacaaacgcgcgagcagtttgagcgttatcttaatgatgtgcataaatgctatcgtggtgaaccgcgatatgtaatgtcgtatgaggggcacgtcattgcggtacaagactttgaggagccctatcctaaagcaggggcggttaccatgcttgcttcagcatttatggaattgttaataaatagggtttacccatcaatccagggttccgctaagttcacactccaatatcgattgaatatagacggtaatcccattaatattactttatcaaaagcaattaagcttacatatgctgatggtactcgcattgctaatgagttcatattaaaagaaataataaatgtgttgaataagtacacagaaaagtaccaaagttgcgatgttgaagcaatcagtgtcagggcttattcagagggtagtatagatttgaatcaagcttcaattccaactaaagatgaatctttgaactatctgaagggagcacttattaaatacagcgacataaataatttacaaatacccaagatgggtcgacgttcaaaaagacgctatcagtcatatatccctgtcgataaaacagaaattaaaaacaaaactatattttttgttgctgatctagaaactcttttattaaaaagacgagacggatgtcgacaaaactcacgtgccctacgcagggggtaaggaccatattacgacgttctatgcacatgactactcaaaagtagtattagggaagactctttaacttatcttaaacaagatattgtaataacagctattgttatgcaacgcgctaaagccattatttgggaagagtatgtgattgatatccgtaaagtattaacaatatcagcattggccctaaaaatatttagacgtgtctactataaggatgatgatgataatcggatctacatttctgacgataatgaggctcaatttattagggaaggctactaaggtggtcacatggacgtgtataagccatacggggagaatttgtattattatgatgtaaattctctatacccctcatctatgctagatgatatgcctataggcaagacccgctcgtttagtgatctaggatcaaagaaatcaaagattgtgttgaatgatatgtttgggttcattagatcttttataatttgtcctaagcatattaaaaagccttttctaccttataaaaatgatgatggtacgataatcttacccactgggagatttctcagtgtttatttttctgaggagcttaattagtatgcagtaagtttgggctacaaagtatacccgatctgtggatatatttttgatagaaaggaatcaccattcaagtgtattgtgtatgacatctacagcaaaaggcttgatgctaaggctaaaggggtgaaagctctggatttcatctataaaataaccatgaacagtctctacgggatcagcccagaaagcacatcgagtcaaattgtttatacagaaaaaagtagaaaattagctctccataatgatgggtttgttcaaagttatgagcttagttcagacaagtccctagtaacatgcaaaaatgtcagaagtttggtttggatttactgaagcttagttcagaccgccctacttatgctgctgttcaaatctccgccgctgtcacgggttatgcccgcataagaatgcacccattcatttagagggatgactgctattacacggatacggactcagtcgttgttgagagggaacttcctgaagaagaggtatcacctaccgctttgggtaagtttaagcatgagcactttgtcgaatatggcatctttttagcacctaagtcctatatgcttaaggtatctagtgtggaccaacccataataaagtttaaaggagcgggtaaagatgaggctgatgaagaatggttcatcaaccagctggctgaccctagggttaaaaaagtgatttcatatgtccgaaagttcagtagaaacttccgtgaactgttggttcaagagaaaatgtgtaagtataccatggggttagaaagtaaaaagagggagtatgtgttcgacgaaaatggagtatgggttgatactaagccctgccatataggtgactttgatgcgaaaagtatcaatccggcctcctatcggataattctgaatttgttagaggagaatgaagatctccaaaatgcattttctaattcggaaatcatgattgctaatcagaagattaaagctgatgctgctaaaaagaggaaagcctctaagagggggagacaccccttctcatattgaaaaataggcatggaatgcattcccgagctctatagtatagaccattgctgaaagtcttatatattaaacgataataaatcatatagggatttccgcagataaacttcaatgagttgttcacactgtatactaattgattagcatcgccctaatccctagtttttttctacaacccgagtcaagtgtgcttttttnncgcagataaacttcaatgagttgttcacactgtatactaattgattagcatcgccctaatccctagtttttttctacaacccgagtcaagtgtgcttttttcgccaataacatgctaaaagcaggagcctttgaggctggcaacccttacttgtatcactaaaggcagtcattactcatatcactaaaggcaagatttacaactctctaaaatagaggaataaacctagcaacctatcaagtccacttggcaatacccttcaggcatcaagcgaggttccactcatcttttctgttcattgcagttctgttctttaagttgcttagctttacttagcttgtcattgctttgcagtgataccccatttcagaaacaatatacgaatcaacaattacaactgcttctcaagctaataccaaatagagcccgaaaccactcaactaaagcacaagctgaaaccaacgaacctgtgcaggctaggccacctttactagtcagctacaaaacagaggaatagtgaggcatcttcccggaaaccagatatggtccaacctttcacttacaagagtcaagccaaggagaaggctaaacccatttctatatctgatccgccaggtcatgtcatgtcttgtgtcaaacagatattggtattcgtatggtatgggcttttatgagccaacactagcctagtaactgatgtcataataagaaaaactagatgaactaggctgggcaaaccagacaacaatgagatcctgggccttccctaggaacgaatggaatctccttttgctagaaggagccgattgttattatactaaaatactggagtttacttgccttgccagtacttgcctttctaatctgttagtttccaatccgttctaatccgttagtatcctttcctttagggagatgatcagcccatcactttctggattagggctcgcctttgaagtttatcacttctcactagtattgatgctaggtaccctgtcttagacaacgtagtagacttgcaggggtgtcccattctgcatctcaatactaaagctaccattcaaagatagcaaaatccctgactgagcaggctgtagctttgaggcaacaactgtgctcagagggcaccattgatcagtccagtcgccacggaatgtccctgaggctacatggcttgtacttcagaccccaggcctacatgcgccccgaagttcagaacatgttcgtgcttaagccctaatatgagctgaccattgctgctctatattgagcacactctaaggcattagttttcaccagaaccctcacaaccagaatccttagtacacgaccatgcatgagtttaacgagcctcaagagtgcataccgcattgagtggattccttactgcatatgtgtaagaatacaatacatcatatgtgtaatggattcaactcgaaccctcccggttcactacctatttaagggtagttggcttgtgtttggtgtcgtggcaaccgacaacactacccattagttgtgatctttggtgattgtcttgtacagcacagtacagacgaagatcaatacatcggattccttcttgtttgattggaagggatggattgtgctttggctcatgtaccctataagggttagtaaaccagggaatgcctttgattatctttttactttctataagggtcttgttatgtcctttgtctctctctctgctctataagggtcttgtttagtggtatactctttgatccttactctatttactacgcaaataaattgttcatttagaaagaggcagggaaaccggtgaaaatgaagaatctgggttcgccattcggcatggttcttttggtcgatgaatcgaatcttccatccaatacgctaggctagtttctttccacaactctcgttctttacacgactgattggctgcttggcctgtagtagggatctggttcactgctttaggtattagtactatggcattcaacctaaatggtttcaattccaaccagt

SEQ ID NO: 25 - DNA, 5682 bp, Zea mays
ctttcaacttaattagaaggtttctttactgctggcttctcaaccagcttcaaaagtggatcaaaaactcggagtggagaagatcatagtgaaagacacacctatgttttgctgtcataaacttttgttccctaattcatgtttaacctgcagaaatgataaattcatatattaaagaaaactacaaatatcataggaacacctagtacacaggaacaataaatcacaaacacccaccaacagggatagctaacttatggagctattatgatcagcaggaccacaagtagtttaatgagctaaactgttagctgaaaagcgaataaatgggtactgtgttctaatagcctagaaccaatgggatgtaaacagagtgcacaatctacacagaagattaatgattatattcatggattggaccaaaaataaaaagcaatacttgataggccaccacactcgagttcctctttgcacttaaggaatgcagaacatagttaaaaatcaggtggggaatcacatcaatcaggtggatgtattatcgtgattttagaactctaaaatattcaaagagaagtttccaatcaaactcacttctagagagtcaaaatgtgtctcattttttttggacagagagagcatgaaaaaagtactttgctctaccaacctgtttcatcttcccatggtaattaagcaattattggagaacctttaagcgagttaattagtggaagaacaacatccaagtaatctacacaagcatatgttgcaaaatatctgcaattaatcacgataggaaggctcaaaagttagcgcaatgctacataaaatatgctataatctaagcatactcagatagtaaaacagtggcaggtgttcccctttcatctattgatccatgtagcttgttcttgaacttttgaagcttttagttgtttctaataataaaactatgtatgttatgcgacaacatagaacataaatttactttttgcaaaacaagaatgactgtatcagaaaagtttggtatccaaggctcttgttcaatcaatttggtggaaagcagaaagcacaagacctatcacccgtgtggctcatggaggcacaaacaggatggagtctggaggttgcgcagtgttactgtgcgtgggtttggcagaagcacggcgtagcaaacaggttggggattggacgcgacctacatggactcggatcgaacgcgtgctggtccctgctcacgtccgtaggcgtggctccctgctgtctctgctcccttgttgcccatgcggctctaccgagcacacggcacagcagctagctagctatcgtcgggacgtgacttgtaaagacgcaaaatgatcacgcacaatatgtccttttttttcgaatacaagaaaatttcctattttctgtgtttttcctgcgaaaataaactaatttgacaatttctttgcattccaaaggggccttatatctggaagaaatccagccggtccaccaaaataaagggagcgcatccacaacctagacgtcgttttcttgctgttccggctcgatcgcccatgtcgccgtcgactgggatgtttcaactacatggaaatgcagagttcatttcaacgagaaggcatcgttgcaacatagagaaaacaactatattgaggaaaataccacagcccaaaattgacagttcagcctatcagttttctgtttaatgatgtttttaatgtaaaatagacatttcagacttatgtaatcctgaggtttgcagctcctttatgtagaacatttgatagaagagatgtgtcagttttatgatgttctaactcttgattttcaacatagagaaggtaagggataggctgacagaagaacactcagggctcattcggtacaatgggttccaacctgaacgattctaaggcaaggattcagtgaatccggtcggttcactcaaaccagtgctgtccgcgtcgttgccaagatccgatccggaggatagttagccgggattcgaaccggaccataaaagataggaaaaatcccaaaccaggtcactcccgtttttgattttggtctaaacgaatagctcattatgaaatggctagattctgatccggaccatttctttccacccggaacgagccagaaaccggctgaaacgcccaaaatgaacgaggcctcaagaggtttgaagctcctttctgtagctgaatctaggaataaagaaattgctgcatgaagttcttgaaaaggtagcacaaaaagaaggcgaagttacagacatgacagagaagctggctttgttagaaattgagaatagatgactggttcgaacgaagcattaaaagagaaagtggatgctatgctggtcatgtttgatgagctacaggaacggtttggttttactcatcaagctgagaaggaagatgatgcagagaagctagcagttcatgagaggacaatctcacacctgacagaggtacacacaagaatcttagagctccattctctagctaaatcaaagaatgaagaaattgaaactcagttccgtgaggctcttgaaataatatcacagaaagaaggtgaagttaaagaattgtgtaagaagctagatgcccttgaaattgagttgggaattgggatattatgaggagcaggcaacggaagctgctgccgctgaaaagaatcataaggttaaatttgatgtagcacttatgttatatctgcagcacatatagttagaagtgaaggctaccttgagattgtgataggcctctgaacccatctgcattgcttcttcaaagtttatagcaccagcaaggaacgatcatagtttcctacaaataagaaatgtttatagttactacggaactacaactaaacatgttgatatggtggatatagatgaacaactaactgtcttaatatgtttctatttaggcaaaaggtgactcaagtgggccaaaaaagggaatggtgccttcaacttctcagattctgaaggtttggaggaatacttgaatgggaagaccatttccagcatgctttcaaccattaattattgtaattgcttacttatagagtggaacctgcatagcaacaagcatccaatgttccgagaataagaattatgtgtggtggcatgacacgtttatcaaattatgacgattttagaagaaaagcagcaccagctttgcaaactgcaattgacactatcagcatggcattggctccaagctcagcctgcatttcgtgcaatatcatatctatttatatttggataaatgtagttgccagaaataagggaacgaaatgaagatacaaaaaaatttaggttgtagtggtaagtggaaacacaaataaagtgaaaagaaaatcattatttccaaacaaccaaatataactgaaataattagcatcctactgcccttatattgactatacccaatgtaaagaaagaattgcagcaggccataggagtatcttacagttacagggaaaggaatctacaaacaaataaacaaacaggaattacgtagcagcggtacaactacaaacaaagataacgatccacgagatctgatgaaaccagaccagacagagcgcagaggtacaggggggttcgcacctcatagctgtcaacgcctataaatgatcttgtagttgcggtgctccacaaacgaacaaagcatcaacacaaccagtgggagtcttagaaaatcggaagggcaggggaaccctttagggctgatttggtgaccgggctgaattggaaggggatttctccccatggatcctctagggatacctaaccaccaaatcagcccttatcccgatccagatccaagatgatccaacacaaaaccagcaggttcgtggatacggaaaggagggtgataattcgatcggatcagtgggagagaagcagcggaggggacgtgcgaccggaccgggggtgagtggcttgtttctggcggcctgttgtcacatgacccaacccacggctcaactcaactcggagatgggtacaagagaagaaaagaatcgggtcttaccctcttccatcgcatcgccgtgtaccatccagaggcgccattcacctcgccaacgctcgacggcggccctaacgtcctggtggtggctcaccggaggctacgggtcatcacagatggtgttcagagccgttccaatccttgaagaattttttttttccatcctaccctaccctatttctctctcgattccgctcaaatccgaggagtcgggagaaccatatttgaccgggagctgttccacgccgacctagacgatgcacccgtcttcgacaccgactcggacaacctcaacgacctgccggtattcgacactgagccggtccatgacgccgtgctcaaccaaggaataaatgatggctcgatcctcgacgggcaccctatctttgacgtggaagctcgtatttgatcaggagcctctcatcgaaatcgattgcagcatctttaacacgagtgcgcccttcatgtgtttgacagattgtctgagctacgttgatgatatggtgtctgctacttttaaggaggggcctatctttgataaggagactgtagtagaggcagtacagaaggaaagtggcagggattactatacttctcacggtgagaatgccacgtttattgcaaggacatagtatcacacaatttctgctttacgtcatttagccagcaactctggtggaatctcaagtgtcaatatgagggaagtggctctgattggaggaaaacctggaaatattggtagatttgaagacattttgtttataaacaatgacatgcaagagtcaccagtcactattgctctgtcgtctcctgttgtccgagaaagtcaattcggtgtagggcttagctttttggatatgaccaacatggagcttgggcgttggctgaattccctgaagatagccgattcacaaatgttggatcagcaagcacttcttgcgttatgcctcccagcagattgtgagaaatccatcaattcacattttcttcttcaagatgccattagtaaatgcagtattttgttgactgagagaaaaaaagtctaacttcaaatcaaaggatcttggaaaaatcagaggttatctgttaaactagttcgtgatctgatatctcaatttgaccactctcttggtgccttggagctctactatcttatgctgagttgctagcaaatgatactaattatgggaattacacaattgaaaagtacaatttggactgctacatgagatgagacttgattctgctgcggtgcgagcattgaccatgatgaagaaaaaactttatttgtgtggcttggtgaacagaacgtgtactatatattgagatgggaaaagagattgcttaaccgtgtactatcttacgctgcccatgttaacgacggaaaaaccaagccctgactggcaagtcttattcggaatgtcaagatctggctagtcgacttgcagggtcttacgttggggcagctcgcagtaaaagcaagtcagagatctcgaagatcgatcatccgagatccattgtcggtccttgatcttccttttgtttaatttctatccttccatgagcagatatataccagacatgtttgtcatttaccatcttgtgttgttgctgttaggatttatgggcttgg

SEQ ID NO: 26 - DNA, 5632 bp, Zea mays
gattgactagacaacttgttaacactgatcctgcctataccaaaatcactcacaagaggggaaaaaacagccacgcatgcttccagttcagactcactccagcatgacatgtttgatccttggacttcctttttagacagactaacattgacttcagttttgatgtaagcacaaatgaacatagagcaaaactacagaaatggcagactgaaaaacaacaagaaaatagaagcttcatttcagttggaatttcccagaatgggagcttctacgattgtcaagtagaataaatatcaccctggatcataagccaagagcattattttgtaagagactaaatttagataacctgtcattgaattgaaaagagtgttgcatgaaaaaagtaacatcaggttacaattacatgcaataaacagcatgaatgtgttatgtggggcaagcaatacaagcggagagggaagatgccaactggcctggcagccaggaaagtggctagccacgggtttgaccgtgattgccgacctggagccgaacctagtctattggttaaggaaataagcaattaggatatttatttgattgtgacaatttaggcttcagttagggccagaggcctatgtaagccatttggcaacctggaatcaagattaagcaatgaatcaatttattgccttcatcttcaaaatagggagccaagaggtaaaacctcgcttggattctgccggcgagtatagcctggaagccaaggaactccgcctacacctttgctacctccttaacgacaccgtaacagaatgtaatctagcaaactacctgtaacaaatcatcttcgtattgcaattttacgcagttccatgcgtgcttgagagaacatatatacagtaaaaggcttgtgaacaccaatcaaaataaatatgtgcttaccaaacagaacagctgctatcttaagctgcttatcaggatacttggggaagaatttatattcttcaaaaagatttgagatcatacagtcgaaaattgatacctccctgtcaacaatagcattcaaataatacaattatgaactgggcacagaacagtgtaagcaaaattctactgaagcacacagatgacagatctacataagttattgcaaaatagaacagagtactaatcaggcagcaactttgaaggcaaaggaactaacagtaagcattgaaacttctagattatcctaagcttatgtcaaaaaaatgtgatcctaccaaaatactgccccaatttggaacaaataatgtctataaagcatacgcataccttaaatagaatatacagcataatatcaacaaacaaaaaagcaagtttcaaagaaatgatcatggctgtcaattagcactcgggttaattaaactgttgagcatatatcttcttcaatatttggtaagctgatccaaacttatttccatcaacaagtttttgcagcatgttgtgaatgattgtccaaaccacaggatgtcagaaaagcaacaaaaatcagtccaaattaattccagttatagcttaaatttgcacctcttattcgtagattctttgaagcgcccgagcatttgtatcatggaatcaacgcttatttgtccagagaacatgtgttgaaaatatgcattagcctctacttcaatgtcatctgaccctccctctgaattagtaagttctctcacaacagagctaggtttcctcgattcatacagagcacacaatttctttatttcatccagtattacatctgacaagagctgccccgagtgagattgaagaacctgaaaatgtgcatgacatgaatccatacttgtcccccccccaaaaaaaaatccaaaacagcaaaactgaaaaaaataataaccatgaccatacagacctttatgaagacacaacaagactcccaatataagtttttgacaatagattgaggttgtgacatgccctctaagacattatcagtgttgctcatagttgctttcaggaaatcaacacattcctgagtgtaggcgagttgagttaggaaagacaaaccttataatcaagcattgaaataaacgggtagtttgctaccagaattgaacaacatgatggatgtgggaagaggtcagctgaaatgtagcagcttacaagaatagattatgcatattacctcaacgaaaccttttccatataaagataacttttcagtcagccatttctcaagatgactatagtctttcctcaaggcagcagcagccaattttatagaaaatgcaaatggagtagaatcaaggacagaagacagaatctgtttaaagtagaaataaaagttgagtgaaacaaatttgtgagaaaatagtgttacagcattgaagtaatattgtagcatggtcccaataacaaacagatgaaaaaaaaagttactttcatgtggataagttttgatacgatacaatttcagaaaataaagtgcattcctcttatacaaaccttcaagtcatgacaaacatcaacagttcttagcaaacaatctggatcactatgagcatcaacaaaacctcgaagggtgaagtatgggtttgtatgccagagataattcataacattgtgctttgttggatccttcagtagagcaggaaatatgcaggacagtacttcatactgaaggagattatacacggtctgcaaagagacaaggggaatttatagcactgctaaaaacaaataaaaatagatgcgactcattatgtgggaccagaaatgcatacgtcgatgcagctaacaccaaaaagaaagagataaggggaacttaacactattaaagtcatgaaactagaggcaaacccattaggtgggaatagaaatacatacagtgacatggctaacaccaacaagtaagagttcagggcaatgtcccagtggatactcaagcattgatcgtacagatgtagcgtacccaacttcagctagttggcataaaacttctaaaaggtcaaggcaggaccaagcatgattgccttgactaggacctgccaaatcctgaaattcctacagtatatgacaactgttaggtgtgaattggatagaattttatcaagatgccagatgttgtcagaattaccaagtgcctggacgaatgagcaaatgtaaatttatcaggtgaagcagaaactgcatgcttcaagaacgatatctggccttctctgtttttccacaatgacccacaaacagcatgaagtggaaatggatcctgtataatccaattaatttattaagcagctagttgattttccaagaatagaaatgtttatatatacataccttgcaagcacgcgtgtatatagacatcaataggtaaaagcctgtttcatcaggtatattgaaaccctcgtgatcaagatattccattacacgcacccagtttgtacttggggcctgcgtgttaaagagagatagagcgtaagggtgcaagataaaaaaaagaacatccaataaaaaagcaagaagtcaatagcttacgagttcattgattgaatccacaagaacatctgcgttccatttagtcagctgagatgagtcgttcgtgtggctattaagaatagcagatacaaatgttgcatatctgttatgggcatctccaagaccactatgagtgccaacaacagccccaagcaacttagatatggcgacatcatcaagaggctcaacaatggaaagtatttccttacagcgagtgttgtcaacagtacatccataacccaactcagctacaatgtcagccatgcttatttctttcccgatttcagacagaagtgactcaaaatcatcatttgtgctacccaagtacatatccaaatgtctacatggcacaaaaaaagagggggagcatttgtgaataaataggaatgaagaagtacacatattcagaatttgattagtcagaaactgaataccttgaaagatttggttgtctatcaaaatctccattagtgacaggtgcaaaaaacggcctctctgtgacttttagtagagatacaacattatttaaagtgtccagatgcttcaacaggccatcatactgatgcagaaacacgacaatttcatgaatttgatcatttgatacagattggataggattcatgcacagctcttcaatttgagcaattgaaaaccattgccctggaacaagaggcaatgtcaatgatcatctgaaaataagagaagcggatatgatatcactagactcacagagaaatgtctacctttctgctttatctctgagttctcagaatctgagagcgcaagcccaacaccaattttctcggcaactgagagttccagcagatttgacagactttcaagaaaatcatccgtcaaggctattgttgtcagcacctcacaaaaactggttgtgaagcatgtcttgcgcaaacaatatctgaaaacatcagataaaagcctttgttgcaactgcaactggaggttcttgacctccccagcattcagcaacacttgattcagacatactcggagcaccaaaatgcatccatccaggccactgtcaactaactgaaaaggtggggaaaataattggaattagaaaacatcgagcagactcagtattcagtaattagaactaagatatgatcgaagccaaagaagaaactcattttatcaagcaagtaggtaaactgctctattttgcgaaactacagtaggtggttcaacgagaatttgaactaaaactgccaatgaaaagtcaccacgagctctgtgattgaggaaatgaaatagatcagctagtgaatggaatgagttttagctattcatacagagtttaagcgcggtcataagtccaaaaacccactaggtggttcaacgagaatttgaactaaaactgccaatgaaaaagtcaccacgagctctgtgattgaggaaatgaaatagatcagctagtgaagcgaatgagccttaactattcatacagagtttaagcgcggccataagtcccaaaaacccacttgtgttaacctaggtcgctagcgctgaacttgtggcctgcaactctaacaaatctaaactcagaatcgacaatcgtaccgttaaacgctaccatatcctaagctagggaggaattgaacgcgctcacaagaatgcaggcgacgcagcattggcgagaacgcactagaacccgcggatccagactgggaagctaagaatcgaagagagggaggggggcgtaacgctggcaggaagcgggagggtccagcagtacagatgggtacctggcagatctcgcgccgaatggagtcgaagttggagtccgtagcgcattcaaacaggaggcgcagctccgcagcgacatcggcactgacggggatcatctcgccggcggcgaggggcaggggcggggagcgctagggcaagaggggtttgggggtcgagcgagttcttgtgagagcgtagcaactcgcggcagatgggaagagattggaagtgtgcaaagtgagggccggtagtcgctacattttattactggttttgctattcatcaaattttaataacaacggattcctttttatggatccctcctaatttgcggtcatcaaatcagttgagggtgtgtataaa

SEQ ID NO: 27 - DNA, 5441 bp, Zea mays
gcgacaacttgtccactgccctacctttgagtgcggtttgaactattgatttacgtaattggaagtaaccaattaggtttacgacgaaacctagaaatcgatcactgatccaatttgactacctctacgggatagacctcaacagaaaactgttgagtaacggcagcaagtgattgagttcagtagttcctcatagaaaattattgactctagagatatggtaatatggagaagacaaaattgtttgaagcacgcacagaaccggaagcgccccttgtttcaaagagaggaggacgggttattcacatttaatttgatggtcagaggcgaattgaaagttaagcagtggtaattaagacccccgggtgaaaatagggatgtctcctacgttacccataatatgtggaagtatcgacgtaatttcatagagtcattcgatctgaatgctacatgaagaacataagccagatgacggaacgcggagacctaggatgtagaagatcataacatgagcgattcggcggatttggattccttttctatatatccactcatgtggtacttcatcatacgattcatataagatccatctgtctagagatcgtcatatacatctagaaagccgtatgctttggaagaagcttgtacagtttgggaaggggttttttgagaaaaaagaagaatctacttcaaccgatatgcccttaggcacggccatacataacatagaaatcacacgtggaaggggtgggcaattagctagagcagcaggtgctgtagcgaaactgattgcaaaagagggtaaattggccactttaagattaccatctggggaggtccgtttggtatcccaaaactgcttagcaacagtcggacaagtgggtaatgttggggtgaaccaaaaaagtttgggtagagccggatctaagtgttggctaggtaaacgccccgtagtaagaggggtagttatgaaccctgtggaccacccccatgggggtggtgaagggaaagcccccattggtagaaaaaaacccacaaccccttggggttatcctgcgcttggaagaagaactaggaaaaggaaaaaatatagtgatagttttattcttcgtcgccgtaagtaaatacgtaactaggaatatggaaaattgcatttttggaatttgcaataatgcgatgggcgaacgacgggaattgaacccgcgcatggtggattcacaatccactgccttgatccacttggctacatccgccccttatccagctaaaggattttctcttttttccattcattattattctatttattctgacctccatacctcgatcgagatagtggacataggatgccactctttaaaatgaaaaaaaggagtaatcagctgtgacacgaaaaaaaacgaatccttttgtagctcgtcatttattggcaaaaatcgaaaaggtcaatatgaaggaggagaaagaaataatagtaacgtggtcccgggcatctagcattctacccgcaatggttggccatacaatcgcgattcataatggaaaagaacatatacctatttacataacaaatcctatggtaggtcgcaaattgggggaattcgtgcctactcggcatttcacgagttatgaaagtacaagaaaggatactaaatctcgtcgttaattgaattcagaatagaaagattcagaataaacaaagaaatacccaatatcctgttggaacaagatattgggtatttccggctttccttccttcaaaaattcctatatgtttaggagaaaaaccttatccattaaggtaaggaacttcaagagcagctaggtctagagggaagttgtgagcattacgttcgtgcattacctccataccaagattagcacggttgatgatatcagcccaagtattaataacgcgaccttggctatcaactacagattggttgaaattgaaaccatttaggttgaatgccatagtactaatacctaaagcagtgaaccagatccctactacaggccaagcagccaagaagaagtgtaaagaacgagaattgttgaaactagcatattggaagattaatcgaccaaaataaccgtgagcagccacaatattataagtctcttcttcctgaccaaatttgtaaccctcattagcagactcattttcagtggtttccctgatcaaactagaggttaccaaggaaccatgcatagcacggaatagggaaccgccgaatacaccagctacacctaacatgtgaaatggatgcataaggatgttgtgctctgcctggaatacaatcataaagttgaaagtaccagatattcctaaaggcataccatcagagaaacttccttgaccaatagggtaaatcaagaaaacagcagtagcagctgcaacaggagctgaatatgcaacagcaatccaagggcgcatacccagacggaaactaagttcccactcacgacccatataacaagctacaccaagtaagaagtgtagaacaattagctcataaggaccgccattgtataaccattcatcaacagatgcagcttcccaaattgggtaaaaatgcaatccgatcgccgcagaagtaggaataatagcaccagagataatattgtttccataaagtaaagaaccagaaacaggctcacgaataccatcaatatctactggaggagcagcgatgaaggcgataataaatacggaagttgcggtcaataaggtagggatcatcaaaacaccgaaccatccaatgtaaagacggttttcggtgctagttatccagttgcagaagcgaccccacaggcttgtactttcgcgtctctctaaaattgcagtcatggtaagatcttggtttattcaaattgcaaggactcccaagcacacgtattaactagaaagaaaatagataatagaaggcttgttatttaacagtataacatagtctatataccaatgtcaaccaagccagccccaacgattggattttcgtataacttcatttaccaaatccaaaaatttgggaaattaagttagtaaaaatgaaaaactcagattgctcttttctattttccatatgggttgcccgggactcgaacccggaactagtcggatggagtagataattcttccttgttacaatagaaaaaacccctccccaaatcgtgcttgcatttttcattgcacacgactttccctatgtggaaatagccaatttctattccgaagaggaagtccactaattttgagaatttttaattagttaaagtgattcacctactatggaacatttcagaatggaaaatgtgcaagttttatcttgatatcgatcttttctagtttattaattttgtctaatgattaattaagagtaagaggattcaccaggtcattgatacggataatatccaaataccaaatacgctcactgtgtgatccatggaaagaaaagtgaattgttttggtgaacatcaaagaaaaaacttgctcttcttccgtaaaaaattcttctaaaaataccgaacccaatcgttgcataaaagttcgtaccgtacttttatgtttacgagctaaagttctagcacatgaaagtcgaagtatatattttagtcgatacaaagtctgttttttcgaagatccactatgataatgaaaaatatttctacatatccgaccaaaacgatcaagaatatcccaatctgataaatcagtccaaacgggtttactaataggatgccccgatccagtacaaaattgagcttttgataaggatccgacaaggggagttgcaaggactgtggtatcgaattttttcattcgagtatctattagaaaagaattctccagcatttgattccttactaacaaagtatttattggtacacttgaaaggtaccccagaaaatcgaagcaagagtttgttaattggtttagacgaatcctttgtggttgagtccaaaaagagaaaaaatattgcgagaaattgacaaggtaagatttccatttcttcttcaaaagaagagtgccttttgatgcaagaattgcctttccttgatatcgaacataatgcataagaggatccataaagaaccatatggttttccgaaaaaaccccgggtacattacaccaaaatgttccatcttcccagaaaagatgattcgttccagaaaggttccagaagatgttaatcgtaagcaagaagattgtttatgaagaaacaacaagaaaaattcatattctgatacataagagttatataggaatcgaaatagtcttttattttcttttttcaaaagaaaaatggatttcattgaagtaataaaactattccaattcgaataatagtggagaaagaatcgcaataaatgcaaagagggaacatcttgaatccggtattcaaggagttgaaccaggatttctaaatggataggatagggtatttttatatgtgatagataatgtaaatgcaaaaatttgtcttctaaaaagggaaatattgaatgaatagattgtaaattttgaaaatttggtatttctttttcttccggacaagatagttgccctagcgagagtgggatttctacaacgatcgcaaacccctcagatagaatctgagaataaaactcagaataaaaataattacggtgatccaacaatcgatcttggttaggataattaaccgaattaattaaaaaattctgctgatacattcgaataattaaacgtttcacaagtagtgaactaaatttcttgttattacaaccaaaaatttccacgggttcggaaccatttaatccataatcatgagcaaatgcataaatatattcctgaaagagaagtgggtagacgaagtagtgttgacgagatttctgtttttctgaatacccttcgaatttttccatttgtatttctacttgaaatagagaaaaaaagcatttctcggtttatcaaatgatgatacatagtgcaatatggtcagaacaaggtgttgcataatacaaacccaggaaagaaagggagtctaatccatagaactttttccactccttttctatctaattagtttatgtttgttctaattataaaacaaacaagaacaaatcttttatttttgcaggccaatcgctcttttgactttggaatacagtctctttatcaatatactgtttcttttacacattcaattcataacatctcttttcaatccataatcaagaataattaggatttctaaaaaaaaaaagtaaagggtccactcataggaaaacctaacctttccccacattaggcactaatctatttttaacgtctaattagatcggggaatccttccaattaaccaattaagaagttaagctcgttgctttttttttattttaccagaattagagccagggtctatccatttattcactagacccagaaaatcag

SEQ ID NO: 28 - DNA, 5221 bp, Zea mays
tacatcaatctctctgaccgttccgcccgcttctttgaattttgcaatcaggctgtcagccttatgctcgaactgaccataaccagcgcccggcagtgaagcccagatattgctgcaacggtcgattgcctgacggatatcaccacgatcaatcataggtaaagcgccacgctccttaatctgctgcaatgccacagcgtcctgacttttcggagagaagtctttcaggccaagctgcttgcggtaggcatcccaccaacgggaaagaagctggtagcgtccggcgcctgttgatttgagttttgggtttagcgtgacaagtttgcgagggtgatcggagtaatcagtaaatagctctccgcctacaatgacgtcataaccatgatttctggttttctgacgtccgttatcagttccctccgaccacgccagcatatcgaggaacgccttacgttgattattgatttctaccatcttctactccggcttttttagcagcgaagcgtttgataagctaaccaatcgagtcagtaccgatgtagccgataaacacgctcgttatataagcgagattgctacttagtccggcgaagtcgagaaggtcacgaatgaactaggcgataatggcgcacatcgttgcgtcgattactgtttttgtaaacgcaccgccattatatctgccgcgaaggtacgccattgcaaacgcaaggattgccccgatgccttgttcctttgccgcgagaatggcggccaacaggtcatgtttttctggcatcttcatgtcttacccccaataaggggatttgctctatttaattaggaataaggtcgattactgatagaacaaatccaggctactgtgtttagtaatcagatttgttcgtgaccgatatgcacgggcaaaacggcaggaggttgttagcgcgacctcctgccacccgctttcacgaaggtcatgtgtaaaaggccgcagcgtaactattactaatgaattcaggacagacagtggctacggctcagtttgggttgtgctgttgctgggcggcgatgacgcctgtacgcatttggtgatccggttctgcttccggtattcgcttaattcagcacaacggaaagagcactggctaaccaggctcgccgactcttcacgattatcgactcaatgctcttacctgttgtgcagatataaaaaatcccgaaaccgttatgcaggctctaactattacctgcgaactgtttcgggattgcattttgcagacctctctgcctgcgatggttggagttccagacgatacgtcgaagtgaccaactaggcggaatcggtagtaagcgccgcctcttttcatctcactaccacaacgagcgaattaacccatcgttgagtcaaatttacccaattttattcaataagtcaatatcatgccgttaatatgttgccatccgtggcaatcatgctgctaacgtgtgaccgcattcaaaatgttgtctgcgattgactcttctttgtggcattgcaccaccagagcgtcatacagcggcttaacagtgcgtgaccaggtgggttgggtaaggtttgggattagcatcgtcacagcgcgatatgctgcgcttgctggcatccttgaatagccgacgcctttgcatcttccgcactctttctcgacaactctcccccacagctctgttttggcaatatcaaccgcacggcctgtaccatggcaatctctgcatcttgcccccggcgtcgcggcactacggcaataatccgcataagcgaatgttgcgagcacttgcagtacctttgccttagtatttccttcaagctttgccacaccacggtatttccccgataccttgtgtgcaaattgcatcagatagttgatagccttttgtttgtcgttctggctgagttcgtgcttaccgcagaatgcagccataccgaatccggcttgtgattgcgccatccccatagcagccatcacatcagtaccggaaagagagtcagaagccgtggcccgtggtgagtcgctcatcatcgggctttttggcgaatgaaatttagctacgctttcgagtctcatgcgccttctccctgtacctgaatcaatgttaggtttccgcagaacactgcgccggtatcgatatacatttggttggcaaacttgagtggtttcactgctggcgtatgaccaaagatgaacgtgtccgcgcctttgatttctttcacgatcccgttttgtgagttgctgattcgttcgcggttccagattacctgctgatgatcaactggctttccaaactcgtattcgtcaaagggataatcggcgtggcagataacatattttttatctttgctcaccagttcgatgattaacggaagttcatctgctttatgggcaagagctttagccagaatttctttgtcgtaatcgagattaaagaaccagccaccgccattaagcagccagtgattaacgtttccacgctctgataagccatcaatcatcatttgctcatggtttccacgtacagctctgaaccaggggaatgtgattaattccaggcattcaacgttctctgcaccacgatcaaccaaatcgcccaccgagataagcaggtcttttttgttgtcgaatccaatcgtatccagtttgttcatcaggttcgtgtagcatccgtgcagatcgccaactacccaaatatttcggtatttgctgccatcaattttttcgtaatagcgcatctctttcactccatccgcgatgaaccatgagaacgtcgttgacgatggcgtgcattttcccgtctttatcatcaacgtattttctgaccgtaccgcgactacatttcagtctgcgtgctacttctgtctgatttccgtatgcttcaacgagcatgtctggaatggtttttactgagaacgtcatgcggcctcacttctgctatttcgcaggtctttgagtttctgttggtactctgccttgatcgccttgcactcttcgatagtccagcgatggcggttatggtttgattcgatttcgtctactgcttcctgcccgatgcggctaatcagttcgacgcgatacggaacgagatttccgcttttgtgctggttgcacaccacgcattgcttgtgaatattgcgttcattaaatcggagttgaggtgccgcagcagttgtccggtaatgtccggcatcccactgagcagacgtgagcgttccgcacgagatacatggtaagtcgcggtctctttctctgatgaaggcgtttacggcttgttgggcttgtttaatccagtaactgcggggctttaaggcgagttttcgaatcttaagtttatctttctgtttctgctcctctcgtcgtcgtttcttctctgctgctttttccgctttttcgcgttctttacttcgtcgttcgagtgctatcttggttccacactctggagagcaccaccactgattagcgaatgcagggtgaaaccattcccggcattcatcgtttttacatcgtcttcgcgctggtttagccatcatcttcttcctcgtgcatcgagctattcggatcgctcatcagttctgcgcagcagtgctcacacacgtgaacttccagcacatgcagcttctgaccgcagttagcgcacgttaaagctcgctcgacgctttcttgttcgtaacttcgattttggtcaatcaccttgttttcctcgcacgacgtcttagccaccggatatcccacaggtgagccgtgtagttgaaggtttttacgtcagattcttttgggattggcttgggtttatttctggtgcgtttcgttggaaggtatttgcagttttcgcagattatgtcggtgatacttcgtcgctgtctcgccacacgtcctccttttcctgcggtagtggtaacacccctgttggtgttctttcacaccggagacaccatcgattccagtaaggttgatttggtcggaagcggttatcttctttgcattcaccgcaccgataacatcgcatcatgcagcttccctcccgaagtcgaaatcaagctgccctccaaatatttcgcatgactcagaacaagagccggtatcgaatcttttagctcgtaccatgtcctgatacagggcttgataatcattttctgaatacattttcgcgataccgtccagcgacattcttcctcggtacataatctcctttggcgtttcccgatgtccgtcacgcacatgggatcccgtgatgacctcattaaaaacacgctgcaatccctcctcatctttgcaggcaagtccgattttttgcgttgattttttaatgcagaatatgcagttaccgagatgttccggtatttgcaaatcgaatggttgttgcttccaccatgcgaggatatcttccttctcaaagtctgacagttcagcaagatatctgattccaggctttggctttagccgcttcggttcatcagctctgatgccaatccacgtggtgtaattccctcgcccgaaatggtcatcacagtatttggtgaagggaacgagttttaatctgtcagtgcagaacgcgccgccgacgtatggagtgccatatttctttaccatatcgataaatggcttcagaacaggcattcgcgtctgaatatcctttggttcccataccgtataaccatttggctgtccaagctccgggttgatatcaacctgcaatacggtgagcggtatatcccagaacttcacaacttccctgacaaaccgatatgtcattggatgttcacaacctgtatccatgaaaacgtaatgcacgtctttacctgcccgtcgcttttgctccattagccagagcaaatatgctgacgtcctgccaccggagaaactaacgacatttatcatgcagccctgtctccccatctcgctttccactccagagccagtctcgcttcgtctgaccacttaacgccacgctctgtaccgaatgcctgtataagctctaatagctccgcaaattcgcctacacgcatcctgctggttgactggcctattaccacaaagccattcccggcaaggttaggaacaacatcctgctgctttaatgctgcggtaaacacacacttccagctttctgcatccagccagcgaccatgccattcaacctgacgagagacgtcacctaagcaggcccatagcttcctgttttggtctaagctgcggttgcgatgctgaaacaa

SEQ ID NO: 29 - DNA, 5352 bp, Zea mays
gggtcctaagaataccaagaagctttctacccacctcccattcttggcgatgcctgtctaaaatatttcgtttgctcattctctgtatcggtacaaattggcgcctgtgatgatcgatatttcaatccttcacaacgtaagctattgtttcgtggtcatcgatcctctattgatggaaatcattgctcttggatctctgatttgcatgtcccttattacaaagtgaagccgtgcacctcgtcctcgagcatgcttgctccttcgatttacacttgcaaagttacacagccagaaacagctgcagctgcagctgcagcgtggccatcgcggcgagcgacacggggccgattcattgccctctgctatggcacgcctgcctgagcgccacgggcgggtccgagagcgcgccggcgacgatctggtcgaacacgaacttgttggcagcctcggtgaagtgcacgccgtcccagctcaccctcttggaggggttttcgcacgacttccccaccaccaccgacgtcccgttcacctgcttcttcccgccgcagccgacgctcaggtctaagttgtaccggccgccgccgtacccgcagcatgtcagcagagggtcgtcgaagcctgcaccacaaacaatacaaacatgagctccttccgcgcgaggaaacgttcagagccagccagcattagaatttagaaacaacaccaacatgaacgccttaccgagcttattggcctggctgatgagcttgtacttggcggtgtagacgtcgacgtaggtgaacgcggcgtcagggtgcgtcttccggaggctcgccacagtctccttgagcctgaggttgaatagctgcgcgaccttgttgtaggtgacggagcagccggtgccgtccgctgggatggcgaggtcagggcggtgcagcagcgcgtagggcaggcagccgagcggccctgtgttgtgtatccagaagtaccttcctccacgcgagtacacgctctgcaaatttgcatgtattcagctaaatgagcagaccatccatggaacgttgtgtgtggtaacatcttccaaagagcaacagcaacttgatgcttgctctgccaaagagcacctggattatagatgtgagcctctccatcagatcagggattatggcttcgacttcttcggtggtattgttaacaaagtagcttgaggtgatgtcgttttgaccgatgtcgaaggtgtaaagtgcctgggagaagtactccgcccttggtaggatctccctgtagataccgcctacatgtagaagagtaagtgttactgaataaaatcttgacgggataaaacataaaaatactgatggagatggtttggggggtttctgttgtcacctttgttgttgtagacgagttggcttctgttgatgaattgttcaaactcccagaactgcacgtccaaggaaatggggctgaaaccagagaggaacagcgatgtattctgtcttctgatcgatgaaccagctgttgcaaagttggctccctgtgtgaagttgcttccgatcgagttcaggtacgcactgaggtgagtcagccccaggctttcagctgcagttcgggaaacgaagagataaagagtaaatcaagaagcaccatttgatcatttgtcgctgaagagttactgtcttggcgctagtctatggcaaaacaactcgacacttaatgatcagtacattccagttggcgaagtctaggcctctagggacagaagcttctgttaccagttgacattcattgcgaaatctaaactgcgaggtgcatgaatttggccaaacacagtgaagccttccgaaaattcagtagaaatatagaacgaggtagttccatacaagttgaagccttgtgcattcagtttcttactgaattcatgcatttcgaacaggacctgcatgtgttttgtagcacttcccactgtctgctgttcagattctagtgttatatatacccttaaagttaccaaaggacagattaagaaaaaaatgtcagtgtcaccctttatccttcaactctggtgacaatctataaagtgaaacatccgtatttgataaaaaatattcctccactgccacccaaatctgattccctcctcatgccgctttgcccccactatattttcatgtacctactaccacaataggctaatgcttcttcctgtccttcccaatatcagcatccccaaaaggttaaagaggagttcgtctaaaataaaaagggctaaaggaagatcaacagggcatctccattgctcgtactgtatctcccaacagcatggcagtggcctatgatcgtatgcaaagatactttgcccgaatcactgaactttttgtcagattgcttggaatgaaaccaagatcgtgccagaaaggcaggtcaaaataatcacacgacacgcgtgctcacgtgctggattgagacggggacgcgcatcatggttgccctggggacatgcccgcacgcgcatgggccggtcgaggtcgaacggagcccatgctcgtccggcacgcggcacatggtctgaggccggtgtttcaggggtcatggtctcgtgtcagggactcggggttggctttgtcgtttcagagatcctgagcaaccgtctgcttctgcttgctcggttcggctctctgctcgtcgcgttccagccgagacgaagtgagaaacagatggtgattggtactaacgaaaactctaaaagccgtacgtactggagtccttgttacaggttactgctctaatttttttttttttgccccaaacttatcttcgccgcgggaccaaaggcagaacgagttaacgctgtgcattcattggtcccggcaagtgaaggcggttttgggtgtgtcaatcgatgggcccgacgcgcagtgcaatcatagccatggccatgggagggcaggtgaaaaggtgaacagtgaaaacccccgcgcagaccgtgtccatggcggcgggttcagcggccgagtggttcgggggcaggccgcaggcgagacgtacgagtacgactgtacgagcgcgcacgtaccgatgaagtcgatgacgaggcgaccatcgcagtagcggccggcgggcatgccgaagaaggtcctgccgttgggcggcggtgcggcgccgaagagcgatgacaggccgcccgtgtccgagttggagtcgccgaagttgaacacggccgggaagtggcagtcgccgcccgcgccggcgtcggagggccgcagcgccagcgccagcgccagcgagagcagcagcagcacggctgctctactccccgccgtggcagtcgcggccgtggccatttccctctccctgcgtggctgcgtcgcgtcgcttgtggcggcacggtggggactggggagtgagagtgaggccggggcgcggatgtctgtcgcggactcgcggtgcgcggtggcggtggactgatgtagtagtgggtcgtggcctcgtgggttcggaggcggatggggactggtcagtggatagatagagacatcagatatgggccggcacgcacgcggctccggtgccgtggcccgtggtccgtggcgtggcgcgcgcgcgcgcgagcttggtgggaagacacggcggtgacgtgacggtgcggcgctcgcctttctcggagaagggagaacggtgtgccaccgctaattcctgtagcgtttcctgctgtttgtggagcacgcgcggcacacacctggacgagcatcccaatcccagatagaaagaacacacggtggcgtggccctgctgagctccgcatctacagttaaaccatgatctatctaaacgttctgcagacttacttgcacacgtttgcccctaaattctgtttgcacgcaacagttaatccgtgtttgtttcagcgttctccggcagcgggtcatctttcggccaagtaacgagccgttccgtggttcagccgaacgatatccgaagtccagacggggtaacgtgcggcgtgccaaagacgagggaacggcggaacgcccgccacacgctccccgagctcggcgtcgcccgggccacaatggcggccccatccgcttccgccccgttgctccgctcccacccccaccacggctcgctcttcccctcgtcaccgcgccaccgtcccgcggccgcttctctgtctgggttcccgcccctcagacccgcctcagcccgcaggctcccatacactgcggtgcggtcctcctccaccgcctcaccctcggcaccagtagaagatgctcccgcggccgcggctccgaccggggacgcggaggaggagcgggtggtgctccccaccaacgagtcctccgaacgccttctgcgcatccggcacaccgtactgccgctccccttctccccctatgttacagtgcttgaactggcctaatcgtatgcttaatttggtctcggttctcaccaaagtcccgtcactctaatacctgtacagtttagtgtctcgtcaaaactatagacaccttagtatactgtctttcacaattgttgctgtagtgcgcccatgtgatggccatggctgtccagaagctcttccccaactccaaggtgacaataggtccctggatagagaatggtttctactacgacttcgacatggagcccttgacggataaggacctcaagaaaattaagaaggagatggtgagtctgcattcctgcactgagcatgtgcgaattgacctgaactgcaaagtggctgttttaatattcagggaaaaaaatagtggcggttttgatttgtcaatttggtaatttcaattgtttgataggatcggatcatccgacagaacctcccattggtgagggaggaggtgtcccgagaagaggctcagaagaggattgaagcactcaatgagccttacaagctggagattttggagagcattaaggaagaaccaatcaccatataccacattggttagccttgtaaatcggtgacttggatatctcaaaacaagagagattggtttgtttatgctagcgtgtattgatgatatcctgcgtgtcatgtaggagaagagtggtgggatctctgtgccgggcctcatgtggagtctactggaaaaatagacagaaaggctgttgaacttgagtccgttgctggtgcttactggagaggtgatgagaaaaaccaaatgctacaaagaatatatggaactgcttgggaaaatgaagatcagttgaaggcttacatccactttaaggaggaagccaagcgacgagatcatcggcgattgggccaggaacttgatttgttctctatacaggtgcgtcttacatcttggtttctgagaaagcatgcataattatagactagttatg

SEQ ID NO: 30 - DNA, 5349 bp, Zea mays
agtaccaagtggcccgatcggatcaaagcgccggagctgcttgtgtgagcatcgtttgagggaagagtttgagcgtgagggccttggacatgctatgatgccagcggcgctgattcatgtcgtaccgtctagataggagttggcgataacagagggcaacaggaggagggatgagccatggtaagcttgaaggttagagtcgaacgaggcaactggagaggtaaagaggacatctaggtatgagaacatttgcgagtgtccatgtttgtgaattaatgagtgagagacccgctacaaccccgatggaacgacctaaattacatgtttgcagggtcgaacgactagcggtattggttacatggctctttctgcaagattcatattagaagattgggcttctatttggtaaaagaagaacaaaaataactaatatttctaactaactaggatcaatagcacaagacatgattttgtttggtgttaccagatctaggctttaacatatccaactccttagcaaatacaaactagcagagaatttgattgagtacggaagcatatcaacggctgacgaattgcataaaccggataaaaaagttgacatataaatataaactagtcagatgctcgttcattgctacgatttctatatgtcatgtgactttgttttaataaaatacaaaaaatattggttatgtgggtatgaatgtggagccaacgactaaggttcaaaccaccacttgtggataattttaccttatttttccataaccgtggaaactgatgagcatggatgttgaagttgatgtttggaccatgggttggattagaaaacttatagggatttttttacaaaagggatgacggtggaaaccagaaaaattggtgccctataatagtagagaagagaaagtgaaacattaaagagagttttgaattggagattatcttgattgtttgcggtgattttgttcccgttgtggcagaaagtggtggttctcatagttgtggtaaagttttcttgtcagggccttgtagcctaggacacatcaatttacatacaaaagggcttaagctgaaaaaatcttcgacaactcagaaatgtgccccatcgattgttcaatggctcaacgtggttggaagagtccatctaaatactcagtgttccttaaaaatataactacagtaggtaaaatgtaaacacctaaaatatttctaaaagaactatgtgcatttcgaagattggtcgttatgcgacattgactattaaatttcaagcaaacatgaaaatatcatggagaaagaagttgttattttgaatggcagtaccaagaattatcggcaaactagcagcaacaacaacaacaataaggtatatgatatttttccttcatctatgtgaattccgtctttaaattttataagcaagttagttgacaatattgtgtggctttataggccacaattttccccattttctcttagaatacgactatggaagtgcataaatgtcctttagcgggataactagaactgtcatgcaaatattcctctttgacctagttattagtcataatccagttggaatctatcggaggtatcaactttgataatatagatgaatgtatcatgcattcaaaatcagaaggataacgtaaacgacataaatatatactgattcaaatattaggtatgttcaattaagagtatagctcttatctcgtatagtgaagtttactagagcgctagtggctagttgcatatataatgtagtctaaaaatatgtatcgtggattcaaatatgttttatagttgattacaagaaaacttaaatagaagaacgaccatatcttttagaagtcatcgtccaatctctatgtggtaagttacttgtccatcatgtctatcgatgtaccctcgtttgattaggcctcatcttcgctaacctaatgttaatgggcccttgttcaagtggtgagttgtcctaggtccatatgattgacattatatcccaaggactttgatgtcaggctagttgactgattcaatcctttgagtcctccaagcgcctgcgcgttgatgcaaccttcatcttccacttattgcacatcattaagtcatgctatagataatgatgaatgatcaaagaaatcttccaaacacatgtgtgttgatgcatcctctcttgtacaagcataatcgacttcgatttagggataaaccattgtcgggtatgatcttatcttatactcataaggactttgttatttatacatctcataatcatcgatatgtctttgttcctgtacacgtatccaatgtaacaagctatatcaatagctagaaggaatcacctctaaaagctatggaacaaaggaggtcatcgagttttgtgttgactttattcctagatttaaatcgattgatgttcctcaattgtggcatgaggtgaggctaagtgcatagggcacagtaggaaggaaagcaataattagaatgaataaagattatttccataaagcacgctgctcggttatgcaaaacatctcctggatggctttgtatatttaggaacacaagaatattctatactttgacttcccaagggagcctatagcccaaattatgcgtcgacatatgaaaactttttatggttggttgcgaaaaattttcgcgacaatgacattgttgataaacaaatatacttgttgtcttggagaccatattgcaatatctggacattgcatgagtatgagataaatgagactgttttgtacaatagcacaacttaaaagagcacaaaccaaaacagtggagttcacatatatgcatgtacctaaatgggaataagaaaatatattatggttacgtagaagaggtatgggaaattgactaaggaccttgtttagggtctctttgttttggtgtcaatgggtgaagctgtccggatcggagggggtaacaatggaccagctgtgaaagatgtgactaaggttttctatgttaaggatatgtctaccaaactgaagaatgggaaaaaacaagttacacgacaaaccaaagcattgtatagttcattcaaggaaaagaaacattgtaggcaatcaagggcaagtcataatcgaacacgtgagaagattatgatgaaaatgacaaaaatcaacccttcacaattaacactaacccaaccattctactataacaagaatggtccatggttatggagcaatcataaccaagtgacatatgttaataaaagtttattattgttccttctcaataatgatgtttaataatgcattagatttattatacaataattataaagtagttttatggaaccctaaatacaactcctaagtttccatagctgtggtgaattttgttgtatgtgccttaaaaattcatgcttttatgtgccacaaattaaggaaacactacgttttagatttttgctattttctatagctttgatgattttttgtttagcgatacaaagtgcttaaatgttgaattgacgctaccctagaaacaatccaaaatgttaccaaacttttgtattgggtctcatatggctcaatgaactaattttgttgtacgtgtaagagaaactattttattttgaaaatgtaatttaacctcgtttctccattttatcacaaagtaaatgcaataataaccaaaattaactaaagatcgaaatttttgtgtggatccatgctttaagtctaaatgcatgcaaaaaagtaaaaatttaaacactagcgtatctcttctaatatataaagcgtcagttccacgctcatctgttcccttgacctctccatgctctccacatttaaatgggaaaaggctaaaattatatagaaatgatgattcgaaccatggttgttgcctctaaacccatattcacactcatgcggctaatataacacacatatcattttgttttatactttatattcaagcataaatggaaagtgaagtgtttgtgccatttcatgaatactcactacaactcctaagtttccatagcgctcgtgcaatttgataatattagtgttaaataggacaaatttcagaaactttccatttcagtgtgtgaaataagggaagcgtaggttttttcatggtcaaacctggaattttatcaatttgttgtattagcaaaatattggactagttgttatacagctcgctagccaattataattaatctagacaatttttagcgttgttagaagttaaactgtcatatcgatttcagttacaagacctgatcaagatgctctacaaaaccattatcgcagcagcacacttctgcaactaattcctatatagtgtgttttccatcatccattatttgctcgcgtcacgggctgcagcgcgctggtctgaagaagcgccaaaaggcaggcctggtctcgatcgaaatagtggccgttccggcggctcgcgcgtcgtgtcgtccacacgtacggcgaggacgacatgacatgacagttccgatgctgctgcaatgcaatgcaactgtgccttgcaacatggcagccgaaaaacagcaatcattgacccaagagagggaaaccacgatccaaatcgtcgcggcacgcgtcgaatcaatccgttcgatgcatgtaaccggcggaggagcaactagtagtactccctgggacggtgactggggactgccgggcggtggcgagtggacaggtgagaggatcggagcagcccgcgcgctacagagcggggaaaggaaaaggagagcagggcctagggtagagggttaggtcgcagcagtgctgctacggcaggccgctagtagctccagacgacgtatggaaatggtcgcaccgttatgcccctgtacggctgtacagctgtactctgtacgtagacgatggcgcatggcaccagatcaacgtgcttgccagttaagcaccccggccgggctagggctagccgtcgtcctgctcagcttcctcgcggagcagatcaaggacacgctcgtgactcgtccatatgtcgtcctcgatctgctcgccaccgtgagcggtcgcagtacgtcgtcgggcacggtagaggcatttcgcgcgcttctccaagcgtgccggatcgtccaatcgtctgccacataccatattatcgtggtgcatgcttgcggcaaagtttgagctcgtccatggcagaagaggatggatgacgctcaagatcggcgccggtttctgcgcggtcatgttgacctcagctgtcgcgatccgctgctctgtactggcggcggctggatcgaccagggcacgcccacgcagtagttatactagctcgtaagtgatatgttatgcctgcttg

SEQ ID NO: 31 - DNA, 5271 bp, Zea mays
cacaatgtcgaattccaaggcatggttacttgaattttacatgcatgtctatttggataaattcccaacttcactcgtgcaaactaaagaaaactaccttgaatacatgtatggaaaatatgtcatctggacgactagattctttataccccaaattcaactatgccatcgatctacaaccatctcctttgatatatgcctttcaatcaaagttaataggcaaaagcttgccataacattcatccatttacttttggtgcaagttccatggtggttttgtaacctttgtattggcatcaggtatggagggtgaatggaaatgtcaagacttttctttcagctgctgaccaatcaaaattttacactggagattgttacatttttcaatacacatatgctggagatgacaaagaggaatgtcttatcggaacttggttcgggaacagaagcgttgaggtaacatctgctcataaaatcaacatcagtgatggtttcaagaatttaaacccacacagatttatttaagtcaagagatattttcattgttccttgttgtatctccatatgtttctaataaatgtgtttttgaggcaagttactccttgtgaatcgatcttacttgcttttaggtggagagggtgtcagcgctgtcattggctagcaagatggttcaggcttcaaagttccaagctgtccaggtaatctgcggattatttatatcttaaagcatatttttggcctctaattttttatgcacaggctcggctttatgaagggaaagaaccaatacagttctttgtcatatttcaaagtcttcaagtgttcaaggtttgcttcgaattagcagtcaaaatccttaacatgttataaaaaatcttaatacttctatgttgaatgctctataagtttcctctctttctgaattttcaatatagggtggccttagctctggatacaagaactttattgctgaaaataatattttggatgacacttactctgaaggtgggattgccctatttcggattcaaggttcaggatcagaaaacatgcaagcaattcaagtagatacagtaagtttggggtcatactttggtttgtcaagatatttgtgagaacatcagtcttatcttcattaatgagcgtcttaatctttctcatctttttgttagctggcttcgtccttaaactcgtcctattgttacattctccacgatggaaacactgtgttcacatggactggcaatgttacgacctcattagatcatgacttggttgagaggcagctagatgtcattaaggtttcaatattctttctcatttgggtgaatacatcttcgtacaatacagatttcctgatgattagcaaattggcagtttggtatcaatgtaaaaccttgactaaattcccctacaaaggttttgcatgtttctgatagaaaatagtttgagtatgttatgcacaaagcaatgctcaatgacacttttattcatgtcacatgttagtatgtagtctaactgctaaagaaaacaaaagaaatgcatgtgagagttaattatttgatttctatgatgatgatataagtctgatagttatcaatggttactagtattggaccagcatattcttggtcttgcggcaacttatatttttcttttgcaatttagtaaaagaaaattagccatgcacatgaatgtagtgcaaatcgatatgactaatagttacttggtttagttgtttgttacaaatgtgtttcatgttgtaaatgtatatcatgttgagtttctttagtatgttttagttgtgctagattttggtccatttgtgtttgttggattgtatgatggcaacaaaacaacgtataggtcttcctctagactcatatttagtatagattggatgtttataccctgttacattgtcattgttgatgctgaatccgaccaacacaatagtaggggctagatcgcccgaggctgcatatagcctagatacatagttcagttgggtctaaatggcaaggctgatgtgcaagtcaacaaggccgatttgacacttcttcacccgaaaaacccatgaacaactcctagaaagacacgttcgagagacacacatcaggggtgtcctaggatcgacaaggctatctagaatgccatcgagtcttgttgagagacgctcaatagcgagaggttggaagaggtaaaaagtagtagattgatttttgatcaattgtgtagtcgaatacctcaatcggacctgatcctatgatatatgtaaagggtgtggtcttatcccagtaggaaattttcccaagacatattctacaatttatccacgagattagaggagtttgggttagaattacgagaagtggactcgaacagggcacgtcggaacttggaacttttgttgaatgttggaacttccaatgcccaactcccgaacccaggagccttgcaagttagaactttcctctgaccccttttgctatcaactgtcaccctccttgtttttatgtggttttaaacgtaatggtaggaactctgcatttcactcgagaagaaatagaattacctttcgcttgtatgttttttgacaggtacattagtcgtctattttctgcttatttggctccaacatgtttttcctaagttttaactctttttgtgcttctattttttattgtacagccagatctaccttccaggtcacaaaaggaggggagagaaaccgaccaattctggaaactactgggtggtaaatccaagtatccaaaccaaaaaattgaaagagaaaatgaaagtgatccccatcttttctcgtgcatcatatccaaaggtaactacaaacaaggattttctaagttgaatgcactgttcaacatatactgacacttctcttctttggctactaatgttgttgttgggggttgtgaaggcaatttaagggtaaggaaaacaaagatgacatggttttattgctaagtgctttcttgatttcatgtctaatacaaacattatttttaaaatgtatatcaggttaaagaaatacaccactttactcaggatgatcttatgacagaggatgtttttgttattgattgtcactcagacatatttgtttgggttggccaggaggtggatgccaaagtgaaatcacaagctatggatattggagaggttaaaccaaaattatcctctataaattagaaatcatgatttttatttatttctcactttctttctcactataactgctagaaatttattgttcatgattttcttatggaaaaactatcacgagaaacaccaatattcattgtgtcagaaggcagcgagccacaattttttactagattcttcaattgggactctgcaaaatctcatgtaagtagtttgtgtcctgcacttgcttattgtgaattaacaccaattctattccatgagatttttacacctatgtatgcatgcctggtatttagcattggaaattaaattcatctttgcacttctgaatttttgttgcagatgcatggcagttcataccagaggaagcttgctatcctaaagggtggattacctccatcactagaagtaagtctcaaacaaatgatttttctagtagctcggtggaaatcatcttctacccgctttttgtgaatttagtatagtttctatccaagtatgtggttgcaaatcaacttttggttcatgatatgcatgtttgttgatactcttgctttctcgacattgttaacttcttgtgcgggtatatagatgatcacaaatttaggttttcagtattttaattaggaatactatgtcatttttatgattgagcctcaacatatatatatgttgaccataaggtttcagagaaggaacatagggtggctaaactagcgtctaagttgaagtcttgctatctaaaagcagctctcttactatctccatgttttcagaaaccaaagcgacgaacaccagcatttacgggaagaggttttggacaagataaatctcagcgttcaagaagcatgtccactagtccggatcgtccacgtgttcggggaaggtctccagccttcaatatgttaacttctgcctttgagaacacaagcaatatcaggaacctttccacccctcctccagctgtgaaaaagcttttcccaaaatctggaggtcctgaacactcaagggtatcacccaaaaaatcagctatcagtgccctcaccagctcttttgaagcacccctaaaaagtacaataccaaaatcggtaaaaggtataatgaatacaactcttcaaatatgatagagcacgggtagcaaaagttctagttcttatatatcttgtttctttttttgcaaaactaagcgagccctgagccagagaaggcgatacaggagcaaggtgtcgtaggcggtgcaagtgaaaacaaactagaagacgacgaaggccgcacgatctacccatatgaacgtctaacaaccacagctgaagatccttcccctgacattgatttaaccaaacgagaggtaacaaactaatcttcctccttccattcatacatgtttgttagatcaattgatgattccatttactgttatcaactaaatgcagtcctacttatcgtctgttgagttcaaagacaaattcaacatgacaagggcggtgttctacaagctccctaagtggaagcagaacaagttgaaatctgatgtccagcttttttagtcttcccatggtcgtcttgaattttgactcctgaagacagtaactgtttgtgaggaggaaagacaccaattttcatgtttagagctcctatcttcacctagttagggtttgtttggattctttcttctaaaatttagagctctaaactttagagataaagatctaaataaatgatctaataaagttagctctaaaatatagctcacctcatattagagctttagagctcaaaagtgagttagctaaagtatctaaagcttttagagctctaaaatttagaggggatctaaacagggccatagcctattctttgtgaaagtacttgttctttccatttataggatctaagatccaatcagagatcaagaggattggaattccatagctcacttgagttgtgggggtctttggattttggatcacgtgttgatgttttttctagtttggccaacgtttgtgttatgggattcagatcgcaaaaggttgccacgattagatatacttgtactttctcgcaatacaacaacaatgcatgtac

SEQ ID NO: 32 - DNA, 5174 bp, Zea mays
aacaaaagaattaaatatagaaaaattttcattccatttttaattacaatttgctctatgcgagactataaacaatactagtttaggcatgctatcttaaaccatatgtagtgctattttatatatatcttggttatggacaatggtgcatgttttgaggccactcaaaaaacaagtatgggactcatgatatttactacaaaacaatttaaccaatgaaaattacattacaatttgctctttgccaaattgtaaacattacttgtttgggcatgttatgtcataagatatgtggaaagatttcaaatgtttcatggttatggacattaatgtaagtttgaagacgttcaaagccctaaataatgtaatgtttagaatgaaagtttttacaaaaacgacccaacaaggtttgtcatcaaagtttttgcaatacaatgatttgggagtaaatggtcatgatttcatgcatgttttcttgaacagattgtggcatgaaccatgcgaaaactttgaagcttttcgaagccctaaataatgtggtagatttatagaatgatccaaaatgttgtttcacacgctccaccagcaactaaaattcaacacaatcaaaacttgagtgtgggacccacataattagatggtcgcatgccgattaaagtttagtgttttgaagaatgaggtaactttaaaagtatttgaattgtaatatgcagttttttcaagataaacgattttgcagagttacgacctctattaaaggaaaaatagttaatggaagaaaaattatatttccactttcattagtcttttccaaatgtcgtactgtaagacatacttgtttaggcatgttaccttaaaacatagacaacctatcgcatgagtttggtgcccaagatattggatgttcgaatgatggcactagagtttgtaattttctggaattgagagcaatatttatgcaattctgcttttattttgatccatgttttaagattctttgttattattctattacatttatatcaatttataataaaagaattaaatatagaaaaaatttcattccaattttaattacaatttgctctatgcgagactataaacaatactagtttaggcatgctatcttaatatgtagtgctattttatatatttcttggttatggacaacagtgcatgttttgaggccactcaaaaaacaagtatgggactcatgatatttattacaaaacaatttaaccaaggaaaataatattacaatttgctctttgccaaactgtaaacatcacttgtttgggcatgttatctcataagatatgtggaaagatttcaaatgtttcatggttatggacattaatgtaagtttgaagcggttcaaagccctaaatgatgtaatgtttagaatggtagtttttacaaaacgacccaacaaggtttctcatcaaagttttcgcaatacactgatttgggagtgaagggtcatgatttcgtgcatgttttctcgaaaagattatgtcatgaaccatgcgaaaactttgaaacttttcgaagccctaaattatgtggtagatttatagaatgatccaacatgttgtttcacatgctccaccagcaactaaaattcaacacaatcaaaagatgagtatgggacccacataattagatggtcgcatgtcgattaaagttcagtgtcttaaagaatgatgtaattttaaaagtatttgaattgcaatatgcaaatttttcaagataaactattttgcagagttacgacctctattaatagaaaatagtcaatggaagaaaaactatatttccactttcattactcttttctaaatgtcgtattgtaatacatacttgtttaggcatgttaccttaaaacatatatagggcacatcaatccaagtttagggcacatcaaaacatgagtatgggactaatgggtattaattttgtgcaagtttaatgcatgatatatcaatttctgatgtgcgtcaacttcgaagcattttgatgccctaaatattgtattgtttagaaagacagtttttgcggatggacccaacttgttgtttcgcatgcaccataattaatccatgctaaagacaaccataacatgagtatgagaccatagattttcgcatgctagcactagatttggtcatatgaaagatgagatcactctagaagcgattgaagcaaaacatgtagattattttcagatcatcaatttattatttgcgtgagctatccaacatgttgtttcacatgcttcatcatcaatccatttgcaagacaacctatagcatgagtttggggcccaagatattagatgttcgaatgctggcactagagtttgtagatatgaagaatgaggtaactttggaaatgtttaaagtgcaacatgtatatttttttggatcggtaattttccggagttcagagctatatttatgcaatcatgcttttattttggtccatgttttaagatactttgttattattctattacagttattccaatgatatttataacaaaagaattaaatatagaaaaaaattcattccaattttaattacaatttgctttatgcgagactataaacaatactagtttaggcatgctatattaaaccatatgtagtgttattttaaatgattcttggttatggacaaaaatgcatgttttgagaccactcaaaaaacaagtatgggactcatgacatttatcacaaaacagtttaagcaagcaaaattacattacaatttgctcgatgccaaactataaacatcacttgtttgggcatgttatctcataagatatgtggaaagatttcaaatgttttatggctacggacattaatgtaagtttgaagacgttcaaagccctaaatgatgtaatgtttagaacggtagtttttacaaaaatgtcccaacaagatttgtcatcaaagttttcgcaatgcactgatttgggagtaaagggtcatgatttcgtgcatgttttctcgaaaagattgtggcatgaaccatgcaaaaactttgaagcttttcaaagccctaaattatgtggtagatttacagaatgatccaacatgtttcatcaatctactataggcgtgagctatccaacatgttgttttacatgcgtcatcatcaacccaagtgcaagacaacctatagcttgagtttggggcccatgatattagatgttcgaatgctggcactagagtttgtagatatgaagaatgaggtaactatagaaatgtttaaagtgcaacatgtatattttttagatcagtaattttctagagttgacaactatatttatgtaattctacttttaatctattacaactatatcaatgatatttataacaaaagaattaaatatagaaaaaaatttattccaattttaattacaatttgctatatgccagaccataaacaatactagtttaggcatgctatcttaatccatatgtagtgttattttaaatgattcttggttatagacaataatgcatgttttgaggccactcaaaaaacaagtatgggagatatttatcacaaaacaacttaaccaaggaaaattacattacaatttgctcattgccaaactataaacatcacttgtttggacttgttatctcataaaatatgtaaagatatttcaaatgttccatggttatgaatattaatgtaagtttgaagcggttcaaagccctaaatgatgtaatgtttagaacggtaatttttacaaaaggactagttgtcatgaaagttttcgcaatacactgatttgggagtaacgggtcatgattccgtgcatgttttctcgataaagattatggcatgaaccatgcaaaaactttgaagcttttcgaagcactaaattatgtggtagatttatagaatgatccaacatgttgtttcacacgctccaccatcaactaaaatttaacacaatcaataacttgtgtatgggacccacataattagatggtcgcatgacgattaaagttcaatgttttaaagaatgaggttactttaaaagtatttgaattgcaatatgcagatttttcaagataaactattttgcagaattacgacctctattaacggaaaaatagttaatggaagaaaatttatattttcactttcattactcttttctaaatgccgtactaaaagacatacttatttaggcatgttaacttaaaacatatatagtgctatttgcaatgttcctcagttgtaaacacatcaacccaagtttaaggccgatcaaaacttgagtatgggactaatgtgtattaatttcgtgcaagtttactgcatgatatatcgatttctgatgtgcgtcaacttccatgcattttaaagccctaatattgtattgtttagacagatagtttatacggatggacccaacttgttgtttctcgtgcaccatcattaacccattttcaagacaaccataacatgagtatgcgaccctaaattgtcgcatgctagcactacatttaatcatatgaaggacgaggggactctagaagcgcttgaagcataacatatagatttttttcagatcatcaatttactataagcgtgagctatccaacatgttgtttcacatgcttcatcatcaacccaagtgcaagacaacctatagcatgagtttggggcccaagatattagatgttcgaatgcaggcactatagtttgtagatatgaagaataaggtaactttagaaatgtttaaagtgcaacatgtatattttttagatctataattttaaggagttgagagctatatttctgcaattgtgtttttattttgatccatgttttaagatactttgttattattctattacagttataccaatgatatttgtaacaaaagaattagatatagaaaaaaattcattccaattttaagtacaattttctctatgcgagactataaacaaaagtagtttaggcatgttatgttaaaccatatgtagtgctattttaaatgattcttggttatggacaatattgcatgttttgaggccactcaaaaagcatgtatgggactcatgatatttatcatagaacaatttaacccaggaaaattaaattacaatttgctcattgccaaactgtaaacatcacttgtttgg

SEQ ID NO: 33 - DNA, 5162 bp, Zea mays
tgaatggaaatggaacaatgtcatcgtgtggaaaaaagtgaaaaaaaaactgaataacactgcaggccaatgagtgaggcttgtaagaactgcgtgtggtgaggaattcctcccgcaggccgcggcacacactcagattcaatttagagcatgtggaatcaatcaaacacttactccagtgaggagcgagctgattcagccgttggagaagcacgggtactatttaaaccgctgcggatttattatagaggaaaccgacgttacctccgaagaggcgcccaacaagaacagcgggacgcctttgtcgtcctcggcggcggcgcggagctgtggttggacagttggagcgactcttctgtcggacaagacgatgagcacggcgcaccctactttgaggccacacgtccacaacagccgtccgatcgcacgacgacggcgcaaagttgaaccgagcgaggacgggtctgggctggctctggtttgagccgacgaccggacgacgtgcttcgcagttcgcacgaacaatctggactggagtcgagttctgcgcaagagcgggcccgcccaaaacaataggtggcctcctgctctcccatgcatctccgtcggcccaacaatacagagtggcccaacttctccaatgcgcaactgctgtacgctcgacgtgaaggcgcttctcccaatctcccctccgactcccgttcctgcgccccaaaccctaggtccgttcgcggcggcggtggactgccagtggcagctctccgctcggcttggcttgggcagctgccgcgccgcgcacctacgggcagcggctgggcggcccgcgctcgtggcagcacccgctgagactgagaccgccaccggcggttcctgggctggaagccggtgcagcagcaggcagtagccatctcggccgccagttccaaaccctaaccgagtaaccgcagccgcagccgcagccgcagggtgcaggcacgcaccagcctcacgccagccgcgccgccgctccggccagccgcaccccgtgccggccagctgcgcccacgaaggtgaaaagcagctttacttgccggcttggttttaagtacaattcacatattaggcttgtgtcatcaagaccatgactaggttagcatctctctgtttaacacttcaacatctgatattgcactgtttctgataaagttcaactcgagtatggctgtgtttcatactgttcgatgtgcccttacgctcggtgtttcttttcctgatttcctttctaaaaatagtttaatattttgggttgtaacactggaaatctgctcctttaacatttggaggtggttattccctgtttatcagggttaaaagccaccttttctttatttcttcactggaactctactttctagtaatatgacaaacaaggttaattggtgactaaaagaagtttgactctgaagttcattatgttgttaagtacagctgtggaactctatttgcaatatgtttacaatttattctgatcacgatcacattttaattttcttgattatatgtcagaattgcttaatctgaaatcttcagtccaagggaaagggaaagttccttcaggctattttaatgctctctataattaagtggagcttggttgactgatgccaaagagaccaagcatctagcttcgactgatatttcatttctttgtactacttgcacctaaaggcttctccattagttctttgagatgaagtaaaaaaaaaggctgttccatccaagtgggatcctgttgcattgtcattaggactaaacgtcggccatccttgttcattgattgtggatcagagcagcagtggcatttcaatagtctcgtgagggtaaaaaaacccaggcaaaatgagttaaaaagtttattttttatctttcacggctggttactctgggagagctgggtcgttaaatgggtcaccacctagcgccttttctaaccttgagtaggtttgttgtaagcatgcttatttctacctattaatctaaatgtgcagcaaatttagatttctgacgtcctttcagttgaccttgtttgcagttccattatgacaagttctcctgtcgtatactgttttcctttcgcttttgtatacccacggtattgatattgtttatcagtattttgtgtataggaatctcaacttctttgccgaggtttatcgacagttgtatttgttgggaaaagtagcagtttgactctatataatagagagtgccatggacggacctgagtctagtagaggtcgcagtaagcaggaggttgatgataatgttaatgcaaggaatacttggaaggaggagcaagaaaatcaggagaatgtggatagcagaaattattcggatatatccagaaaacatggatatgaacatgaaactgggcatcaggatgataatagaatgattacaccttcaaatgataggaatgaatcaaggaggaatccagatagaagctcaggcctggctcgaggtgccgacgatgacgtctataatctgagaagggactcacgatctcctaaagttcaaaggagaagccctgatgattccaaggatcgagactatgatagaaggaggggaagaggggacaataatgattgggaaccttcaagaagatttagccctgatgcttctgctaggagttcagagagaagagagggtagtagggagaagcaaggacaacgggatcaagatgaaagggcatcagtcaggagggtagatgaagtttatgttgatgaaactggtggttctcttagagttgacacaagagaagcttatagagatgataaatctgacagagggagggataggaattggaatgagaaaacccgagacattgaaggttctaaggactatgggaggaacactcaattacgagatactaaggagccaaatgattttgaatggaggaatgcacaggaaaggctagatggcgggaatttccatggccgaactggatatcggagagattctaggggtagatctgaaagtattagaggtccctcaaactatgggaaccgatacgacaattcagactcaatagagattcgacctaatagtaatcttaactttggaagagagggctctgtttctggtagaagatttgaaaccggagcacaccgagattcagtacctggaggaactgatgataaatcctctgatcatcttgaaccagatccaagtggtagcacaagcatggtttcttcgtttcctcaacaaggtccaaaaggcgataggtcatctagaggaggaaggggtagaccaaatggaagggattctcaaagaattggagttccaatgccaatcatgcctcctccatttggtcctcttggacttccaccaggaccaatgcagcatatggggccaaatattccccattctcctggtcctcctctcctacctggcgttttcatgccgccatttccagggcctctagtgtggcctggagctcgaggtgttgatgtgaatatgctttctgttcctcccaaccttaccattcctccagttgctccagaacataggtttgcaccaaatgtgggagctgggtctagtcataatatccacttaaatcaaatggacactgggttaggtggtccagcagatatatcaggtttgggttacaataatatgggtcctcaaagccgtgaaatgctccatgataaacctggttggatgccacataggaacagtggaccaaacagaaaagctccttcaaggggcgaacaaaatgattactcacagaactttgtggacactggcatgaggcctcaaaatttcattagagaactggatcttacaagcgtagcagaggactatccaaagttgagagaactcatacagaggaaagatgaaattgttgctaagtcagcttcaccgccaatgtattacaagtgtgacctgcgggaacatgttctttctccagagttttttggtaccaagttcgatgttattcttgtggatcctccatgggaggagtatactcaccgtgcgccaggaatcacagatcacatagaatattggactgctgaggagattatgaatttgaagattgaggttttccccttttctttatcctttctattttgtgatttcatttatgctgcagaattaatatttagaagtgtattttttgaatcaacaggctattgcagatacaccctcctttgtgttcctttgggttggtgatggtgtaggccttgaacagggtcgtcagtgtttaaagaaggtagagcctgctatttccgtacttaaatgactgcgctctatattattattgtaatgccattcgttttgggggatggggtgggatcttgaaatcattttttaggaggtcacccaggttcccgcagcttcaaatcaatttttgccctctgatggaatgtcgtagcaacataaacattgtttcatacttccacagttttatttcatgtatgtgtgttttaattttcagttgttgatgagctgcaataacaagtagatgaggctgactgaaatttttctatgatcagtggggattccgtaggtgtgaagatgtttgctgggtgaaaacgaacaagaaaaatgcagctccaagtctgcggcatgactcacatacattgttgcagcactcaaaggtagtgttgtacttgattagtatgtgatgtatcattttctgccatgcctacatgtctttttcttcttctgtttttctctggttctcatgcgaagtatctaccctttccatgtgcaggagcattgcttgatgggcataaaaggaactgtgcggcgtagcacggatggccatgtcatccatgcgaatattgacacagatataataatagctgaagaaccaattgatggtatttttcctttggtttattagttttgttcctattcttgatgcaatctatactattggcttatgaccaacggcaatcattttcaatgatgaggtgcatacactgagtaaacttgttttctcgaaattttcttctttgctttctttctgttgaaaatggagttccctgatctgtttttattgctgccatggtatgaatattccaattttgtccaccaaaatgtgttactgtgttgtaaatttggcttggttggcaaaaacatctgtcttggatttataggaatttgggattataaac

SEQ ID NO: 34 - DNA, 5139 bp, Zea mays
taataacacttaaaagaaaaaaaaactagatgtcaagatattactaagtacaacgtccacgttattttaacttaaccgaatccaattcaagcagcaagcgataataaactaagcacaagtattatatcaaccttagctatagaacacaccaaaaagtgaacgagacttaggctcattattttgggacaccaaactagaactatggacagaagcaacttaactaactatttaaaccactcttttgaattaacctttataatatccaaactaataaaacatcacactatacttaatctatcaagtagacaatcatcacaccacatatatatttaccaatatacttatcacataaacctaaaattcaactttaacctccgcatcaagtaatagacaagagaatcatcgcaatcgatacatctatttaatcgaaccatctatctagttgacgggaataacgaatcaactcaccataactaaactcgacccgaatccgcgaggtcaacgacgattctgcggatgaggacaacgaacttgaagggcggcgcggtgaaattattggaacggctgagtcatggacgtggttctgtcgaggcgagaacaagaaacaacgacgacgtccaaagcacgacttatgaagaacagaatggcgaccggcctaggcgcgatgggtgagttgagcgactccgacgacgtgcgcgagctcgttctgggcatggacgtgagttggagcagaggagaacacggccgaaggtccggagtggcgctgcgtggtggagattggcagccgggtgtcgacgagtgcgtggagtcctgcagaactgtgatgctgaagatggcgtggtgacgagtgaacacggggctgagtgacgacagcggtgtccgagtgctgtgaggcaacgacgaggtcgacagtcggtgtcacggatgaaaccgagatcggccatgacagcggagctacgacgactggatcgatgtcagttttgagcttgcagacgacggtgttgtccggcgaggccacacgcagaggtggccagcccaagtgcacgacgcgcagtgcggcgatggcggccaggatcgagtgttgctggccagtagcgtgacggcgaggtagtggtgaggcccggcgagctcggaacaggggctcgacgaacggcggtagggaggtcgagtacagctgaggataagatcagcgtgtgagggagatacccagcggcggctaggagaacgatgggaagggcacgcggccaggcacctaggcgaggggagcacgtggcttgctgggggctcctacagcctggacatgatagggagatgagcaggaaacatgcacgcggataaggaagaggatgtcgtaggaaagtttctagcgtctaggagatgtacgtgacctgtgaacttgtaccggctgaagataatatcaacagaaggtaaggctaaaagccttgggaggggatgacgtggggttgagaagaaaaggggattatcccccattttcttaaatgaatacataaagataattagatcataggaatagagggctgtgggatatttccggagaaaagcacggactcaagataaggaatgaagggagatgaacacgtaatttttttagcgatgattaaagggtcgatgatacgggctacatatctcattctaatgttttagcaaactaaatcatttaccaattacttgctgtcagtactaattatagtggtttggtttgcttcggacaggatgcaaatagaccgaattagacagattttggcgtcagtatttagtcggggcttaactcgtctaacctaataatctcatccactaatcaagcactcgattactctgccgaagacaacacactagaaaaaagaggcccaattattactcttacgctcgccaaaacaacgtgctggaggaaaaattgggtcatgcataacctcgtgcaagatttcacgcgattcgaattattttaccccgaacattttagttgtccagttcaaactaatttgctcggaataaaatcatcaaagtggggcgggcttccgaattcgtattcgcgcgagcgatgaattttaaataaccatcggacgctccgattttcgaaatgactatgttccgaacatcacaaaaatttaggaagagcccggatagataaaaataaaaacgatatctcactcgcgacaaacgaaacagatgcgatattaaaatcgcgataaacgaaaataattaaaatttggcatccgttttatccactgatattacgtgcttaaattcatactcgttgtcgagcagaatataaacaccaggggtgttatattacactaggatcgaactgtgttgtgtgtggtgctgacgaccgcgccgtactagtgccaaacattgatatggatcaatagagagcctaagagatgaagcaccagcagtagtggctcgatcaaaagtcatttcctgctgcagcctttttcagatggagctacgaagagcctctggcctctagcacatacaacgggcttgaaagctctcgtgatctgctgtagctaggtgcaagaacaccagaaagggaaaggctagcaagctagctccacgaacaagcaagcacgactgatgtgtgaagcctacctaacatgcgtgcagcacatcagaccatcagtcctggatttcgaccggagtgccatgccatatactagtactatgcatgagtttatatgaaacctgctggagtttaacgatgagtacatgaaaaagtggagcagttcaggtggatcgcagaggcaaaggatgcgccccatatgcatggagcaacggaggaggcgtgcgggctggcgccttgtgcatgcagaccatgcctgcatttagtgtgagtcttgcgtccactagttgaagaacgcactctagtgcggcctatgtttggagagacacgtacggttggcctgcagtagtgaccgcttctcatggtaagacgcgtccatcatgtggcccagacgagacgagaggtgtagtttctaggcatgtcgatgatgtgccatctagtgctatgagaaagtgtggtgctctggtaggagaaagctagcaagacgatgctcctgatactcacaagatagagagttgtgtacatgtcttctcggtgagtgagagagagagcaatagcacaagcctattgattttgtgagtcctgactattcatttatgtttgcagttcgtccgtctgccaaatcttgctgcaattgggtctgagtggtcagtttgaccaacatgcatgttattaattgcagctttctcgtggagaagtaggtaacttttcgtctaacttttggcccacgagatcactaaaaaattgtctatagagaacaagttagtccacattattttatataggccacagttaaactaatttgcacctaactcttgtgtttagtcttgagaagagtggatgtgacatgatttagggtttacccacatagcaaaatccaccagcatcaaaagtttctcacccaataagaacctagtaacctgctaaccacctattcatatagttaggcctcgtttggattagttaatctggtcagcaactaaatcttgcattttggtctctgtttgattttatttttataaagtttcaagatctttatccttgaccaaagacagcaatttttgcagctcatcctcaagaaacaacatcctctttttggcatttgtcgccactatttgtagtctaacaatttcatcatccttcttttgggcacccaattgcaactcatcaacattatgcaaaaactttttagcggcttcagtagcctactttacctctattttcttcctcttaatggtccaagtgtaatcttcttcaattgtcttaagctggttccacacaaaattcttttttgcctattgtgctgaattttcactgtcttctaatctcatgatcttggaagcttactttagttttcttatctcatacctaatatcttcctcacttttttggtgatccgaattgttgggactaaactttacttcatatattagtattgacaattcggatcccaaaaaattggagaagtgattagggaagagattaaaaactaaagaaatcttactaggtcctaagatgagagaagcacaatgaaatttcagcataacaaacgaaaaagaattatgtgtagaaacagcttaagacaatggaagaatgttacagtgggaccattaagaggaagaacttacaggtaaagtgggctactgaagcagctcaaaagcttttgcataatgttgaggagatgcaagtgggagcacaaataaaggtgttgaaattgttagatgacatgtagtggcgataaatgccaaagatagtatgctatctcttgtggatgccctgggaaatttgttctcttttgttaagcatgaagatcttgaaactaataaaatgaagatcaacaaaaactaaaacgcaagagttagctgtagtcgagtttagctgatccaaatgaggcctaactatatcaactttgtgtcaggtggttagcaggtctgaaaaatatagtttcgcttgtttacaccatcagagcaggcctgaaaattaatgtcgcatttacatgcgatcatatacccaacttaattttctcccttaaggtgtattgttggtttatttataggcccaattaggtgcactggagtcgaacaatgtaggaaccgtctcctctaggtgtcaacaaaatcttatgcatgcttttctactgcaaattgggtcttgtgggttaggaactgtcacacgctcttgctgcaattgggtcttagttgtcagtttgacaaacttgcatgttattgattgctacattcttatggagaagtaggtcttgttgtttgacttttggggcctgctagagtaaattgcccacgagggcaataaacttgtctatagagaccaagttagtcaacatatttttagagaggaaagaaccatttctattaacaggaatacaactgagtcttcttacgagtggatgtgatgtgattaaggttttacacacgtaaaaaattgaccagcctaagatgtttatcacccaagaagaccccagtaacctgctaaccatatgtcacaaagttcatatagttgggcctcatttggatcagttaaactaaactgcacctaac

SEQ ID NO: 35 - DNA, 5035 bp, Zea mays
  misc_feature (4297)..(4297): n is a, c, g, or t
gtttataatcccaaattcctataaatccaagacagatgtttttgccaaccaagccaaatttacaacacagtaacacattttggtggacaaaattggaatattcataccatggcagcaataaaaacagatcagggaactccattttcaacagaaagaaagcaaagaagaaaatttcgagaaaacaagtttactcagtgtatgcacctcatcattgaaaatgattgccgttggtcataagccaatagtatagattgcatcaagaataggaacaaaactaataaaccaaaggaaaaataccatcaattggttcttcagctattattatatctgtgtcaatattcgcatggatgacatggccatccgtgctacgccgcacagttccttttatgcccatcaagcaatgctcctgcacatggaaagggtagatacttcgcatgagaaccagagaaaaacagaagaagaaaaagacatgtaggcatggcagaaaatgatacatcacatactaatcaagtacaacactacctttgagtgctgcaacaatgtatgtgagtcatgccgcagacttggagctgcatttttcttgttcgttttcacccagcaaacatcttcacacctacggaatccccactgatcatagaaaaatttcagtcagcctcatctacttgttattgcagctcatcaacaactgaaaattaaaacacacatacatgaaataaaactgtggaagtatgaaacaatgtttatgttgctacgacattccatcagagggcaaaaattgatttgaagctgcgggaacctgggtgacctcctaaaaaatgatttcaagatcccaccccatcccccaaaacgaatggcattacaataataatatagagcgcagtcatttaagtacggaaatagcaggctctaccttctttaaacactgacgaccctgttcaaggcctacaccatcaccaacccaaaggaacacaaaggagggtgtatctgcaatagcctgttgattcaaaaaatacacttctaaatattaattctgcagcataaatgaaatcacaaaatagaaaggataaagaaaaggggaaaacctcaatcttcaaattcataatctcctcagcagtccaatattctatgtgatctgtgattcctggcgcacggtgagtatactcctcccatggaggatccacaagaataacatcgaacttggtaccaaaaaactctggagaaagaacatgttcccgcaggtcacacttgtaatacattggcggtgaagctgacttagcaacaatttcatctttcctctgtatgagttctctcaactttggatagtcctctgctacgcttgtaagatccagttctctaatgaaattttgaggcctcatgccagtgtccacaaagttctgtgagtaatcattttgttcgccccttgaaggagcttttctgtttggtccactgttcctatgtggcatccaaccaggtttatcatggagcatttcacggctttgaggacccatattattgtaacccaaacctgatatatctgctggaccacctaacccagtgtccatttgatttaagtggatattatgactagacccagctcccacatttggtgcaaacctatgttctggagcaactggaggaatggtaaggttgggaggaacagaaagcatattcacatcaacacctcgagctccaggccacactagaggccctggaaatggcggcatgaaaacgccaggtaggagaggaggaccaggagaatggggaatatttggccccatatgctgcattggtcctggtggaagtccaagaggaccaaatggaggaggcatgattggcattggaactccaattctttgagaatcccttccatttggtctaccccttcctcctctagatgacctatcgccttttggaccttgttgaggaaacgaagaaaccatgcttgtgctaccacttggatctggttcaagatgatcagaggatttatcatcagttcctccaggtactgaatctcggtgtgctccggtttcaaatcttctaccagaaacagagccctctcttccaaagttaagattactattaggtcgaatctctattgagtctgaattgtcgtatcggttcccatagtttgagggacctctaatactttcagatctacccctagaatctctccgatatccagttcggccatggaaattcccgccatctagcctttcctgtgcattcctccattcaaaatcatttggctccttagtatctcgtaattgagtgttcctcccatagtccttagaaccttcaatgtctcgggttttctcattccaattcctatccctccctctgtcagatttatcatctctataagcttctcttgtgtcaactctaagagaaccaccagtttcatcaacataaacttcatctaccctcctgactgatgccctttcatcttgatcccgttgtccttgcttctccctactaccctctcttctctctgaactcctagcagaagcatcagggctaaatcttcttgaaggttcccaatcattattgtcccctcttcccctccttctatcatagtctcgatccttggaatcatcagggcttctcctttgaactttaggagatcgtgagtcccttctcagattatagacgtcatcgtcggcacctcgagccaggcctgagcttctatctggattcctccttgattcattcctatcatttgaaggtgtaatcattctattatcatcctgatgcccagtttcatgttcatatccatgttttctggatatatccgaataatttctgctatccacattctcctgattttcttgctcctccttccaagtattccttgcattaacattatcatcaacctcctgcttactgcgacctctactagactcaggtccgtccatggcactctctattatatagagtcaaactgctacttttcccaacaaatacaactgtcgataaacctcggcaaagaagttgagattcctatacacaaaatactgataaacaatatcaataccgtgggtatacaaaagcgaaaggaaaacagtatacgacaggagaacttgtcataatggaactgcaaacaaggtcaactgaaaggacgtcagaaatctaaatttgctgcacatttagattaataggtagaaataagcatgcttacaacaaacctactcaaggttagaaaaggcgctaggtggtgacccatttaacgacccagctctcccagagtaaccagccgtgaaagataaaaaataaactttttaactcattttgcctgggtttttttaccctcacgagactattgaaatgccactgctgctctgatccacaatcaatgaacaaggatggccgacgtttagtcctaatgacaatgcaacaggatcccacttggatggaacagcctttttttttacttcatctcaaagaactaatggagaagcctttaggtgcaagtagtacaaagaaatgaaatatcagtcgaagctagatgcttggtctctttggcatcagtcaaccaagctccacttaattatagagagcattaaaatagcctgaaggaactttccctttcccttggactgaagatttcagattaagcaattctgacatataatcaagaaaattaaaatgtgatcgtgatcagaataaattgtaaacatattgcaaatagagttccacagctgtacttaacaacataatgaacttcagagtcaaacttcttttagtcaccaattaaccttgtttgtcatattactagaaagtagagttccagtgaagaaataaagaaaaggtggcttttaaccctgataaacagggaataaccacctccaaatgttaaaggagcagatttccagtgttacaacccaaaatattaaactatttttagaaaggaaatcaggaaaagaaacaccgagcgtaagggcacatcgaacagtatgaaacacagccatactcgagttgaactttatcagaaacagtgcaatatcagatgttgaagtgttaaacagagagatgctaacctagtcatggtcttgatgacacaagcctaatatgtgaattgtacttaaaaccaagccggcaagtaaagctgcttttcaccttcgtgggcgcagctggccggcacggggtgcggctggccggagcggcggcgcggctggcgtgaggctggtgcgtgcctgcaccctgcggctgcggctgcggctgcggttactcggttagggtttggaactggcggccgagatggctactgcctgctgctgcaccggcttccagcccaggaacngccgccgcgaacggacctagggtttggggcgcaggaacgggagtcggaggggagattgggagaagcgccttcacgtcgagcgtacagcagttgcgcattggagaagttgggccactctgtattgttgggccgacggagatgcatgggagagcaggaggccacctattgttttgggcgggcccgctcttgcgcagaactcgactccagtccagattgttcgtgcgaactgcgaagcacgtcgtccggtcgtcggctcaaaccagagccagcccagacccgtcctcgctcggttcaactttgcgccgtcgtcgtgcgatcggacggctgttgtggacgtgtggcctcaaagtagggtgcgccgtgctcatcgtcttgtccgacagaagagtcgctccaactgtccaaccacagctccgcgccgccgccgaggacgacaaaggcgtcccgctgttcttgttgggcgcctcttcggaggtaacgtcggtttcctctataataaatccgcagcggtttaaatagtacccgtgcttctccaacggctgaatcagctcgctcctcactggagtaagtgtttgattgattccacatgctctaaattgaatctgagtgtgtgccgcggcctgcgggaggaattcctcaccacacgcagttcttacaagcctcactcattggcctgcagtgttattcagtttttttttcacttttttccacacgatgacattgttccatttccattca

SEQ ID NO: 36 - DNA, 5021 bp, Zea mays
ccagtacccgaacctatattacccgaaacccacacaaggatgcaagcaatcatgcgaaacataaaattagtccgcttgtgaatcataaatcaaatatggatgccttcaacacgctgcagttgctgtcaagaagctcaatcagcagctctacaacagctgtaccattcgctaacccccacggttcaaacaagggcctgggggttctacatagttgttactacttctgtagaaactagcacaactaggaaacaaaaacaacacagcacagcagccgagctgagggctgaggcacctggaagaagaatctgtagccgtcgaccatgtcaaatcctatgatacaactttacccctcggacaaaaatctaataccctacatcaacacctgctcagtcgtcctatcagtatcaggttaccaccaaattatctgaaaaaatcaagaacgttacagcagcagtcagagttggtattctgtaaacctaatggtacctcacaagtaaaattggtccttacatcagcagtcagaaagtcaggagaagtttcagcctgttacaaatttccattcgatttctcgtcctcaagcgctttaagcttctcctgcaaggattaggaatgcctcacgtaagtttctaagagtcaagagtgcaagatcaaatctaaaattccaaaaaggtgtccacacagagctcccaaccactggcattaaagaaatgggaagtccatttttcgtaaaccagaaacctttggccattcaattatgtaaaccagacatatttggccacagcacccttttaatgctggtttcactgattttgactgccacactggacagtcagcatgctgactcagatcactccggcccgtgaggccctcctctcccttgtcctctgtgccaatgataggtgggtccctctgcccatcccttatctccaggcgtttccttcgagagtcgacctcgccccctcgagcacgagcactgccccgatgacgagcacttgccattgtgcacagccattgctgaacgcagcccctgccaaggtggccagcgccatcgtcgaacggatcacttaagcttgttcagcaccgcgctgtagtagtccacagcggaggcagcatggccgcttgtgcccagctccagccatggcagtaatttggtggctgtggtgctgcagcttggatgcaccgacatcagctcgaacctgctgctactgcactgctcctctattttccttcccggtccataaatccaagcatccagcttctccttcaattgacaaccactagcagcagcagctgctgccgccatcaaactagcactcaccttcctttctctctgctccaatccttccaacatgatgtagaggtgtattttctgaggtcaaaaacaaaagagaaagcttacatgtagagatgtattttctgaggtcaagccatcacacttctcctgaagttgtttcaattcttctttaagtgaactattttcctgctttagcaaatctgcacgattggctacttcctcccattcagcctgtagtatgccataaaaaacatagaatacatcaaggcttgcatgaagcaaagaacaccaaattatatgaacagacgtggcagcatctacccttttaaggtgtcacagcgaggaaataaataaaatctgtgggtcctgctatcagctatatgcatgagcttggagacaaatatgcagctgttttcacaatgttcctcaattattttctttagccttaaggaaaactcatgatatattattccttggatgctatctgctttctatgatcctggttcatcatcttccaaggaaaaaatgcagatatattagtcctcaactaggtgtattgttctggtgaaatgttggttgtcatccatgaacactaactaaccactacactactacagtagcacatcttcgttctttattctaggaacatgtgcaggaacacatgcatggtccacatggttatgcatatttagcgattattctcatcatctactgcagtcaatttcaagtaggttcaaccagattctagtatatgtggttcaagttatatattgcgcagaattctacagaaactgcataatgtcatgatctaatagaatttatgaccttatacaagacaataggtaaaagctggctagtgttttatgttggcaaaagctattctcctccggtcctcccttagacccttaccctacagattacaggggtagatgagatagcaagaagaaccaggtagtcaccatctctctggaagctctagcagttttttttggttcttactgcttgatttcaactgctagtgtgcccattttataggcagcccctaacacaagatgcttacccatttgacaaactaaccaattgaccttatcttccttgaacatcttatctgaaaccaattctaaaccgacttagcataagtgtcttgactggttgatgctgctgccaaactggtggcccaaaccccacccacacccaactcccagcagtaacaagatggtcactcctaaataagcagttagcagaaatgcaaaatattcacaagatacagatataggataaattataacatccaaatgattcttatgaaacgctgcagacattacagacctgtttgcgcaatcttgagcgtcgagctgactccctatttgattgcttacgtttttgtctcttcagttctctctcatcctatgttaataaaaaatgaccctaagtaagaaaagtgcaaggtaggtactagaacaaaataaaggcaagggcaaccaaatcctgcatggtgacagacctgtatagccggatcactgagaacaatatcacgtgaatttgatgaaggagctgatattggtgctgcaataactttaccatgcatgggtacagaagcagtaccccagtaatccattcccatattcatagtagttgctgggccagccatgggagagggaacaggccaaaatggcatcatagggttaagcacaacaggcccagaagatggttgtgtgggctcaactgcagaactttgagtacctttactcctagcatctgacgaaaagaaggaacttaactattgcacctaatgttttgcgctaaataaaaaaacacaaatttgtttctcagtacctattcccacagggggggctaaaagtagttggttataagttatacataaagcttcaagtcttaccattaccctgacctcgctcagaaccatccttcgcccttgaaccctgcaagcaaattatttgtttatgtcagttagtataagttagcatgaggatggtcatatgcaacatataaaggaagaaaatgcaggacggtaggatgcatacttctagtttgtccatgagctagcaggtaaaccacgttggaagcgaggataacatagatgcatctaacttgtaagtcgctataataaccaaaggaaaaaaaagagtagatttgcaaattgtaaagtgtctcatgcaacatatggaactgcgcaaattaatgaaacttaaaacaaggctacagtttgattcattagaatttgttttgaaaaataaactggatactcattattcagtgtcctcttaaaataccatgtacacagacagaaccagttgcaaactgtaccaaattgcacctctcacgcactccatcggcatactgcagatgctgcccagaggatttcaagatttaagcaaaagttactcccacaaatcacgccttccataatgggaaggagagtgaaacagtaacatactgctttggaatttgtactagtagcattatgaagctaaatgtagtaatataatggaatgacatacactttttgaatttgtactgcttccttcagaagaactcccgcttccactctcactgtataatagatagcagtctcaatattttatctgttagtataacaaaaaacaaataaattacctttgtgaagaaccttcattggaggaagaaactgaaggctttgccgctgacttgttattttttactgcaacaacatccagactacctaagcttccttttgatcttttcaggggagtcttccgcttattttttgatctatctgtctctgtaccgccagcaccagatgtctaacaacataacccaatcaaaaaaaaaaacttatctgctgtgaggagacaaatggcataaacacgactcaaacaagtgaattcctatgtaacaaatataaatgacagagaacagttaagatgaaagctttagaaaggaatgggtgaaattctgcatccattctgtaacaataaatatatcaaataaaaggcacccattaacttactggaggttgaattgtcccatttggtgacggcataggataaggaccgtatgggtatgaaccctgacacaaaaaacaaggaaaattaagttcattacgatatcaaccatgcattaacacaataagaatatgatctcaagtaaaacgaggtacattaccggtggcatgggtgcctgctggtatggtgtgccttgtgcatacattgttgcatatggtggtggtgtcccataaggaggcatcatctatccagttgaacaatctaatgttatatgactcattaagcaaaagagcctctagatgagttggttaggtggtctaaatagcactcaggtcttgagttagactccccgtgggagcgaattttaggtttgggttaaaaaaatcgcctcgtctgtcccacgccaaagcacaggtctaaggcccagtcccgatcatggtggttctcacatgggctaggtaccactatttatgggtggggcagagatttgttggtttacttgacctatgtgaggtcttcttactacaatgttcggaggctgtcttacctcccgcacatcaagttttatattatgtaccataaccatgtaaggcatgcgttagtgcaaaaatataatgacattaaaaaacagtcagatggatttcaataaaaaagatgtagttaaataatcttcaaaaacaaaaacaaaaagtacaggatccaatatctaatgacaacagata

SEQ ID NO: 37 - DNA, 2669 bp, Zea mays
cccttataggacaccgctttgggcccgaggttttcaggaacatcgctgactctccggattaactggcggtgacggtaatttctgcaaccgcagcaaactcaccattaccggatacaaccggaatgttgaccttgcctgcagcaacgccgttcacggtgatggtcataccactgaccgacacggtggcttttgttttatccgcagacaccgcacgaaagctcttgtcggttacgccctccggctggaaggccacggtcagcgtggtgctctgccctttcaccaccgaggtgctggcaggcgtcacggtcatgccggttgccgctgttaccgtgctgcgatcttctgccatcgacggacgtcccacattggtgactttcaccgtgcgggtgatcacttccttcgccgtcaccgccttaccgatactgctgacccagccacggaacacatcgaccgtgccgttcgggaagcggattttataggcacgggtatcgccttcattaaaccacgccagcagcgcctgctgcccctgctctccgggcatccacgccagcgtgaagctggtatctccggcagatttctgcccctgcccggtcgcagtccagtctgcatcttcatcatcgagatagctgtcgtcataggactcagcggtcagttcgccgggcgtcaggtctttaacttttgccagacgcgaccagtcaacgtctgaaagcggattcgcgtaagggtcaccgctccccttataaacccacagggtggtcccggcacctttcaccggcattgtaggatttggtacaggcatagcgtcctcacatttcataggtaatgacataagtcagatcggctgaactccacaagcccgcatcatcgtcgcgccggtagtcatagccgctggccaccatactggtgatcaaatctgacagtgccgggatatcgctcatcaccggataaatccgggactccatccacgcatccagctctgaatccggcacctgagcaggcaggaaaacttcgatatgcagctccgcctgccaggtatcgctgtccagctcttcgcccgtgtattcagcgccggtgagataaacggcaactgccggaaaatccgcctcatcaaaaacagcggggcgaccatcaaaaaacgtcgccccggtgtcatgcttctccagtgcatccagtacggctgcacggagttcagtatgtttcatcgctttattaccatcctcagttgatgctgcagcgcatagcccagctctttcggaagacgttcacgccgtatccgctcaatattttgtttaaacgccgtggtcagcggcaccgccatcgggattttcaccacatcaatggggtaacggtttttcccagccacacgctgcatgacatgccaccggccatttttcagttgctgaataaacgcgccgggaatacgacggttacccaccacaagcacgctgccgccacctttcagggatgaacgctgcccctttttacgacgcctgcggcgcgaaaggacaacccgcgcattacccagcttgattacgggcaaatccccccggttaactttgattctggcctgcggatttttgaccgtggcccttttcagcctggccctttcctttaccagtttccggcgtacctttgtctcacgggcaacctgtgacgccgactgcgatatcgcggatgaagcaacgcggttaatggccattgcggcggcaccaggcaccgccgttttgctgatacggctgaggttttcaacggcctgctcaagaccttttatggccatacatccccctttcagcggcgacggttaacggcaggcggtacgccccgtccaagccagagatgacaacttccgccatcatccggcgaaacccgatctacccagaaattttcctcaccgatggtcagcgtgtctccacgccgcagctgccgcacctcatcagtccggacaaacagggacgggctggagccttcaacgcgcacgccctgtccggcatagctgatattttcagggtcatcaaaaacaccacgtatcaccgcacctgactgctcaccggatgtaatggtggctgacgttcccatgtacccgcgtatcgtttcatcggcgcgggcaatggcagcatcgaacaggttatcgaaatcagccacagcgcctcccgttattgcattctggccaggccgcgctctgtcatttcggctgccacaccggcagagacacgaaacgccgttcccggcagcacaaatgccacaggttcatcccgcgtggcgtgaagtgcatcagtatgcagcttcaccagtgccacgaccgtgaccagttcagacgtatccagaatcacggtatccggctgcgctgatcccacctcattttcatgtccggtcagcacattttcccggctgagaggggtgtcctgaccggcagtttcatccgtgtcatcaagctcctctttcagctctgccacacggagcgccagttcttctttcgtccccgtcaggctgacatcacggttcagttgttcacccagcgagcggagacgggcaatcagttcatctttcgtcatggactcctccacagagaaacaatggccccgaagggccatgattacgccagttgtacggacacgaactcatcagggtcagccagcagcatcagcggtgcgccatacatccccttatag

SEQ ID NO: 38 - DNA, 4962 bp, Zea mays
acaataagaacagtagatagcgatgcaaagaatacaatgagtggaatttgagaaagataggtgtccaagaccgtcttgatttttggttggtccagcactactttgagcaagagcagcttctcctctaggttttctaaaatgtaacagtagagatagcagtgagatgtaccatataaaaaaacaatgacaaagacaacaacataaaccacaaattgtttgatttgcttctcatatgatttccttaaaggttagatcatattatttgagcttccataaatgcgcatttatcatatacttgagcatgcgaagtctgagatgaagaagtggcgacgaatctccaattcgagaggacaatggtagcacaatgttgtttgtcatgaagtatagtgttctgttcagcctccattttagtaataattccttaatctactcattatattattgaattgtatcaacctttttaccaataagactaaagactcgagtcctatgagtaagcttaatgccctcaaaattacattcaattcgagtttgcatatatgatttcaggacaaacaattttgtgcttatgaccttcgatttcttggtatactttattagtgtgcaatgtgatcaggatagaaaaagtttctatttctttttgtgtggtagtatttttttagacatgtattgtaagcatataggaaaacataacaaaaaggtaaagaaaacaatccctcactgtatatatcaagagaagtatctttgtgtggtttgtcacaaccactgatctatagaaagtatttgggttaagcgctaaattatgagacttcaaaatattttatagtcaaatggaaacattctaaggacgtctctcaccaacactacaaactcatctattttaacatctggtgttgatcttgcagtagctcccaaacttatacatatttgtaggatttctatagtacaaaataggtgacaaagaaaatcaaatagactgacaaaagaaatgatcacaatctcatactttttctagtaaagtttataaagacgtgcagagtttagttgtactgtaaataactgaatatacaacattcgttacaataaacacttaatgataggcataaccagagtatgaaaagcatgtgtttagagtttttcattgcaattaagacaaactcttaaatatattattaaacacttatacgaacattgaccacttctagtctttatattgatgacaagtcatgaatcaattaggcagatttattggtagagataatagctagagcaacactagttatagcaaatagaggagaaccgaagcaaaacaatcccagagtacacctacatcgacaacacaagaacatcaatgacaaattttttaaaaaaatcataatttgttgacacttgaagaaaaactttcaacaaaaaatatcaaacaccaagcaccaaaccaaaataaatacatttaaaatttagtttggtggttggggtttggtagatttttttaacgattttcttcaactattaacaaattattatgttttttaaaattgtgtacttgatattccaatgttgttgatctttgtatactgtaggattgtactacttccgattcatctcattgttgctgcaactggtgatgtcttaactatcatctacttaattaattaatttaaaacttctcgtaaataaaaagactaggggtgggtaatgtttctataagtaatcttataatagtttttacaagtgcttaattatttgtttaacggtttgtcatacttgcaatttaaaataataaatacatacttttcatgctctaattttgcttatcattagtggtccaatgtcacaaatgatgtatatttaattgttcacaacacaactaaactttttatgtatgtacaaacattcccatgaaaaaagtataaggttgtggcatttctgttgttagtctattgggtttactttgtcacttattttcataatatcaaaatcttacaaacatgttttaaatttaagggctactgcaaaatccacatcagatattaaactagataattttgtaatgttggtgagagatatccttgtaccgtcttcaaatgaaactataaatttttattgcttcactaaaatactttctatagatcaatggttgtgatatgccacacaaaggtaattctacactttatttatagagagggatacatgtccaaaaataaccctacagaaaatgaaatagaaagtttattctattctgattacattgcattgtaggctgataaaatataccaagagatcgaatgtcatagggagaaaattgtccgcattgtcgcgttaaagtcatatatgtaaacttgaaatttgaaagtaatacaagggcacaaagcatattaataggactaatttacttatgcttattgataaaaaggttgacacaattgaatattgtagtggttatactaaggaattgttgcccaaattagaggctgaacagtagagtacccttcttgtcttcttcagtagtagatatgatgtatgtcataaatctcaaaatcttcatgctcaagtctgatgaatagacaattatggaagctactaaacgacgtcaaataatatagttcaaccttctaatctaaggaaactatatgagaagcaaatcagacaatctatggtttatgttattatctttttcattgtttctcatttttgtttttatatgatttttcttgctgatatctctgttgttacaactttagaaaatatggagaaggtaccctttcttaaagtagtggtggagcaacgagaaatcaagatggtttagggtcaaacactcaaaccttcccccaaattgcactcattatattactctcatgcctaatacactttttatgtttctctcaaaacaatagtggatcccttcgcagagccaagcagttagaaggacataagtgaaatatttctatttcatcatttttaatgttttctattttcgacagttgtaagcacattgtttaaatctttaacagacattctcaatcattatattaagattgtgaatatgattgtcaaatatctgtctggaagtacaaacattcttccccagatttgttgcgttcaagtaattatgttgtctcactttatcgttacctactgtcgaaatattattcttaaaatttttgcatttgataacaacttcacaccctaactattaaattgttgttattgatagattctttgttggctttgagctctcttgattgttttatcccatcattttctatcttaaagaaaagtatttatgcaagacgaaggatgaagtgaaagcaacatggtctctaggggttctacaatataacaccagggctccaatttacatgctcatcgcaacagttgttttgtgctactccgccattgcacctttgattatttcattctatgttgcattgctcttagatgacttatagcgaaaaatcaggtaagccagatgtatttttcttttttgtgtgaaatgactagaagaagaacttccaattatattaaaagaataaaaaatcgaaacagggcaaaacagtagtgcaacaaatgcatcatttttttgtttgcacactttgatattcagtttgttaatactataactttttatgttgttttgtgaaattattttttatataaatgatcttgttttattaattggttgtttggtgaagttgattatcgaattattcaccttatgcatattttaagagcttatagtgcctaccaaacagggtgggacatcgaattaaacttctcatgtcaagttaagtaacttggctagtttggtagggtccatctctagttaaactgatcatctccagttaagggtccatctatagtgcctgtttggtagggtgaaaattatctcaagttccacaacaaaattcaaacaaaattactactgttttatcccctaacaaaccttagttctagaaatctatatgaataattaaaaatataaccagaacaaacgcaaagccactaaccattcataaagcccagctaaacaacaataggcgcaaaatgttgcaagcccaaaaaatctaccaagcaatcagagttaaacatagaccacaatttcaaaacaagcaaacgcaaatctagcatccacaaaaatgttcagctccgatgcaaggaactacagaatctccaacctaataatagccgccatagaaaaaagtgcacattcgaatctaatccttgagtttgtatatgaaacatcacattgaagggccgacaacacgtcaggaagaataatagggctgcaaatcgcaaaaaaaaatagaccaaaccgaaaaataaggtgtggaggatggcctcgtgaatgatcatcgatgcatcaggcgagtcgaacgaaaccctaacctccatcaagcgcgcgcggccagccatatcgtcacacgaaactaccgtttccagacaaggggaaggcgcgggatgacaactcaccttttgactcgaatcccgttagccggatttccttctccaaatctagaacgagagcgatgcaaccaaggccacgacacaagaggatttctcaccttttttcgcagaaacaaaccaaccgcgtcagttcgaggggccgcattcggctaaccggcggcgaggaatagcgtcagggagaggacctcgagcgaggagagcagcgagacggaggcagcgatgaagacgagggagaccgcgacccagagaggaagagggtcagaagagcacgagtggggagggaaaggccaacagcccaaccctagcgcaggcggctggctatctacctccggactctggagacgcacgtaaatgggcctagaggaaacgcctgcccacgagcaactgtttggaaatataaaagtttcaactcataaaaaatggctccaattttttataaaaaacagtttcaactgtgttctattatataatgggcctgtttgtttcggcttctggcag

SEQ ID NO: 39 - DNA, 3790 bp, Zea mays
cagcgtcagatgtgtataagagacagtacatcaatctctctgaccgttccgcccgcttctttgaattttgcaatcaggctgtcagccttatgctcgaactgaccataaccagcgcccggcagtgaagcccagatattgctgcaacggtcgattgcctgacggatatcaccacgatcaatcataggtaaagcgccacgctccttaatctgctgcaatgccacagcgtcctgacttttcggagagaagtctttcaggccaagctgcttgcggtaggcatcccaccaacgggaaagaagctggtagcgtccggcgcctgttgatttgagttttgggtttagcgtgacaagtttgcgagggtgatcggagtaatcagtaaatagctctccgcctacaatgacgtcataaccatgatttctggttttctgacgtccgttatcagttccctccgaccacgccagcatatcgaggaacgccttacgttgattattgatttctaccatcttctactccggcttttttagcagcgaagcgtttgataagctaaccaatcgagtcagtaccgatgtagccgataaacacgctcgttatataagcgagattgctacttagtccggcgaagtcgagaaggtcacgaatgaactaggcgataatggcgcacatcgttgcgtcgattactgtttttgtaaacgcaccgccattatatctgccgcgaaggtacgccattgcaaacgcaaggattgccccgatgccttgttcctttgccgcgagaatggcggccaacaggtcatgtttttctggcatcttcatgtcttacccccaataaggggatttgctctatttaattaggaataaggtcgattactgatagaacaaatccaggctactgtgtttagtaatcagatttgttcgtgaccgatatgcacgggcaaaacggcaggaggttgttagcgcgacctcctgccacccgctttcacgaaggtcatgtgtaaaaggccgcagcgtaactattactaatgaattcaggacagacagtggctacggctcagtttgggttgtgctgttgctgggcggcgatgacgcctgtacgcatttggtgatccggttctgcttccggtattcgcttaattcagcacaacggaaagagcactggctaaccaggctcgccgactcttcacgattatcgactcaatgctcttacctgttgtgcagatataaaaaatcccgaaaccgttatgcaggctctaactattacctgcgaactgtttcgggattgcattttgcagacctctctgcctgcgatggttggagttccagacgatacgtcgaagtgaccaactaggcggaatcggtagtaagcgccgcctcttttcatctcactaccacaacgagcgaattaacccatcgttgagtcaaatttacccaattttattcaataagtcaatatcatgccgttaatatgttgccatccgtggcaatcatgctgctaacgtgtgaccgcattcaaaatgttgtctgcgattgactcttctttgtggcattgcaccaccagagcgtcatacagcggcttaacagtgcgtgaccaggtgggttgggtaaggtttgggattagcatcgtcacagcgcgatatgctgcgcttgctggcatccttgaatagccgacgcctttgcatcttccgcactctttctcgacaactctcccccacagctctgttttggcaatatcaaccgcacggcctgtaccatggcaatctctgcatcttgcccccggcgtcgcggcactacggcaataatccgcataagcgaatgttgcgagcacttgcagtacctttgccttagtatttccttcaagctttgccacaccacggtatttccccgataccttgtgtgcaaattgcatcagatagttgatagccttttgtttgtcgttctggctgagttcgtgcttaccgcagaatgcagccataccgaatccggcttgtgattgcgccatccccatagcagccatcacatcagtaccggaaagagagtcagaagccgtggcccgtggtgagtcgctcatcatcgggctttttggcgaatgaaatttagctacgctttcgagtctcatgcgccttctccctgtacctgaatcaatgttaggtttccgcagaacactgcgccggtatcgatatacatttggttggcaaacttgagtggtttcactgctggcgtatgaccaaagatgaacgtgtccgcgcctttgatttctttcacgatcccgttttgtgagttgctgattcgttcgcggttccagattacctgctgatgatcaactggctttccaaactcgtattcgtcaaagggataatcggcgtggcagataacatattttttatctttgctcaccagttcgatgattaacggaagttcatctgctttatgggcaagagctttagccagaatttctttgtcgtaatcgagattaaagaaccagccaccgccattaagcagccagtgattaacgtttccacgctctgataagccatcaatcatcatttgctcatggtttccacgtacagctctgaaccaggggaatgtgattaattccaggcattcaacgttctctgcaccacgatcaaccaaatcgcccaccgagataagcaggtcttttttgttgtcgaatccaatcgtatccagtttgttcatcaggttcgtgtagcatccgtgcagatcgccaactacccaaatatttcggtatttgctgccatcaattttttcgtaatagcgcatctctttcactccatccgcgatgaaccatgagaacgtcgttgacgatggcgtgcattttcccgtctttatcatcaacgtattttctgaccgtaccgcgactacatttcagtctgcgtgctacttctgtctgatttccgtatgcttcaacgagcatgtctggaatggtttttactgagaacgtcatgcggcctcacttctgctatttcgcaggtctttgagtttctgttggtactctgccttgatcgccttgcactcttcgatagtccagcgatggcggttatggtttgattcgatttcgtctactgcttcctgcccgatgcggctaatcagttcgacgcgatacggaacgagatttccgcttttgtgctggttgcacaccacgcattgcttgtgaatattgcgttcattaaatcggagttgaggtgccgcagcagttgtccggtaatgtccggcatcccactgagcagacgtgagcgttccgcacgagatacatggtaagtcgcggtctctttctctgatgaaggcgtttacggcttgttgggcttgtttaatccagtaactgcggggctttaaggcgagttttcgaatcttaagtttatctttctgtttctgctcctctcgtcgtcgtttcttctctgctgctttttccgctttttcgcgttctttacttcgtcgttcgagtgctatcttggttccacactctggagagcaccaccactgattagcgaatgcagggtgaaaccattcccggcattcatcgtttttacatcgtcttcgcgctggtttagccatcatcttcttcctcgtgcatcgagctattcggatcgctcatcagttctgcgcagcagtgctcacacacgtgaacttccagcacatgcagcttctgaccgcagttagcgcacgttaaagctcgctcgacgctttcttgttcgtaacttcgattttggtcaatcaccttgttttcctcgcacgacgtcttagccaccggatatcccacaggtgagtcgtattaatttaaatc

SEQ ID NO: 40 - DNA, 4911 bp, Zea mays
gagtccaccttcatcccacgcggactctggatgagttggaagatatgatcgggtggcatgacaagtggttttaaacggaacagaacatagaaaacagagtgcaaacaccacttgtgtccttttgtgtcattaactctttctcagctgatgcaacatctagatatttcacccactagtctggacgctctgctcaaatctaccctcgcccaagttctctactcagttttcccctcccacctccacactatactcagaaatcacctcacggcggcattttctcccgtcaaaggctcttccgtgtggacctaagtccttacaagtgggaccggtcctcacttcactcccctgcttctcccccaaatcgatcccaatcgaaatcgcacgctccaggctccaccgcgcggctcccctgcgccgagacgagcagcagcagcctgtgcactcgtcgtcgtcgctgtcctccaagcgctcgctctccatcgacagcgggggctcctcctccatccaccttcatcccggccgcacaggcaggcggacgccgcgggccacacaggcaggcggatctcggccgccgcgatgcgctccggcgggcggcttctacgcgggcgagctcgacgcgggggtgggcgcggctgggaacggccagccgcaagcgagatcgacgcagagtgggtgcggccggtagctcgacaccaaatcgacaccaaaactccatcccaaatcgacaccaaatcgacactcccactgccagggatgacgcccggccgtgagaagacgacgctcggtcgtggccatcctcgtcggcgccctgctcgctgcatctcccttggcgcgtgcagcaagctgtatctgcgatggcgcacgcggctgctgcatcttccctgggctgctgttgctgtctgtttctgaataatgtctgaattgctgtaatgaatactgaaatctgaactgctatctgtttctgaactgctgtcgcactgtttttgaactgaatggcactggtttttggtcacataacgttgttctgtctgttcaacagaaacaggcgtgtgtcgtagtggtctgggctgacgtgcagtaaaggtacttgaggtgctaggttcgattccaatctaatttttttttgcattttgttgcatataggagacgtgtccattttgttgcacacttttgtctatgtgtctcatttttttatctcaagcaactaggtccaaattatgactccctaccaagtttcactattttttgacaatatttggtatttatttatttatttttggccctaaaaggcatttaaaccatataaagcaataaataataaaaaagtggattttttacatgaagtaagtcatcaatgattagatgaactaatggttcactttttaagcaaaaacaaagaaaaaagtaagaaatatagctcaaagagtgacgttgtgatcgaatgttatgaaacttagtgagagacgtgtccatttgtgaagcacctattattacacttttgcaaaacctcatggtctttttatctcaagcaactaggtccaaattatgactccttgccaagtttcactagtttttgacaatatttggtattcatttatttatttttggccctaaaaggcatttaaaccatataaaccaataaataataaaaaagtggattctttacatgaagtaagtcattaatgattagatgaactaatggttcacttttgaagcaaaacaaagaaagacgtaagaaatatagctcaaagagtgacgttgtaattgaatgttatgaaacttagggagagacgtgtccatttgtgaagcacctattattacacttttgcaaaacctcatgacctatttatctcaagcaactaggtccacattatgactcccagccaagtttcactattttttgacaatatttggtatttatttatttttgtccctaaaaggcatttaaaccatataaaccaataaataataaaaaagtggattctttacatgaagtaagtcatcaatgattagatgaactaatggttcactttttgacaatatttggtatttatttatttaattttggccctaaaaggaatttagatgtgtaaggttatgtagttgcgtttgcatatgatactggaacatctaacttgtctacatggtgatatggcttgggtttgtagtgcagcggtgcaggtcgaatcttgtgcctgcacctttttttgccagttgtgtctaacttgtctacttgccttttttttgcatatgatactcgaacatctaacttgtctaacttgccttttttgccaattgtgtcgccagcacatctaacttgtctaacttgccttttttgccaattgtgtcgccagcctagctatattacacgacaacatttttccctttttttacagccatatgagaccttatttcatccataattcatctgtagtgcttacagcttacaactgaacacaaaaaaattcatagttcatccatagtgattacaacttatttcatccatagttcatccatagtgcatagagcttacaaatttctagtgcttaccaccttggttcataataaaaagtaaaccaacaaatatcataaaagcacaaatgactaaaatgtaaataattttgttgaggttgccatttatcttcatccattcaattgctagaatgtccaacttcacagacacatctcctttatctgcaccacataactcttctccaaaattagtcaccatcaattacgtagcaccttgttcttgctcaaaactggactgtgtctgtttagtcataccactcaagcgtaaccattcgatgtactcatccatccacataaaaaagttgcacttcttaaggatctaatataaaaacacaaaaaccacataattaatctaaaatcacatgacataaaggatgaatgataaactacataaacaaacaagggaaatgatcatgaaccttgccgggttgtgatttgctttcgcactttacgaattctctgccatagttgtcgttttctgattttttcgtcctgagcctaaccaatggctctgaccgggtgcaatcaggacactggacgagagggacatggtcgaagctgggaaaaccttgcaatctgttggatgagctcgcacgcgacattctctatggatgcgcacactaggagccggccgacgtttggggcttactagaggatgctgcctgcctgtgcgagattttttttcaatcaaaacacgatatatttcagatccaccaggagtaaatccgagatataaattcattttttcataattaaaagcttcaatggtaaaactactaggcgctgccggggtgtgtgggctttgtacacggctctctcagtagaaatgcaagcagctagctgcttgcgcctactctgctataatccacggagccttttgcttctgctgatgctagcgaagtagcattcaatgcagcgtatggttccatgggactttggtcaggatggatggctccgagaatgcaacagaaagctatggttaagctacctctcgaggagctcgccggagaagcgctcgccggagaggagcgctcgccgctcgagggaggcgcggtggaggggcggtggaggggagccgctcgactgctcgacggatggcgcggtggaggggagccgcgcggtggagcagtggagggaaggcgcggtggagcctgggagcatgcccgcgtgctcgtcggagatccggccgcgacgcgcccacccgcgtcgagctaccggccgcgcccactccgcgtcgagctcgcttgcggctggccgctcccggccgagcccacccccgcgtcgagctcgcccgcgtagaagccgcccgccggagcacaccgcggcggccgagatccgcctaccgtgcggcccgggtgaacgggtcctgcggctacgggggcgccggcgagaaggcggcagcgacgccgtcgaacggcgatatgaaggtggaggaggaggagcccccgctgtcgatggagagcgagcgcttggaggacagcgacggcgacgagggcacaggctgctgttgctgctcgtctcggcgcaggttcaggccgtggtggtcgttgtcggcggccgagatccgcctgcctgtgcggcccgcggcgtccgagacccgcggcggccgaggggaacgctcgccggagaggagcgctcgccgctcgagggaggcgcggtggaggggagccgcgcagtcgagccgctggagcgtgcgatttcgattgggatcgatttgggggagaagctgaagtgaggaccggtcccacttgtaaggacttaggtccacatggaagagcctttgacgggagaaaatgccgccgtgaggtgatttctgagcatagtgtggaggtgggaggagaaaactgagtagagaatttgggcgagggtagatttgagcagagcgtccatactagtgggtgaaatgtaaatgtcccaatttaaatctgctacattcagttcacttactgtgactgcatataaattgatgcataaaagcctagaactaatccagctacaacactcataacacacaacaacagtctatctactgttttcattggctttttcctcatgtcacctatctcatgctttagatcagctactacttgcttcatgtcatgcttccgctgcatatacttgccttcttgattcatgtcttttgccggaaaagaaaaggcttcactaaattgtttctttgtttccacgcacgggaactaaaacagggggacctatctagggcaccgataaccagacctagtgccacaccttttgtatacaccatatcctacgctgaagccctcgtcggcaacatggacggtggaggacgaaactggacgtggtgaaggtacaagttctgcacaagtgggtgctgggaaacatgcacaaaaagagacctcc

SEQ ID NO: 41 - DNA, 4858 bp, Zea mays
gaacctagggtcgggacctagagagatgtgattagtctgacctagagagatgcgatttctttcaatggcatcatccggtttttcctcaatatatcacgaatttgttgggggacttgcgagacatagtggatgaactgacgaaggagattgatgcattacaaaataaggaacaagaacttaaggactctttggaaggtatgatgcagctattgaatttggagtgaaggtgtagtcgtgttcatgcagccttagcagtaagcccttattttgttttctgcctatttctcttttgtagccatgtcagttatttatactttgttctttttatgctgagaagggcttggggtgctagtgaccaatgtgctggtggttacctccattgtggcaactacgcacaagtagtagcacggaggaagtaaccatcagcatattgggcacacctccaccatccgccgtgacgctctcctggccaaaaggttggtcattgctgcaaggaggactagtcggctcagatgacaggctgcctcagctgctaccaagtcaggctacttagagtttgtagggtgatgtcatttggacctcgacgagatccaccactcgattatattgtactggatgctcacttatttatgttccaaattcagttattctatgatgaacgctcagttgttttatgtgccactcagttattttattctgaatagttattctaatatgtgcaactcagttattgtaatatgtgcaagttatttatgtgccactcagttattctaatggacgcactcagttagtctggtgtcagaactcagttattccattctaatacctcagttattcttgtgggccgactcatttattttcttctcgtgactcagttattctactccaatccctcaattattccgttataataactcagttattgtaacgtacccactcggttattctctgttcacaagtcaattattccgttccagtaactcagttattctagtgtggcgactcagttattcttgtgtcagtactcagttattctggtgacggaactcagttattacgttctactacctcagttattctaatgtgcacactcagttattctctactcattactcagttattccattctaataactcagttattctggtgtcagtactaagttattctggtgacggaactcggttattacgttctactacctcagttattctaatgtgcacactcagttattctgttctaataactcagttattctactaattacttagttattccgttctaatacctcagttattctactgttccgactcagttattctggagtcagcactcagttattctagtgggcgcacttagttattccatgttcatttctcagttattctcggttcagtactcggttattctgtgttcatcactcagttattctggtgacgaaactcagctattctctgctcgtgcctcagttcttgtgggccaactcagttattctactccaatccctcagttattccgttataatacctcagttattctaaaccctcagttattatgttataataccgcagttattccatgttcctaactcagttattctaatgtcggtactcagttattctaatgcgcgccttgagttattccatgttcaccactcagttattcaagtgacagaactcagttattctactccaatccctcagttatcccgtgtcatacctcagttattgtaatgtgcctactcagttattatatgttcatgacttagttattccgttccaacaactcagtacttctaatggacgcactcagttattctggtgccagaactcagtaattctgttccaatacctcagttattcttgtcggctaactcagtgattatgatgtgcagactcagttattctggtgtcggcactcagttgttcggttctgatccctcagttattctactccaatccctcagttatcctgtatcatacctcagttattgtaatgtgcccactcagttatgcggtgtttattactcagttattctctattcacattcagttattgcgttcaagtaactcagttatgctattgttcattactcagttattctgttgtgcacactcagttattctattgttcactactcagttattatctgttcattactcagttattctgttccaacaactcagttcttctaatgcacgcactcagttattatggtgacagaactcagtaattccgttccaataccttagttattcttgtgggctaactcagttattctcctccgatgcctcagttatcatcatacctcagttattggaatgtgcccactcagttattattgtgtacagactcagttattctggtgtcggcactcagttgttcggttctgatccctcagttattatgttataatacctcagttattgagatgtgccgactcagttattccatgttcgtcactcagttattcttttgtcagaactcagttattctaatgggcgcacatagttattctggtgtgatgactcagttattctcgtgtgcctactcacttattctctgctcattactcagttattctctttgtaatcactcggtagtggggactccgttattctctattcacagtcagttattgcgttctattaactcagttattccatgttcgccactcagttatttcattccaacaactcagttattctaatggacgtactcaattattctggactaatacctcagttattcttgtgggccaactcagttattctactccgatcccttagttattccgttctaatacctcagttattctctgctcatgactcagttattctagtgggcgcactcagttattccatgttcatgtctcagttattctggagtcggtactcagtaattctagtgggcgcacttagttattccatgttcatttctcagttattctcggttcagtactcggttattctgtgttcatcacctagttattctagtgatggaactcagttattctctgctcatgcctcagttcttgtgggccaactcagttctactccaatccctcagttatttcgttataataccttagttattccatgttcttaactcagttattctaaaccctcagttattatgttataataccgcagttattccatgttcctaactcagttattctaatgtcggtactcagttattctaatgcgcgccctcagttattccatgttcaacactcagttattctttgtacgttactcaggtattgtgcgttcattactcagttattctagacgacgcactcagttattcgagtgacagaactcagttattctactccaatccctcagttatcctgtgtcatacctcagttattgtaatgtgcctactcagttattatatgttcatgactcagttattctgttccaacaactcagttcttctaatggacgcactcagttattctggtgccagaactcagtaattctgttccaatacctcagttattcttgtgggctaactcagttattatggtgtgtagactcagttattctggtgtcggcactcagttgtttggttctgatccctcagttattctatgtttgttactcagttattgtgcgttcattactcagttattctaatcgacgcactcagttattctactccaatcccttagttatcctgtatcatacctcagttattgtaatgtgcccactcagttatgttcctaactcagttattctaatgttggtactcagttattctaatgcgcgccttgagttattccatgttcatcactcagttattcgagtgacagaactcagttattctactccaatccctcagttatcccgtgtcatacctcagttattgtaatgtgcctactcagttattatatgttcatgactcagttattccgttccaacaactcagttcttctaatggacgcactcagttattctggtgccagaactcagtaattccgttccaatacctcagttattcttgtgggctaactcagtgattatggtgtgcagactcagttattctggtgttggcactcaattgttcggttctgatccctcagttattctcagttcgttactcagttattgtgcgttcattactcagttattctaatcgacgcactcagttattcgtgtgacattactcagttattctactcgaatccctcagttatcctgtatcatacctcagttattgtaatgtgcccactcagttatgcggtgtttattactcagttattctctattcacagtcagttattgcgttcaagtaactcagttatgctattgttcattactcagttattctgttgtgcacactcagttattccatgttcactactcagttattatctcttcattactcagttattccgttccaacaactcagttcttctaatggacgcactcagttattatggtgacagaactcagttattccgttccaataccttagttattcttgtgggctaactcagttattctcctccgatccctcagttatcatcatacctcagttattggaatgtgcccactcagttattattgtgtgcagactcagttattctggtgtcggcactcagttgttcggttctgatccctcagttattatgttataatacctcagttattgcgatgtgcgactcagttattccatgttcgtcactcaattattcttttgtcggaactcagttattctaatgggcgcatatagttattctggtgtgatgactcagttattctctgctcattactcagttatttcgcagtcataactgaattattcagttattctctttgtaatcactcgatagtggggactccgttattc

SEQ ID NO: 42 - DNA, 4854 bp, Zea mays
gaacccagggtcgggacctagagagatgcaattagtctgacccagagagatgcgatttctttcaatggcatcatccggtttttcctcaatatatcacgaatttgttgggggacttgcgagacatagtggatgaactgacgaaggagattgatgcattacaaaataaggaacaagaacttaaggactctttggaaggtatgatgcagctattgaatttggagtaaaggtgtagtcgtgttcatgcagccttagcggtaagccgttttctgcctatttctcttttgtagccatgtcagttatttatactttgttctttttatgttgagaagggcttggggtgctagtgaccaatgtgctggtggttacctccattgtggcaactacgcacaagtagtagcacggaggaagtaaccatcagcatattgggcacacctccaccatccgccgtgacgctctcctggccaaaaggttggtcattgctgcaaggaggactagtcggctcagatgacaggctgcctcagctgctaccaagtcaggctacttagagtttgtagggtgatgtcatttggacctcgacgagatccaccactcgattatattgtactggatgctcacttatttatgttccaaactcagttattctatgatgaacgctcagttgttttatgtgccactcagttattttattctgaatagttattctaatatgtgcaactcagttattgtaatatgcgcaagttatttatgtgccactcagttattctaatggacgcactcagttagtctggtgtcggaactcagttattccattctaatacctcagttattcttgtgggccgactcatttattttcttctcgtgactcagttattctactccaatccctcagttattccgttataataactcagttattgtaacgtacccactcggttattctctgttcacaagtcagttattccgttccagtaactcagttattctagtgtggcgactcagttattcttgtgtcagtactcagttattctggtgacggaactcaattattacgttctacgacctcagttattctaatgtgcacactcagttattctctactcattactcggttattccattctaataactcagttattctggtgacggaactcagttattacgttctactacctcagttattctaatgtgcacactcagttattctgttcaaataactcagttattctactaattactcagttattccgttctaatacctcagttattctagtgggcgcacttagttattccatgttcatttctcagttattctcggttcagtactcggttattctgtgttcatcactcagttattctggtgacgaaactcagctattctctgctcgtgcctcagttcttgtgggccaactcagttattctactccaatccctcagttattccgttataatacctcagttattctaaaccctcagttattatgttataacaccgcagttattccatgttcctaactcggttattctaatgtcggtactcagttattctaatgcgcgccttgagttattccatgttcatcactcagttattcgagtgacagaacacagttattctactccaatccctcagttatcccgtgtcatacctcagttactgtaatgtgcctactcagttattatatgttcatgactcagttattccgttccaacaactcagttcttctaatggacgcactcagttattctggtgccagaactcagtaattccgttccaatacctcagttattcttgtgggctaactcagtgattatggtgtgcagactcagttattctggtgtcggcactcagttgttcggttctgatccctcagttattctactccaatccctcagttatcctgtatcgtacctcagttattgtaatgtgcccacttagttatgcggtgtttattactcagttattctctattcacattcagttattgcgttcaagtaactcagttatgctattgttcattactcagtaattctgttgtgcacactcagttattctattgttcactactcagttattatctgttcattactcagttattctgttccaacaactcagttcttctaatgcacacactcagttattatggtgacagaactcagctattccgttccaataccttagttattcttgtgggctaactcagttattctcctccgatgcctcagttatcatcatacctcagttattggaatgtgcccactcagttattattgtgtgcagactcagttattctggtgtcggcactcagttgttcggttctgatccctcagttattatgttataatacctcagttattgagatgtgccgactcagttattcttttgtcagaactcagttattctaatgggcgcacatagttattctggtgtgatgaatcagttattctcgtgtgcctactcacttattctctgctcattactcagttattctctttgtaatcacttagtagtggggactccgttattctctattcacaatcagttattgcgttctattaactcagttattccatgttcgccactcagttatttactcagttgttgtgttttcattactcagttatttcattccaacaactcagttattctaatggacgtactcagttatttctttcagtagctcagttattctattgtgtggactcagttattctggtgtcagcactccattctaatacctcagttattctctgctcatgactcagttattctagtggacgcacttagttattccacgttcatttctcagttattctcggttcagtactcggttattctgtgttcatcactcagttattctctgctcatgcctcagttcttgtgggccaactcagttctactccaatccctcagttattccgttataatacctcagttattccatgttcctaactcagttattctaaaccctcagttattatgttataatactgcagttattccatgttcctaactcagttattctaatgtcgatactcagttattctaatgcgcgccctcagttattctatgttcaacactcagttattctctgtacattactcagttattctctgtacgttactcggttattgtgcgttcattactcagttattctagacgacgcactcagttattcaagtgacagaactcagttattctactccaatccctcagttatcctgtgtcatacctcagttattgtaatgtgcctactcagttattatatgttcatgactcagttattccgttccaacaactcagttcttctaatggacgcactcagttattctggtgccagaactcaataattctgttccaatacctcagttattcttgtgggctaactcagttattatggtgtgtagactcagttattctggtgtcggcacttagttgtttggttctgatccctcagttattctatgttcgttactcagttattgtgcgttcattactcagttattctaatcgacgcactcagttattctactccaatccctcagttatcctgtatcatacctcagttattgtaatgtgcccactcagttatgttcctaactcagttattctaatgtcggtacccagttattctaatgcgcgccttgagttattccatgttcatcactcagttattcgagtgacagaactcagttattctactccaatccctcagttatcccgtgtcatacctcagttattgtaatgtgcctactcagttattatatgttcacgactcagttattccgttccaacaactcagttcttctaatggacgcactcagttattctggtgccagaactcagtagttccgttccaatacctcagttattcttgtgggctaactcagtgattatggtgtgcagactcagttattctggtgttgccactcagttgttcggttctgatccctcagttattctccgttcgttactcagttattgtgcgttcattactcagttattctaatcgatgcactcagttattcgggtgacattactcagttattctactcgaatccctcagttatcctatatcatacctcagttattgtaatgtgcccactcaattatgcggtgtttattactcaattattctctattcacagtcagttattgcgttcaagtaactcagttatgctattgttcattactcagttattctgttgtgcacactcagttattccatgttcactactcagttatgcggtgtttattactcagttattctctattcacagtcagttattgcgttcaagtaactcagttatgctattgttcattactcagttattctgttgtgcacactcagttattccatgttcactactcagttattatctgttcattactcagttattccagtccaacaactcagttcttctaatgcacgcactcagttattatggtgacagaactcagttattccgttccaataccttagttattcttgtgggctaactcagttattctcctctgatccctcagttatcatcatacctcagttattggaatgtgcccactcagttattattgtctgcagactcagttattctggtgtcagcactcagttgttcagttccgatccctcagttattatgttataatacctcagttattgcgatgtgccgactcagttattccatgttcgtcactcagttattcttttgttggaactcagttattctaataggcgcacatagttattctggtgtgatgactcagttattctctgctcattactcagttattccacagtcataactgaattattcagttattctctttgtaatcactcggtagtggggactccgttattc

SEQ ID NO: 43 - DNA, 4840 bp, Zea mays
aacaattgaagccgttttcatgagttgaaacttatatttccaaacagttgcccgtgggccagccgcctgcgctagggttgggctgttggcctttccttccccactcgtgctcttctgaccctcttcctctctgggtcgcggtctccctcgtcttcatcgccgcctccgtctcgctgctctcctcgctcgaggtcctctccatgacgctattcctcgccgccggttagccgactgcggcccctcgacctgacgcggttggtttgtttctgcgaaaaaaggtgagaaatcctcttgtgtcgtggccttggttgcatcgctctcgttctagatttggagaaggaaatccggctaacgggattcgagtcaaaaggtgagttgtcatcccgcgccttccccttgtctggaaacggtagtttcgtgtgacgaaatggctggccgcgcgcgcttgatggaggttagggtttcgttcgactcgcctgatgcatcgatgatcattcacgaggccatcctccacacctatttttttcggttcggtcttttttttttgcgatttgcagccctattattcttcctgacgtgttgtcggcccttcaatgtgatgtttcatatataaactcaaggattagattcggatgtgcactttttctagggcggctattattaggttggagattctgtagttccttgcatcggagctgaacatttttgtggatactagatttgcgtttgcttgttttgaaattgtggtctatgtttaactctgattgcttggtagattttttgggcttgcaacattgtgcgcctattgttgtttagctgggctttatgaatggttagtggctttgcgtttgttctggttatatttttagttattcatatagatttccagaactagggtttgttaggggataaaacagtggtaatttttgtttgaattttgctgtggaacttgagataatttcaccctaccaaacaggcactatagatggacccttaactagagatgatcagtttaactatagatggaccctaccaaactagccaagttacttaacttgacatgagaagtttaattcggtgagccaccctgtttggtaggcactataaacactcttaaaatatgcattagaaaggtggataattcgataatcaacttcaccaaacaaccaattaacaaaacaagatcatttatataaaaataatttcacaaaacaacataaaaagttatagtattaacaaactgaatatcaaagtgcgcaaacaaaaaaaatgatgcatttgttgcactattgttttgccctgtttcgattttttattcttttaatataattggaagcttttctttctagtcatttcacacaaaaaaaacatctggcttacctgatttttcgctataagtcatctaagagcaatgcaacatagaatgaaataatcaaaggtgcaatggcggagtagcacaaaacaactgttgcgatgagcatgtaaattggagccctggtgttatattgtagaacccctagagaccatgttgctttcacttcatccttcgtcttgcataaatacttttctttaagatagaaaatgatgggataaaacaatcaagagagctcaaagccaacaaagaatctatcaataacaacaatttaatagttagggtgtgaagttgttatcaaatgcaaaaattttaagaataatatttcgacagtaggtaacgataaagtgagacaacataattacttgaacgcaacaaatctggggaagaatgtttgtacttccagacagatatttgacaatcatattcacaatcttaatataatgattgagaatgtctgttaaagatttaaacaatgtgcttacaactgtcgaaaatagaaaacattaaaaatgatgaaatagaaatatttcacttatgtccttctaactgcttggctctgcgaagggatccactattgttttgagagaaacataaaaagtgtattaggcatgagagtaatataatgagtgcaatttgggggaaggtttgagtgtttgaccctaaaccatcttgatttctcgttgctccaccactactttaagaaagggtaccttctccatattttctaaagttgtaacaacagagatatcagcaagaaaaatcatataaaaacaaaaatgagaaacaatgaaaaagataataacataaaccatagattgtctgatttgcttctcatatagtttccttagattagaaggttgaactatattatttgacgtcgtttagtagcttccataattgtctattcatcagacttgagcatgaagattttgagatttatgacatacatcatatctactactgaagaagacaagaagggtactctactgttcagcctctaatttgggcaacaattccttagtataaccactacaatattcaattgtgtcaacctttttatcaataagcataagtaaattagtcctattaatatgctttgtgcccttgtattactttcaaatttcaagtttacatatatgactttaacgcgacaatgcggacaattttctccctatgacattcgatctcttggtatattttatcagcctacaatgcaatgtaatcagaatagaataaactttctatttcattttctgtagggttatttttggacatgtatccctctctataaataaagtgtagaattacctttgtgtggcatatcacaaccattgatctatagaaagtattttagtgaagcaataaaaatttatagtttcatttgaagacggtacaaggatatctctcaccaacattacaaaattatctagtttaatatctgatgtggattttgcagtagcccttaaatttaaaacatgtttgtaagattttgatattatgaaaataagtgacaaagtaaacccaatagactaacaacagaaatgccacaaccttatacttttttcatgggaatgtttgtacatacataaaaagtttagttgtgttgtgaacaattaaatatacatcatttgtgacattggaccactaatgataagcaaaattagagcatgaaaagtatgtatttattattttaaattgcaagtatgacaaaccgttaaacaaataattaagcacttgtaaaaactattataagattacttatagaaacattacccacccctagtctttttatttacgagaagttttaaattaattaattaagtagatgatagttaagacatcaccagttgcagcaacaatgagatgaatcggaagtagtacaatcctacagtatacaaagatcaacaacattggaatatcaagtacacaattttaaaaaacataataatttgttaatagttgaagaaaatcgttaaaaaaatctaccaaaccccaaccaccaaactaaattttaaatgtatttattttggtttggtgcttggtgtttgatattttttgttgaaagtttttcttcaagtgtcaacaaattatgatttttttaaaaaatttgtcattgatgttcttgtgttgtcgatgtaggtgtactctgggattgttttgcttcggttctcctctatttgctataactagtgttgctctagctattatctctaccaataaatctgcctaattgattcatgacttgtcatcaatataaagactagaagtggtcaatgttcgtataagtgtttaataatatatttaagagtttgtcttaattgcaatgaaaaactctaaacacatgcttttcatactctggttatgcctatcattaagtgtttattgtaacgaatgttgtatattcagttatttacagtacaactaaactctgcacgtctttataaactttactagaaaaagtatgagattgtgatcatttcttttgtcagtctatttgattttctttgtcacctattttgtactatagaaatcctacaaatatgtataagtttgggagctactgcaagatcaacaccagatgttaaaatagatgagtttgtagtgttggtgagagacgtccttagaatgtttccatttgactataaaatattttgaagtctcataatttagcgcttaacccaaatactttctatagatcagtggttgtgacaaaccacacaaagatacttctcttgatatatacagtgagggattgttttctttacctttttgttatgttttcctatatgcttacaatacatgtctaaaaaaatactaccacacaaaaagaaatagaaactttttctatcctgatcacattgcacactaataaagtataccaagaaatcgaaggtcataagcacaaaattgtttgtcctgaaatcatatatgcaaactcgaattgaatgtaattttgagggcattaagcttactcataggactcgagtctttagtcttattggtaaaaaggttgatacaattcaataatataatgagtagattaaggaattattactaaaatggaggctgaacagaacactatacttcatgacaaacaacattgtgctaccattgtcctctcgaattggagattcgtcgccacttcttcatctcagacttcgcatgctcaagtatatgataaatgcgcatttatggaagctcaaataatatgatctaacctttaaggaaatcatatgagaagcaaatcaaacaatttgtggtttatgttgttgtctttgtcattgtttttttatatggtacatctcactgctatctctactgttacattttagaaaacctagaggagaagctgctcttgctcaaagtagtgctggaccaaccaaaaatcaagacggtcttggacacctatctttctcaaattccactcattgtattctttgcatcgctatctactgttcttattgt

SEQ ID NO: 44 - DNA, 4840 bp, Zea mays
acaataagaacagtagatagcgatgcaaagaatacaatgagtggaatttgagaaagataggtgtccaagaccgtcttgatttttggttggtccagcactactttgagcaagagcagcttctcctctaggttttctaaaatgtaacagtagagatagcagtgagatgtaccatataaaaaaacaatgacaaagacaacaacataaaccacaaattgtttgatttgcttctcatatgatttccttaaaggttagatcatattatttgagcttccataaatgcgcatttatcatatacttgagcatgcgaagtctgagatgaagaagtggcgacgaatctccaattcgagaggacaatggtagcacaatgttgtttgtcatgaagtatagtgttctgttcagcctccattttagtaataattccttaatctactcattatattattgaattgtatcaacctttttaccaataagactaaagactcgagtcctatgagtaagcttaatgccctcaaaattacattcaattcgagtttgcatatatgatttcaggacaaacaattttgtgcttatgaccttcgatttcttggtatactttattagtgtgcaatgtgatcaggatagaaaaagtttctatttctttttgtgtggtagtatttttttagacatgtattgtaagcatataggaaaacataacaaaaaggtaaagaaaacaatccctcactgtatatatcaagagaagtatctttgtgtggtttgtcacaaccactgatctatagaaagtatttgggttaagcgctaaattatgagacttcaaaatattttatagtcaaatggaaacattctaaggacatctctcaccaacactacaaactcatctattttaacatctggtgttgatcttgcagtagctcccaaacttatacatatttgtaggatttctatagtacaaaataggtgacaaagaaaatcaaatagactgacaaaagaaatgatcacaatctcatactttttctagtaaagtttataaagacgtgcagagtttagttgtactgtaaataactgaatatacaacattcgttacaataaacacttaatgataggcataaccagagtatgaaaagcatgtgtttagagtttttcattgcaattaagacaaactcttaaatatattattaaacacttatacgaacattgaccacttctagtctttatattgatgacaagtcatgaatcaattaggcagatttattggtagagataatagctagagcaacactagttatagcaaatagaggagaaccgaagcaaaacaatcccagagtacacctacatcgacaacacaagaacatcaatgacaaattttttaaaaaaatcataatttgttgacacttgaagaaaaactttcaacaaaaaatatcaaacaccaagcaccaaaccaaaataaatacatttaaaatttagtttggtggttggggtttggtagatttttttaacgattttcttcaactattaacaaattattatgttttttaaaattgtgtacttgatattccaatgttgttgatctttgtatactgtaggattgtactacttccgattcatctcattgttgctgcaactggtgatgtcttaactatcatctacttaattaattaatttaaaacttctcgtaaataaaaagactaggggtgggtaatgtttctataagtaatcttataatagtttttacaagtgcttaattatttgtttaacggtttgtcatacttgcaatttaaaataataaatacatacttttcatgctctaattttgcttatcattagtggtccaatgtcacaaatgatgtatatttaattgttcacaacacaactaaactttttatgtatgtacaaacattcccatgaaaaaagtataaggttgtggcatttctgttgttagtctattgggtttactttgtcacttattttcataatatcaaaatcttacaaacatgttttaaatttaagggctactgcaaaatccacatcagatattaaactagataattttgtaatgttggtgagagatatccttgtaccgtcttcaaatgaaactataaatttttattgcttcactaaaatactttctatagatcaatggttgtgatatgccacacaaaggtaattctacactttatttatagagagggatacatgtccaaaaataaccctacagaaaatgaaatagaaagtttattctattctgattacattgcattgtaggctgataaaatataccaagagatcgaatgtcatagggagaaaattgtccgcattgtcgcgttaaagtcatatatgtaaacttgaaatttgaaagtaatacaagggcacaaagcatattaataggactaatttacttatgcttattgataaaaaggttgacacaattgaatattgtagtggttatactaaggaattgttgcccaaattagaggctgaacagtagagtacccttcttgtcttcttcagtagtagatatgatgtatgtcataaatctcaaaatcttcatgctcaagtctgatgaatagacaattatggaagctactaaacgacgtcaaataatatagttcaaccttctaatctaaggaaactatatgagaagcaaatcagacaatctatggtttatgttattatctttttcattgtttctcatttttgtttttatatgatttttcttgctgatatctctgttgttacaactttagaaaatatggagaaggtaccctttcttaaagtagtggtggagcaacgagaaatcaagatggtttagggtcaaacactcaaaccttcccccaaattgcactcattatattactctcatgcctaatacactttttatgtttctctcaaaacaatagtggatcccttcgcagagccaagcagttagaaggacataagtgaaatatttctatttcatcatttttaatgttttctattttcgacagttgtaagcacattgtttaaatctttaacagacattctcaatcattatattaagattgtgaatatgattgtcaaatatctgtctggaagtacaaacattcttccccagatttgttgcgttcaagtaattctgttgtctcactttatcgttacctactgtcgaaatattattcttaaaatttttgcatttgataacaacttcacaccctaactattaaattgttgttattgatagattctttgttggctttgagctctcttgattgttttatcccatcattttctatcttaaagaaaagtatttatgcaagacgaaggatgaagtgaaagcaacatggtctctaggggttctacaatataacaccagggctccaatttacatgctcatcgcaacagttgttttgtgctactccgccattgcacctttgattatttcattctatgttgcattgctcttagatgacttatagcgaaaaatcaggtaagccagatgtatttttcttttttgtgtgaaatgactagaagaagaacttccaattatattaaaagaataaaaaatcgaaacagggcaaaacagtagtgcaacaaatgcatcatttttttgtttgcacactttgatattcagtttgttaatactataactttttatgttgttttgtgaaattattttttatataaatgatcttgttttattaattggttgtttggtgaagttgattatcgaattattcaccttatgcatattttaagagcttatagtgcctaccaaacagggtgggacatcgaattaaacttctcatgtcaagttaagtaacttggctagtttggtagggtccatctctagttaaactgatcatctccagttaagggtccatctatagtgcctgtttggtagggtgaaaattatctcaagttccacaacaaaattcaaacaaaattactactgttttatcccctaacaaaccttagttctagaaatctatatgaataattaaaaatataaccagaacaaacgcaaagccactaaccattcataaagcccagctaaacaacaataggcgcaaaatgttgcaagcccaaaaaatctaccaagcaatcagagttaaacatagaccacaatttcaaaacaagcaaacgcaaatctagcatccacaaaaatgttcagctccgatgcaaggaactacagaatctccaacctaataatagccgccatagaaaaaagtgcacattcgaatctaatccttgagtttgtatatgaaacatcacattgaagggccgacaacacgtcaggaagaataatagggctgcaaatcgcaaaaaaaaatagaccaaaccgaaaaataaggtgtggaggatggcctcgtgaatgatcatcgatgcatcaggcgagtcgaacgaaaccctaacctccatcaagcgcgcgcggccagccatatcgtcacacgaaactaccgtttccagacaaggggaaggcgcgggatgacaactcaccttttgactcgaatcccgttagccggatttccttctccaaatctagaacgagagcgatgcaaccaaggccacgacacaagaggatttctcaccttttttcgcagaaacaaaccaaccgcgtcaggtcgaggggccgcagtcggctaaccggcggcgaggaatagcgtcatggagaggacctcgagcgaggagagcagcgagacggaggcggcgatgaagacgagggagaccgcgacccagagaggaagagggtcagaagagcacgagtggggaaggaaaggccaacagcccaaccctagcgcaggcggctggcccacgggcaactgtttggaaatataagtttcaactcatgaaaacggcttcaattgtt

SEQ ID NO: 45 - DNA, 4799 bp, Zea mays
ggaacatttcacattatattaatgaactaatattacctttgttggaatagtcttgaataacagaagaatatttctatagtaaaggtgaaatgaaagagtagagctgataagaggtatggtcaaacatagagctacccacgactctttagtgtcaaatacactagcacggaggatatgagtgagcacgagagagaatatggttgtgttgtgtgcaattggccaatacaatcctcctatgtcaaaccttgttcgataaacattgagaaactgaaaaagaacacatggtacattagcatgaatggacaaatttcggggtaagtaagaaaaaaatatagtttctaggttctcacttgattgtggtatacgacatgaccaaggtaaaagtataccagcaggaacggtaaaatcataggagccaccacggagcatgtgaagcccaatagtccaaataatataacttttggcacctcatgctgactggggaatgtgggaacatattctgtatcttctctatattctccctttctcaaaatatatttccttataaagctcattatcagattaaagaacaacaaaagttcagatgataaactagcccatcccgaggtcataaaataggtgatgaagaaggtagcctgcaataaaaaataaaatcacagaaaacaaaaaagaaatgttagatgaaaattaaatacacaaaaccaatatattatctttccataaagaaaagggaaggtgtgctaaagctatctagttaaagctctagcaaccttgacaggaatgtcctttgggcttaataacaaattcaattgactcatgaatgtactagatagtacattaacaaataatatgtttcaaactatgaagcacaacaatttaaagcaagcactcatcttccttgcactgtgagatgtggcaccttccaatttagaaactttcatcatcaatgtcccaacaatatacataataatttgttggatcacactaggaatgtatcctgcaaataggcgggtaatatatattcaataggtgcaacatggagacatgtcaaatggatagtatatatatttgtagtgacataagaacacacatctattgagatagcccaactgaagtttcagtacttacttctccaacctttcttttaaggaagcaggaatcacctgttgcagctgctctgggtcagatagtgcttgtatacacaccatcaacatcaaaagtaagaatgcaaaaataatacagcctggaattagtgttgctttacgtcacttgttggattgccaaagattggacaaatacaagtcttctggttctagagccagactagtaacccatttcattgggttagatgcctgcaccatatttgatgcagtaactgcgtcatagcgagttttgaaaaatacaaaagcagttgtgcattcctgctgcatataattccacatagaaattactaatttaatccatattattactgctaaattaagcaattaacaaaagcatgcacgcaagaattttaacctcgcgatctaagttcagggtggattcttcattgtcagggttccccttgttttgcttgcattcagagttgaacttggaagaatttggagagggtggtcccgcgaaacaacaactgttggtggttgtcgtcctatatccctgactactgatttcaactacgaaatatttgaagttcttatgtgccttctttgcggcagtctatcagataagttaaagacaccaaaaccaagaggtgaaatacaaacacgcataaggaaagaaaagccattcaacactgaaggaactggtcatttgttcacttgttcatgtcaaaaagccaaaaaaaattatgagaaacctagctaattataagatgaagaagtcttaattatacttcccttagaatatataatagtaaatgttcttcgttagtaaaagagaaatgcatgcatcgagtactagctagataccattatcttgtggacaagcccaactttgtagacaatttgatggaagagataactagacaagtgatactttgtgaaaaaatttccaacaacatcactatatgattcttaagttgtctttggtatttcatgaacaaggagtgcaaataggcttggattttgcgttgcccttttgagatgaagggacgtcaacgtggcaatgtgcttcacctcctgcattgtagggaaaaacagatcagcaaaaaacattccaactacaaggagatggagcctttcagcaattcaaatgcgaaacaaatttacaatgtacagaattaagcatgttattccagaaattatgtattgcaccgcacaatggatcaagaggttgcatgcaaggaatcatcaaaacatacactttgttatattctacagtgctcattcttcttcaacttatcaagaagtgaatgaagaagcatggtggatgaattaatcaaggtagaaaacacttgtaagatgttgataactatcaaaacacacatatatatatatataattcaaaacacaagatttcaacatttgataataaattaaaagagagagagaaactttgctcggcttacctttttgattcctgtttcacattcgatactgtaaatgcatccattcgttccgaaggaattgaaacatgttgagtattctttccaaaataataattgactggaatacttcccaagagagccagaagtgtagcaatggagaagatgtgtatgcggttgaatatataaattaatatatgtgtttcagtctctgccaatttggttgctggggttggacatatgaactagtatgaatgcttgatgaaaaaggggacaaggaggtgaaaaggaagttttgtgtactgtacctaagtactataattcgatcaaaaacaactgcatccaacctagcagcaaataagagctcttcctcagtacactgcagggctttcactacccagctagtcgatggaacaaacctttcaaagttacaaccccctcggagtcgactgtattgctcaacaattctgcgtccgaagtaaatcttgacattggcgtgttgatttctcaaaacagagtagagcatcaagaagaggacacatataccaatgttgatgcccacagaggtcacaagcccgctggactccatcttgtaagaagtggcggagccatcccgcaataggagcctaggaaccattatgaatttctaaaattaatttacctaaagaattatatacatgtagcgacataagatcagacatctatcgagatagcccaactgaagtatcagtacttacttcaccaacctttcttttcaggaaggaggaaccaactgttgcagctgatatgggtcatatagtgcttgtatacacaccatccaggtcaaaagtgagaatgcaaaaataatgcagcctgaaactagtgttgatttacgccacttgttggatagccaaagattggaacaatacgtcttttggttctggagccagactagtaacccatttcatagggttaggtgtgtggactatatttgatgtagcaactgcatcatagtgagttttgaaaaaacaaaagtagttgtgcattcctgttgcatataattccacatagaaattactaatttaatccatattattactgctaaattaagcaattaacaaatgcatacatgcaagctttttaacctcgtgatctaagttcatggtggtttccttattgtcagtgttccccttgttctactcgcattcagagttgaacttagaagaatttggagggagtggtcccgcgaaacaacagttgttggtggttgtcgtcctacatccttgactgccgatttcaactatgaaatgtttgaactttttatatgccttctttgtgccatcaaaacatgcacttttttatattgtacactgcccagaagtgaatgaagaagcatggtggatgaattagtcaaggtagaaaacacttgataattaaaagagagagatctgatggctatcatggggaaggacgccgctctctaagcaccacccacacaatcagtgttttaatcatagacgcacacatgtgatctgatggctaaaacaagccgatattggttagagcctaagtcatccaacgctaatagtgctagttttgcatcaaagcccctctattttattgaaataaacatgtaatccagtccaatatatagttatttgaaatttaaacttggatgctcgaaatgaaataaaatcaataacaaaacaattttaactcaaataaaattattttggtctcaaataaaatatattcttgcatagaaaaaaatctatatatattttatgcaatattttaatgtgttggtgtaatatttcttacattatctttgtgagactgtgtcatgttgtttgctgcttgtttttccctcatctagcacttaaagatttagacatattgtcatgctacttggggtagtggttcctctaattgtcactctctttctacctatcgtgtgtttggtgatactattattgcttgcttggaaactaagaagcggtttctcattcatgtgtagaggtagatttgcatgttgtggctcttgtgatggctaaggagacttgttatgttgcttgcttgctgattttggtgtttcaatataggtgtatcacacgcttgatctggtcaagcatgagcttataatattaatattattgttgatgtttattacactctcgcacatgtttagggtattatgatttctcattgtaatgtaccttcaatggctgattagtgaataaagtggtttggaaaacacctctaccattttcattttata

SEQ ID NO: 46 - DNA, 4792 bp, Zea mays
aaaaaaaaaacgtaacccagtacccgaacctatattacccgaaacccacacaaggatgcaagcaatcatgcgaaacataaaattagtccgcttgtgaatcataaatcaaatatggatgccttcaacacgctgcagttgctgtcaagaagctcaatcagcagctctacaacagctgtaccattcgctaacccccacggttcaaacaagggcctgggggttctacatagttgttactacttctgtagaaactagcacaactaggaaacaaaaacaacacagcacagcagccgagctgagggctgaggcacctggaagaagaatctgtagccgtcgaccatgtcaaatcctatgatacaactttacccctcggacaaaaatctaataccctacatcaacacctgctcagtcgtcctatcagtatcaggttaccaccaaattatctgaaaaaatcaagaacgttacagcagcagtcagagttggtattctgtaaacctaatggtacctcacaagtaaaattggtccttacatcagcagtcagaaagtcaggagaagtttcagcctgttacaaatttccattcgatttctcgtcctcaagcgctttaagcttctcctgcaaggattaggaatgcctcacgtaagtttctaagagtcaagagtgcaagatcaaatctaaaattccaaaaaggtgtccacacagagctcccaaccactggcattaaagaaatgggaagtccatttttcgtaaaccagaaacctttggccattcaattatgtaaaccagacatatttggccacagcacccttttaatgctggtttcactgattttgactgccacactggacagtcagcatgctgactcagatcactccggcccgtgaggccctcctctcccttgtcctctgtgccaatgataggtgggtccctctgcccatcccttatctccaggcgtttccttcgagagtcgacctcgccccctcgagcacgagcactgccccgatgacgagcacttgccattgtgcacagccattgctgaacgcagcccctgccaaggtggccagcgccatcgtcgaacggatcacttaagcttgttcagcaccgcgctgtagtagtccacagcggaggcagcatggccgcttgtgcccagctccagccatggcagtaatttggtggctgtggtgctgcagcttggatgcaccgacatcagctcgaacctgctgctactgcactgctcctctattttccttcccggtccataaatccaagcatccagcttctccttcaattgacaaccactagcagcagcagctgctgccgccatcaaactagcactcaccttcctttctctctgctccaatccttccaacatgatgtagaggtgtattttctgaggtcaaaaacaaaagagaaagcttacatgtagagatgtattttctgaggtcaagccatcacacttctcctgaagttgtttcaattcttctttaagtgaactattttcctgctttagcaaatctgcacgattggctacttcctcccattcagcctgtagtatgccataaaaaacatagaatacatcaaggcttgcatgaagcaaagaacaccaaattatatgaacagacgtggcagcatctacccttttaaggtgtcacagcgaggaaataaataaaatctgtgggtcctgctatcagctatatgcatgagcttggagacaaatatgcagctgttttcacaatgttcctcaattattttctttagccttaaggaaaactcatgatatattattccttggatgctatctgctttctatgatcctggttcatcatcttccaaggaaaaaatgcagatatattagtcctcaactaggtgtattgttctggtgaaatgttggttgtcatccatgaacactaactaaccactacactactacagtagcacatcttcgttctttattctaggaacatgtgcaggaacacatgcatggtccacatggttatgcatatttagcgattattctcatcatctactgcagtcaatttcaagtaggttcaaccagattctagtatatgtggttcaagttatatattgcgcagaattctacagaaactgcataatgtcatgatctaatagaatttatgaccttatacaagacaataggtaaaagctggctagtgttttatgttggcaaaagctattctcctccggtcctcccttagacccttaccctacagattacaggggtagatgagatagcaagaagaaccaggtagtcaccatctctctggaagctctagcagttttttttggttcttactgcttgatttcaactgctagtgtgcccattttataggcagcccctaacacaagatgcttacccatttgacaaactaaccaattgaccttatcttccttgaacatcttatctgaaaccaattctaaaccgacttagcataagtgtcttgactggttgatgctgctgccaaactggtggcccaaaccccacccacacccaactcccagcagtaacaagatggtcactcctaaataagcagttagcagaaatgcaaaatattcacaagatacagatataggataaattataacatccaaatgattcttatgaaacgctgcagacattacagacctgtttgcgcaatcttgagcgtcgagctgactccctatttgattgcttacgtttttgtctcttcagttctctctcatcctatgttaataaaaaatgaccctaagtaagaaaagtgcaaggtaggtactagaacaaaataaaggcaagggcaaccaaatcctgcatggtgacagacctgtatagccggatcactgagaacaatatcacgtgaatttgatgaaggagctgatattggtgctgcaataactttaccatgcatgggtacagaagcagtaccccagtaatccattcccatattcatagtagttgctgggccagccatgggagagggaacaggccaaaatggcatcatagggttaagcacaacaggcccagaagatggttgtgtgggctcaactgcagaactttgagtacctttactcctagcatctgacgaaaagaaggaacttaactattgcacctaatgttttgcgctaaataaaaaaacacaaatttgtttctcagtacctattcccacagggggggctaaaagtagttggttataagttatacataaagcttcaagtcttaccattaccctgacctcgctcagaaccatccttcgcccttgaaccctgcaagcaaattatttgtttatgtcagttagtataagttagcatgaggatggtcatatgcaacatataaaggaagaaaatgcaggacggtaggatgcatacttctagtttgtccatgagctagcaggtaaaccacgttggaagcgaggataacatagatgcatctaacttgtaagtcgctataataaccaaaggaaaaaaaagagtagatttgcaaattgtaaagtgtctcatgcaacatatggaactgcgcaaattaatgaaacttaaaacaaggctacagtttgattcattagaatttgttttgaaaaataaactggatactcattattcagtgtcctcttaaaataccatgtacacagacagaaccagttgcaaactgtaccaaattgcacctctcacgcactccatcggcatactgcagatgctgcccagaggatttcaagatttaagcaaaagttactcccacaaatcacgccttccataatgggaaggagagtgaaacagtaacatactgctttggaatttgtactagtagcattatgaagctaaatgtagtaatataatggaatgacatacactttttgaatttgtactgcttccttcagaagaactcccgcttccactctcactgtataatagatagcagtctcaatattttatctgttagtataacaaaaaacaaataaattacctttgtgaagaaccttcattggaggaagaaactgaaggctttgccgctgacttgttattttttactgcaacaacatccagactacctaagcttccttttgatcttttcaggggagtcttccgcttattttttgatctatctgtctctgtaccgccagcaccagatgtctaacaacataacccaatcaaaaaaaaaaacttatctgctgtgaggagacaaatggcataaacacgactcaaacaagtgaattcctatgtaacaaatataaatgacagagaacagttaagatgaaagctttagaaaggaatgggtgaaattctgcatccattctgtaacaataaatatatcaaataaaaggcacccattaacttactggaggttgaattgtcccatttggtgacggcataggataaggaccgtatgggtatgaaccctgacacaaaaaacaaggaaaattaagttcattacgatatcaaccatgcattaacacaataagaatatgatctcaagtaaaacgaggtacattaccggtggcatgggtgcctgctggtatggtgtgccttgtgcatacattgttgcatatggtggtggtgtcccataaggaggcatcatctatccagttgaacaatctaatgttatatgactcattaagcaaaagagcctctagatgagttggttaggtggtctaaatagcactcaggtcttgagttagactccccgtgggagcgaattttaggtttgggttaaaaaaatcgcctcgtctgtcccacgccaaagcacaggtctaaggcccagcctcagtcgcggtcattctaacaagggctccggtgccgccgtgcatgaga

SEQ ID NO: 47 - DNA, 4786 bp, Zea mays
tctggtgcgcaataccagctacagaatggggcgatcgagcacactgaggacaatgcgggctctgatgaggggtttgggacatctagggccacaacttgggcaaggggtggagttgcattagccggacgtcatggaggtgcggcggaccgacgcgcagcggcaccgccaagctctaattcgccacagaggagaagaaccgggcgggtcggggtactctagtgagcaatcccatccatggagttgggcgatcgagcgcgccgaggacagcgcgggctcctgtgaggggtttgggacatctagggccacaacatgggaaaggggtggagctacatcggtcggacgccgtggaggtgcgatggaccgacacgcagcggcactagcaagctctaatttgccacagaggagaagaaccgggtgggtcgggggtactctggcgagcaatcctagccacagagtggggcgatcgagcgcaccgaggacagcgcgggctccggtgaggggtctgggacatctagggccacaacttgggcaaggggtggagctgcatcggccgacgtcgtggaggtgcggtggacctacgcgcagcggcaccggcaagctctaattcgccgtagagttgaagaaccgggcaggtcgggggtactctagcaagcaatcctagccacggagtggggcgatcgagcgcatcgtggacatcacgggctccgttgagtggtttgggacatctagggccaccacttgggcaagaggtagagcggcatcagccgaacaatgtgaaggtgtggcagacggactagcagcggcaccggcaagctctaattcgctgcagaggagaagaaccaggcaggtcaggggtactctagcgagtaatgctaggcatggagtggggtgatcgagcgcatcgaggacagcgtgggctccggtgagaggtttgggatatctagggccacaacttgggcaaggggtgagctgcatcggccggacgccgtggaggagcggcggaccgacgcgcagaggcaccaacaagctctaattcgctgaagaggagaagaaccgggcgggtcgggggtactctaccgagcaatcctagccacggagtcgggcgatcaagcgcaccgaggacagcgcgggctccggtgtggggtttgggacatctagggccacaacttgggtaaggggtggagttgcaccggccggacgctgttgaggtgcggtgtaccgatgtgcagtggcaccggcaagctctaattcgctgcagaggagaagaaccgggtgggtcgggggtactctagcaagcaatcccagccatggagtggtgcgatcgagcgcacagaagacagtgtgggctctagtgaggggtttggtacatctagggccacaacttgggcaagggtggagctacattggtcggacgccgtggaggtgcgacggaccgacggcagcggcattggcaacctctattttgccgcagaggagaagaatcggtaaggtcgagggtactctggcgagcaatcccagccacgaagtggggcgatcgagtgcactgagggcagtgcaggctccggtgaggggtttgggacatctagggccacaacttgggcaaggtgtggagatgcatcggccggatgttgtggaggtgcgacggaccgatacgcagtggcaccggcaagctctaattcgccatagaggagaagaaccgagcggctcgggggtactctagcgagcaatcccagccacgaagtggggcgatcgtgcgcaccgaggacagtgcgggctccagtgtggggtttcagaaatctagggccacaacttgggaaaggggtggagctgcatcggccagacgccgtggaggtgcggcggaccgacacgcagtggcaccggcaagctctaattttccacagaggagaagaaccaggcgggtcaggggtactctagcgagcaatcccagccatggagtggggcgatcaagtgcactgaggacaacacgggctccagtgatgggattgggacatctagggccacaacttgagcaaggggtggagctgcatcggctggacgccgtggaggtgcggcggacctacatgcagcggcactggcaagctctaattcgccgcagaggagaagaaccaggtgggttgggggtactctggagagcaatcccagccacggagtagggcgatcgagcgcaccgaggatagcgcgagctccgttgagtggtttgggacatttagggccacaacttgtgcaaggggtggagctgcattggccgaacgccgtggaggtgcggcggaccgacgcgcagcggcaccagcaagctctaattcgccgcagaggagaagaatcgagcgggtcaggggtactctagagagcaatgccagccatggagtggggcgatcgagcgcaccgaggatagcgcaggctctggtgaggggttcgggacatctagggccacaacttgggcaaggggttgagctgcatcggccggacgacattgatatgcggcaaacctaagcgtagcgacaccggcatgctctaattcgccgcagaggagaagaactggcgggtcgggggtactctggcgtgcaatcccatacatggagtggggcgatcgagcgcaccgaggatagcacgggctccgatgaggggtttgggacatctagggccacaacttgggcaaggggtggagctgcatcgtctggacgccgtggaggtgcggtggaccaacgcgcagcggcaccggcaagccctaattcgccacagaggagaagaaccgggcgggtcggggtattctagcgagcaatcccagccacggagtggggcgattgagcgcaccgaggacaacatgggctccggtgatgggtttgggacatctagggccacaacttgggcaaggggtggagctacatcggcgggacgccgtggaggtgcggcaaaccgatgcgcagcggcaccggtaagctctaattcaccgtagaggagaagaaccgggcgggctggcgagcaatcctagccacgaagtggggcgatcgagcgcatcaaggacaacacgggctccggtgaggggtttgggacatctagggccacaacttggataacgggtggagctgcatcggcctcacgccgtggaggtacggcggaccgacgtgcagcggcaccggcaagctctaattcatcgtagaggagaagaaccgggcgggttgagggtactctaccgagcaatcctatccgcggagtggggtgatcgagcgcaccgaggacagtgcgggctccggtgaggggtttgggacatctagggccaccacttgggcaagggttggagctgcatcggccaaacatcatggaggtgcggcagatcgacgcacagcggcactagcaagctctaattcaccgaagaggagaagaaccgagcgggttggtggtactctgttgagcaatcgcagccacggagtggggcgatcgagcgcaccgaggacaacatgggctccggtgaggggtttgagacatctaggcccacaacttgggcaagttgtggagctgcatcggccggacgccgtggaggtgcggtggaccgacgcgcagtggcaccggcaagctctaattcgtcgtagaggataagaaccgcgtgggtcgggagtaatctagcgagcaaacccatccacgaagtggggtggtggagcgcactgaggacagcacgggctcctgtgaggggtttgggacatctagggccacaacttgggcaaggggtggagctgcatcggccacacgctgtggaggtgtggcagaccgacgcgcagcgacaccggcaagctagaattcgccacagaggagaagaactgggcgggtcaggggtactctagtcagcaatcacagccacggagtggggcgatcgagcgcaccgaggacagcgcgagctctggtgaggagtttgggacatctaggtccacaacttgaacaaggggtggagctgcatcggccgtacgccatggaggtgcggcagaccgacgcgcagcgacaccagcatgctctaattcgccacagaggagaagaaccaggtgggtcgggggtactctggcgagcaatcccagccacggagtggggcgattgagcgcgccgaggacagcgcgggctctggtgaggggtttgggagatgtagggccacaacttgggcaagctctaattcaccgcagaggagaagaaccgggtgggtaggggtactctagcgagcaatcccagccactgagtggggcgatcgagcacaccgaggacagcgcgggctccggtgaggggtttgggacatctagggtcataacttgggcaaggggtggagctacatcggccggacgccgtggaggtgcggcggaccaacgcatagcggcaccgacaagctctaattcaccgtagaggagacgaaccgggcgggtcaggggtactctggcgagcaatcccagccacaaagtggggcgattcagcgcaccgaggacagcgcgggctctggtgaggggtttgggacatctagggccacaacttgggcaagggatggagctgcatcggccggactccatggaggtgcggcggactgtagcgccgcggcaccggcaagctctaataaaccgtagaggagaaaaaccaggcgggttggggttactttggcgagcaatcccagccacgacgtggggcgatggagcgcactgaggacagcgcgggctccgatgaggggtttgcgacatctagggccacaacttgggcaaggtgtggagctggatcgactgcacggcatggaggtgcg

SEQ ID NO: 48 - DNA, 4830 bp, Zea mays
tatatatatatatatcccaattatatgtattcagacagttcatattctacatatgtaatcacttcaatttgtaacgagttacctgttgtaaggtttcaaatatttgtgatcaccaaacaaaatgggacggagtgcacttacaaatatatcaaatgagaataacaaaggttcatactgatatgtttccatgtcttcgtttaatactgataatatcgagctatttaaatatcttaataaatctgcccccacaaccagtgatccgatgacgaagaacgtaagagggaggagaggaacagaaaacaaagagaatactatgcacggagaaaggctgatgaaaccacagaagaaagggagacaagaaataaaaggatgcgtgattaccgcgcatggaagaaggctgagacaggtatcccctatgatcttatactacattctattgttttttaacataattcatctgtctattgtagtgctatgctcgcccgaacagtcccaacgttttggttttggatcttcgatcgtaatgcaagctcctggaggggacaacacacatgtggcacaggctgagacgccgtatggtacgagttgcttgttgcagacaccatgttcaacaatttctcaggcatccagattgcaatacatggactcaattggtccaagtgatcccatggagtggctacataccaatgattactacgtccgacattatcaatgaacatacagtgaatatggtgacgaaatatgtagtacgccagttaaaatgggaacaagacgacagactgcgcttactgatatatctaaccaaattatcacaggttcatgcataatcaaaccaagtagcacagtcttttcattttattatttattactgatgtcgaacattttttaaatacagatatggccccacaaccaggtccgaccgatgaacatgagcgtcatcgggaggagagggatagaaaacaacgagaataccgtgcaagaagaaagctgaagaaaccaacgaagaaagggaggcgagaaataaaagaatgtgtgattaccgagcgaggaagaaggatgacataggtacttcctgccgagaattaacatcgtcctattttttagttactaatactcattcttcctcttgcagtactatactcgctcagacagacacaggcttatgctactggatcttcgatcgtaatacaaaccacaaccactggagacgataacaggaaggtggcagagccggtaacgcctgatggtgagaggggctctttgcaccaactgccaacatcaggggaaccatgttcaaccatttctcaacattcaacctataatcaatacggtaggaattcgttgttataattactacttacataatttattatttgatttccgtttgtctttagcaactactgcatctaccatgggcaacctcataatgaaccgagcgaggtacatcaatatggatgatgcggataaagaaattcgactgcataagcgacgtgaatacaaaaagtttagacaatgtggacaagatgacacgataattggtgagcacaagtgaatcattcaaaaaaatcaatgtgtctcctcttaaggcttaccatggctttctacgctgccagacactctatcaggtgctccattatcaattcatacacaacaacatattgtccatgacacacctacccatgagtctgaattgacagagtatgatactgtattaattgagcctacacaaccaagcttggaaggacatggtacctaactgtctaatacttcttttcctactaaatatggttattctgcgtatgatggttgcattgcatgtgtgagtagaaaataattagagatccttgagaaatggttgtttgggtcattttctttatgggggtttgcatcgttcaaactggacggttacatatgggtatatacttttatgctatatactagtatatacatcattaacacatttctaatgtctggtttacacatcagagcatccaatatcaccacatgatttcaatattgctcaacataatgaatatactagaagtcgagaatttcatggagaaggtaaccataaattatgatttatattattttacccggaaatggttcatttctgtttttaataactgcaaatagtgcatttgttttttaacccagatgatgcatttgaatcatatcgcctgcttgggtactccagtcataccgaagatccatatgactatgtctaccataagttgcccgatagacacaatgtattgcgaaaaatacctgactgttgttattgtggagccgtgaaatttcaatttgagccacacggaatgtgttgcagaaagggaaagattaaagtgcacatacatgatgtgcctactgagttgaaaaggttgttcaccagtcagggagatgatgatgcaaaatattttagaaaaaacatacggtacttcaactctcatttctccttcaccagtcttggagttacattggaccgacgagttagcacagcagctaatacgggtatatatacatttcgtgtccaagatgccttgtatcatcgtctcgaccatttagtgctagtttctcaaggccctcgtcatttgcaattttacttctatgatacaaaagatgctacattggcccacagggcacgaagatcaccagaccttgatattaatatcattaaaaatatcttgacaatattagagggaaatccatatgtacaaactttcaatacacttggatccattccaagtcttgatgactatgttattgaactcaacactaatgtaacgcctgaccaaagaaggtacttgactatgcatcacatttctttgttgtttacttgcagcacatttctttttgtaatacatgatttttaacatgtttctttctgcataaacaaggtacaatgcgcccactgcgcacctccatgccgtgcagtcgatccagctccacaccttgcccaagttgtggccctagatgtcgcaaacccctcatcggagcccgcgctgtcctcagtgcgctccatcgccccacgtcgtggctgggattgctcgccaaagtaaccccaacccgcctggtttttctcctctacggtttattagagcttgccggtgccgcggcgctacagtccgccgcacctccatggagtccggccgatgcagctccatcccttgcccaagttgtggccctagatgtcccaaacccctcaccagagcccgcgctgtcctcggtgcgctgaatcgccccactttgtggctgggattgctcgccagagtacccctgacccgcccggttcgtctcctctacggtgaattagagcttgtcggtgccgctatgcgttggtccgccgcacctccacggcgtccggccgatgtagctccaccccttgcccaagttatgaccctagatgtcccaaacccctcaccggagcccgcgctgtcctcggtgtgctcgatcgccccactcagtggctgggattgctcgctagagtacccctacccacccggttcttctcctctgcggtgaattagagcttgcccaagttgtggccctacatctcccaaacccctcaccagagcccgcgctgtcctcggcgcgctcaatcgccccactccgtggctgggattgctcgccagagtacccccgacccacctggttcttctcctctgtggcgaattagagcatgctggtgtcgctgcgcgtcggtctgccgcacctccatggcgtacggccgatgcagctccaccccttgttcaagttgtggacctagatgtcccaaactcctcaccagagctcgcgctgtcctcggtgcgctcgatcgccccactccgtggctgtgattgctgactagagtacccctgacccgcccagttcttctcctctgtggcgaattctagcttgccggtgtcgctgcgcgtcggtctgccacacctccacagcgtgtggccgatgcagctccaccccttgcccaagttgtggccctagatgtcccaaacccctcacaggagcccgtgctgtcctcagtgcgctccaccaccccacttcgtggatgggtttgctcgctagattactcccgacccacgcggttcttatcctctacgacgaattagagcttgccggtgccactgcgcgtcggtccaccgcacctccacggcgtccggccgatgcagctccacaacttgcccaagttgtgggcctagatgtctcaaacccctcaccggagcccatgttgtcctcggtgcgctcgatcgccccactccgtggctgcgattgctcaacagagtaccaccaacccgctcggttcttctcctcttcggtgaattagagcttgctagtgccgctgtgcgtcgatctgccgcacctccatgatgtttggccgatgcagctccaacccttgcccaagtggtggccctagatgtcccaaacccctcaccggagcccgcactgtcctcggtgcgctcgatcaccccactccgcggataggattgctcggtagagtaccctcaacccgcccggttcttctcctctacgatgaattagagcttgccggtgccgctgcacgtcggtccgccgtacctccacggcgtgaggccgatgcagctccacccgttatccaagttgtggccctagatgtcccaaacccctcaccggagcccgtgttgtccttgatgcgctcgatcgccccacttcgtggctaggattgctcgccagcccgcccggttcttctcctctacggtgaattagagcttaccggtgccgctgcgcatcggtttgccgcacctccacggcgtcccgccgatgtagctccaccccttgcccaagttgtggccctag

SEQ ID NO: 49 - DNA, 4759 bp, Zea mays
ataagaacagtagatagcgatgcgaggaatacaatgagtggaatttgagaaagataggtatccaagattgtcttgatttcttgttgctccagcactactttgagcaagagcagcttctctaggttttctaaaatgtaacagtagagatagcagtgagatgaaccatataaaaaacaatgacaaagaaaacaacataaacccaataattcaagaggaagtctgagatgaagaagtggcgacgaatctccaattcaagaggacaatgatagcacaatgttgtttgtcatgaagtatagtgttctgttcagcctccattttagcaataattccttaacctactcattatattattgaattgtatcaaccttttttccaataagactaaagactcgagtcctatgagtaagcttaatgccctcaggattacattcaattcgagttgcatatttaatttcaggacaaacaattttgtgcttatgacctttgacttcttggtatattttattagtgtgcaatgtgatcaggatagaaaaaagtttctatttctttttgtgtaggtagtatttttttagacatgtattataagcatataggaaaacataacaaaaaggtaaagaaagcaatccctcactatatatatcaagagtagaaatatctttgtgtggtttgtcacaaccattgatctacagaaagtatttgggttaagcgctaaaattatgagacttcaaaatcctgtataatcaactggaaacattctaaggacatctctcaccaacactacaaacttctctattttaacatctggtgttgatcttgcagtagctcacaaacttatacatacttgtaggatttctatagtacaaaataggtgacaaagaaaatcaaatagactgacaaaagaaatgatcacaacctcatactttttctagtaaggtttgtaaagacgtacagagtttagttatgctgtaaataactgaatatacaacattcgttacaatagacacttaatgacaggcataaccagagtatgaaaagcatgtgtttaggatttttcattgcaactaagacaaactcttaaatatattattaaacacttataagaacattgaccacttctagtctttatattgatgaaaagtcctgaatcaattaggcagatttattggtagagataatagttagagcaccactagttatagcaaatagaggagaaccgaagcaaaacaatcccagagtacacctagatcgacaacacaagaacatcaatgacaaaattttaaaaaatcataatttgttaacacttgaagaaaaactttcaacaaaaaataccaaaccccaaccaccaaaccaaaataaatacatttaagatttagtttggtggttggggtttggtagatttttttgaacgattttgttcaactattaacaaattattattttttaaaattgtgtacttgatattccaatgttgttgatctttatatactgtaggattgtactacttccggttcatctcactgttgctgcaactggtggtgtcttaactacaatctatacgaacatatctactcaattaatttaaaacttctcgtaaataaaaagactaggagtgggtaatgttcctataagtaatcttataatgatttttacaagtgttttattatttgtttaacggtttgtcatacatgcaacttaaaataataaatacatgctttccatgctctaattttgcttatcattagtagtgcaatgtcacaaatgatgtatatttagttgtttacaacaaaactaaactttgtatgtatgtacaaacattcccatgaaaaagtataaggttgtgggcatttctgttgttagtttattgggtttactttgtcaattatttcatactatcaaaatcttacaaacatattttaaatttgagggctactgcaaaatccaaatcagatattaaactagataactttgtagtgttggtgagagatgtccttgtaacgtctccaaatgaaactataaatttttattgcttcactaaaatactttctatagatcaatggttgtgataggtcacacaaaggtaattctacactttaattatagagagggatacatgtccaaaaacaaccctacaaaaaatgaaatagaaattttattatattctgattacattgcattgtaggctgataaaatataccaagagatcgaatgtcatacggagaaaattgtccgcgctgtcgcgttaaagtcatatatgtaaacttgaaactgaaagtaatacaagggcacaaagcatattaatatgactaatttacttattcttattgataaaaaggttgacacaattgaatattgtagtgattatactaagaaattgttgcccaaattagaagctgaaactgtagagtaccctttttgtcttcttcagtagtagatatgatgaatctcataaatctcaaaatcttcatgctcaagtctatgatgaatggacaattatgaaagctactaaaccacgtcaaataatatggtccaaccttctaatctaaggaaactatacgagaagcaaatcagacaatctatggtttatgttattatctttttcattgtttctcatttttgtttttatatgatttttcttgctgatatctctgttgttacaactttataaaatatggagaaggtaccctttctgaaagtagtggtggagcaacgagaaatcaagatggtttgagtcaaacactcaaacattccccaaattgcactcattatattactcgcatgcctaactacacttcttatgtttctctcaaaacaatagtgaatcccttcgcagagccaagcagctataaggacataagtgaaatatttctatttcatcatttttaatgttttctatttttgacagttgtaagcacattgtttaaatctttgacagacattcacaatcattatactaagattgtgaatatgattgtcaaatatctgtctggaagtgcaacattcttccccagatttgttgcgttcaagtaattctgttgtctcactttatcgttacctactgtcaaaatattattcttaacatttttgcatttgataacaacttcacaccctaactattaaattgttgtcattgatagattctttgttggctttgagctctcttgattgttttatctcatcattttctatcttaaaaaaagggtctatgcaagacgaaggatgaagtgaaagcaacatggtctctaggggttctacaatataacaccagggctccaatttacatgctcatcgcaacagttgttttgtgctactccgccattgcacctttgattatttcattctatgttgcattgctcttagatgacttatagcgaaaaatcaggtaagccagatgttttttttgtgtgaaatgactagaaagaaaagcttccaattatattaaaagaataaaaaatcgaaacagggcaaaacaatagtgcaacaaatgcatcattttttttgtttgcgcactttgatattcagtttgttaatactataactttttatgttgttttgtgaaattatttttatataaatgatcttgttttgttaattggttgtttggtgaagttgattatcgaattatccacctttctaatgcatattttaagagtgtttatagtgcctaccaaacagggtggctcaccgaattaaacttctcatgtcaagttaagtaacttggctagtttggtagggtccatctatagttaaactgatcatctctagttaagggtccatctatagtgcctgtttggtagggtgaaattatctcaagttccacagcaaaattcaaacaaaaattaccactgttttatcccctaacaaaccctagttctggaaatctatatgaataactaaaaatataaccagaacaaacgcaaagccactaaccattcataaagcccagctaaacaacaataggcgcacaatgttgcaagcccaaaaaatctaccaagcaatcagagttaaacatagaccacaatttcaaaacaagcaaacgcaaatctagtatccacaaaaatgttcagctccgatgcaaggaactacagaatctccaacctaataatagccgccctagaaaaagtgcacatccgaatctaatccttgagtttatatatgaaacatcacattgaagggccgacaacacgtcaggaagaataatagggctgcaaatcgcaaaaaaaaaagaccgaaccgaaaaaaataggtgtggaggatggcctcgtgaatgatcatcgatgcatcaggcgagtcgaacgaaaccctaacctccatcaagcgcgcgcggccagccatttcgtcacacgaaactaccgtttccagacaaggggaaggcgcgggatgacaactcaccttttgactcgaatcccgttagccggatttccttctccaaatctagaacgagagcgatgcaaccaaggccacgacacaagaggatttctcaccttttttcgcagaaacaaaccaaccgcgtcaggtcgaggggccgcagtcggctaaccggcggcgaggaatagcgtcatggagaggacctcgagcgaggagagcagcgagacggaggcggcgatgaagacgagggagaccgcgacccagagaggaagagggtcagaagagcacgagtggggaaggaaaggccaacagcccaaccctagcgcaggcggctggcccacgggcaactgtttggaaatataagtttcaactcatgaaaacggcttcaattgtt

SEQ ID NO: 50 - DNA, 4708 bp, Zea mays
cataactagtctataattatgcatgctttctcagaaaccaagatgtaagacgcacctgtatagagaacaaatcaagttcctggcccaatcgccgatgatctcgtcgcttggcttcctccttaaagtggatgtaagccttcaactgatcttcattttcccaagcagttccatatattctttgtagcatttggtttttctcatcacctctccagtaagcaccagcaacggactcaagttcaacagcctttctgtctatttttccagtagactccacatgaggcccggcacagagatcccaccactcttctcctacatgacacgcaggatatcatcaatacacgctagcataaacaaaccaatctctcttgttttgagatatccaagtcaccgatttacaaggctaaccaatgtggtatatggtgattggttcttccttaatgctctccaaaatctccagcttgtaaggctcattgagtgcttcaatcctcttctgagcctcttctcgggacacctcctccctcaccaatgggaggttctgtcggatgatccgatcctatcaaacaattgaaattaccaaattgacaaatcaaaaccgccactatttttttccctgaatattaaaacagccactttgcagttcaggtcaattcgcacatgctcagtgcaggaatgcagactcaccatctccttcttaattttcttgaggtccttatccgtcaagggctccatgtcgaagtcgtagtagaaaccattctctatccagggacctattgtcaccttggagttggggaagagcttctggacagccatggccatcacatgggcgcactacagcaacaattgtgaaagacagtatactaaggtgtctatagttttgacgagacactaaactgtacaggtattagagtgacgggactttggtgagaaccgagaccaaattaagcatacgattaggccagttcaagcactgtaacatagggggagaaggggagcggcagtacggtgtgccggatgcgcagaaggcgttcggaggactcgttggtggggagcaccacccgctcctcctccgcgtccccggtcggagccgcggccgcgggagcatcttctactggtgccgagggtgaggcggtggaggaggaccgcaccgcagtgtatgggagcctgcgggctgaggcgggtctgaggggcgggaacccagacagagaagcggccgcgggacggtggcgcggtgacgaggggaagagcgagccgtggtgggggtgggagcggagcaacggggcggaagcggatggggccgccattgtggcccgggcgacgccgagctcggggagcgtgtggcgggcgttccgccgttccctcgtctttggcacgccgcacgttaccccgtctggacttcggatatcgttcggctgaaccacggaacggctcgttacttggccgaaagatgacccgctgccggagaacgctgaaacaaacacggattaactgttgcgtgcaaacagaatttaggggcaaacgtgtgcaagtaagtctgcagaacgtttagatagatcatggtttaactgtagatgcggagctcagcagggccacgccaccgtgtgttctttctatctgggattgggatgctcgtccaggtgtgtgccgcgcgtgctccacaaacagcaggaaacgctacaggaattagcggtggcacaccgttctcccttctccgagaaaggcgagcgccgcaccgtcacgtcaccgccgtgtcttcccaccaagctcgcgcgcgcgcgcgccacgccacggaccacgggccacggcaccggagccgcgtgcgtgccggcccatatctgatgtctctatctatccactgaccagtccccatccgcctccgaacccacgaggccacgacccactactacatcagtccaccgccaccgcgcaccgcgagtccgcgacagacatccgcgccccggcctcactctcactccccagtccccaccgtgccgccacaagcgacgcgacgcagccacgcagggagagggaaatggccacggccgcgactgccacggcggggagtagagcagccgtgctgctgctgctctcgctggcgctggcgctggcgctgcggccctccgacgccggcgcgggcggcgactgccacttcccggccgtgttcaacttcggcgactccaactcggacacgggcggcctgtcatcgctcttcggcgccgcaccgccgcccaacggcaggaccttcttcggcatgcccgccggccgctactgcgatggtcgcctcgtcatcgacttcatcggtacgtgcgcgctcgtacagtcgtactcgtacgtctcgcctgcggcctgcccccgaaccactcggccgctgaacccgccgccatggacacggtctgcgcgggggttttcactgttcaccttttcacctgccctcccatggccatggctatgattgcactgcgcgtcgggcccatcgattgacacacccaaaaccgccttcacttgccgggaccaatgaatgcacagcgttaactcgttctgcctttggtcccgcggcgaagataagtttggggcaaaaaaaaaaaaagatagagcagtaacctgtaacaaggactccagtacgtacggcttttagagttttcgttagtaccaatcaccatctgtttctcacttcgtctcggctggaacgcgacgagcagagagccgaaccgagcaagcagaagcagacggttgctcaggatctctgaaacgacaaagccaaccccgagtccctgacacgagaccatgacccctgaaacaccggcctcagaccatgtgccgcgtgccggacgagcatgggctccgttcgacctcgaccggcccatgcgcgtgcgggcatgtccccagggcaaccatgatgcgcgtccccgtctcaatccagcacgtgagcacgcgtgtcgtgtgattattttgacctgcctttctggcacgatcttggtttcattccaagcaatctgacaaaaagttcagtgattcgggcaaagtatctttgcatacgatcataggccactgccatgctgttgggagatacagtacgagcaatggagatgccctgttgatcttcctttagccctttttattttagacgaactcctctttaaccttttggggatgctgatattgggaaggacaggaagaagcattagcctattgtggtagtaggtacatgaaaatatagtgggggcaaagcggcatgaggagggaatcagatttgggtggcagtggaggaatattttttatcaaatacggatgtttcactttatagattgtcaccagagttgaaggataaagggtgacactgacatttttttcttaatctgtcctttggtaactttaagggtatatataacactagaatctgaacagcagacagtgggaagtgctacaaaacacatgcaggtcctgttcgaaatgcatgaattcagtaagaaactgaatgcacaaggcttcaacttgtatggaactacctcgttctatatttctactgaattttcggaaggcttcactgtgtttggccaaattcatgcacctcgcagtttagatttcgcaatgaatgtcaactggtaacagaagcttctgtccctagaggcctagacttcgccaactggaatgtactgatcattaagtgtcgagttgttttgccatagactagcgccaagacagtaactcttcagcgacaaatgatcaaatggtgcttcttgatttactctttatctcttcgtttcccgaactgcagctgaaagcctggggctgactcacctcagtgcgtacctgaactcgatcggaagcaacttcacacagggagccaactttgcaacagctggttcatcgatcagaagacagaatacatcgctgttcctctctggtttcagccccatttccttggacgtgcagttctgggagtttgaacaattcatcaacagaagccaactcgtctacaacaacaaaggtgacaacagaaaccccccaaaccatctccatcagtatttttatgttttatcccgtcaagattttattcagtaacacttactcttctacatgtaggcggtatctacagggagatcctaccaagggcggagtacttctcccaggcactttacaccttcgacatcggtcaaaacgacatcacctcaagctactttgttaacaataccaccgaagaagtcgaagccataatccctgatctgatggagaggctcacatctataatccaggtgctctttggcagagcaagcatcaagttgctgttgctctttggaagatgttaccacacacaacgttccatggatggtctgctcatttagctgaatacatgcaaatttgcagagcgtgtactcgcgtggaggaaggtacttctggatacacaacacagggccgctcggctgcctgccctacgcgctgctgcaccgccctgacctcgccatcccagcggacggcaccggctgctccgtcacctacaacaaggtcgcgcagctattcaacctcaggctcaaggagactgtggcgagcctccggaagacgcaccctgacgccgcgttcacctacgtcgacgtctacaccgccaagtacaagctcatcagccaggccaataagctcggtaaggcgttcatgttggtgttgtttctaaattctaatgctggctggctctgaacgtttgtgacttgaagtcgcg

SEQ ID NO: 51 - DNA, 4659 bp, Zea mays
caatcgacagtgatatattattgctgattcgtggcctgagtcctcaccgttgattttttagaaccttacgtcatttttatatttctaaattaaaaaccaccattgatgggtcaacaatttatagtgaagtgggtagcaatcatgtgcttacactattacatgcattgcaccatctgaacactatgtggataaatttatacctcatagctactcaaaattgattgttctatctaacacaacaatttttatatactttatatgatttcgtcatacattcagtgatttttaatatgtactttgctaaaaccttatccggagttatatcaacccttgctacatctttttgagacattacaaatctatatttagtgaatctcaatttctaattctaagtgaatgtcatatttttcatccacacattaaatttagactttgcttcttattatatattctattaaaaatgtcaactatattttgttaaaatagattctagaccgtaccatacattatattctttgatattacagtgacatgacaatagtttcaatctacaccgcaacacttaaaatgttgaattatcttctatccaagaatcatatgtataacggcactgttttataaaaaatggagttctcacagttgggttccaattttggtatgccaaggtgtatacaaagtaataacttacagaaaatattatggtagagtttggtttgttaatgaaacaatttctcaccaccaataaactctaaatgtatatattaaccgttaatatatataatgtatacttgtactttatggcacctggcatttatgtttattttcaattgaatattggtagaactcggtagttttgaaatatatatactgtatttttttcattgtttatttttaagacaaactgtagctatcaatttaaggacctatttttttgaaaaaaactaaattactggatctaaaattttaggtgatctgataacccacacccaaatattttctccatccaggaaagaatggaagtctcgtttcccaaggagtcaaaacattctaaatcttcataggattgcataagataatatcttccactatgtttgtcataaaaaacatttgacgactaatgtattattttttctgaagatcatatatattaatagtttctgtatatatttaatcaaattggagattgtttttggggaaatatggatctgttactagtttactactaaaatattataactttagatatataccattactatcttacttatatgtgggattcacatgtgtcaatgacatgtagagtctatgatttatatctaaagttataatattttaatggtatatatctaattattccttgtttttgagattttcctccttttgggagacgacaatccgcagaatacaaaacacacgtgcagacaatgggccgaaacgtgccatgagtgctcgggctttaaggaagagtctccatgctattgagctgctaatcctcgctctgtttcgggccgtatgccccagtccggactccggagttcccacaccagcccgcgggctcgatatttgctttcgcaatttcctctcgtcgctcgccgctaggctctagcgcctggtcactcgcagtcgcagcggagattttggccccgtgtgccgtgttcgtgttgcagcctggttccgatcaaccgcttcctggctatctcggcgtccttcgagcgccgctgcgggtgctggctcggcgggtgcggcgacatctgctcctgcgccgagggtgttcgacggaatgacgcataatgagagaggtagccagcggttcttctctgactgtacttttttccccattatcgaaattgatgatttgatgtgctatagtagtgtcagtgctacgtagggctggactggactgaaaatatgccctgctgctgcatgtagagtacagttttgtgtgctccgtgtctctgccattccccttttgcaatcttattgcctctgaatttctgcatcatatgaccagagtccctgtggtttattttcgttatgggagttgggtccgtttttttttctttttgtagaagcctggttgaggtaaactctaagtaaggccccgtttggtttggagtaactaaagtttagtcacttttagtccctaaagaagcaaacatggtgactaaactttagatctttagtcacctaaactttagatctttagtcaccaagagggtgactaaaagggactaaattaggatttttaacttatttactctcttcacttttttcttgcaacaaacatccactaattattaagggtaatacagtcattattcacagcgattaatgctctttagtccgatttagtcactgaaaccaaacggggtactttagcgactaaagtttagtctagtgactaaaggaaccaaacaggccctaacttgtgttttgtggaacgctgtttaacgccatcctgattcagggtgagctcatctggaaaataagaatattactgttagcaaagcactgaattgtttaatccttcggtactgttgttctgtcattccaaatggtcgtgccctagcccctctgattttatggttatctaacaattctattcagtaaacaaattctgcaagactgaaaatggacatgaaaaatgaggctattatgactggagtactagtgttcagtgtcacaatataagtgctatgctaaattcagctcgcaaaggtgttaaacctgcagctccattagtttagctcctgatttattttttcaaatgttttttttcattttcaaccatttgtacagattttagtgaaatccggtgtattttctcattttgatttattttaaacttgcattccttttatgacgggatgtaaatttgatagcagaagatatgtgaatgagtatcacaaggttgctacttgtattaacttgctatttctttcagcgatgcaatgcaaaagtttctgattttctgaaggtggacaaacatgctgaaacattcacagttcagtctgcagagaattttttctgctcttagcgtcaagcaaattccacttcctttttgtaagtacaaatcccactttgtgaagtttgcctaaaagtaaaactgagagagtttggggcagctgccttgcttggatgggcatttggtttaaccatcaatctataaaacagtgtgcctgttctcttattgctgtactctccggaattcattttggtgctcgttctttttgtaacaagctaaacaatggaattgccctaaaggatagaagccttattaggtttgacaggaatttgattgacatgtttacgctacatgaacttttgcaacagtgtacacagaagaggtccctcttggttgggaaaggctgccatggtttagccatccatttgggtttggtaactgatactgtcacatgcaatattctcatcaacttgtatacaaaatgtggtaggaatgattgcgctcgccatgtttttgactcaatgtctttcagaagcatagtctcatggaataccatgattgctgggtatacctgcaatggagatggtttacaggctctgaagcttttttcaaagatgcaccaagaagggacacagatgagtgaatttaccctgtccagcaccctatgtgcatgtgctgcagaatgtgctactatagaatgcagacaattacatgctatagcaatgaagcttgcattggactcaaatagttttgttggaactgctgttcttgatgtttatgcgaagtgtaatatgattaatgatgcctgtttggtttttgagaagattcctgagaaaactgcagttacatggagtacattgtttgtaggactcatgcaaaatggtcttcacgaagatgcattacgtctattccagggttcacaaagggaagggatacaattgactgaattcactctttctgctatactcagtacatgtgcaagcctagcattgatgattgaaggaatgcagctgcatgcagatgttatcaagtatggttttaataacaatttgtttgtggcatcatctcttgtggatgtttatgcaaggtgtgggcagattgagaaagcctatctagtatttgctgacatgaaacacaagaatgttgtcctgtggaatgcaatgataactagttttactaggcatggtaaatctttggaagcaatgattctctttgagaaaatgcagcagtcagggatatctccaaatgaagttacttatgtctccatgatgtcggtgtgtggtcatgcaggtttagttgaagaggcccgatgctactttgatctgctggttactgatcagactgttaaacctaatattgttcactattcttgcatggttgatgttttggggcgatctgggaagactgatgaggcttgggaactgattcaacaaatgccatttgaaccaactccttctatgtggggatctttgcttggttcatgccgtaagtacaggaatgtcggaatagccagactagcagctgaacagcttttcaaacttgaaccagaaaatggtgggaaccatgctttgctttcggatgtatatgctgccagcggaagctgggagaatgctgtgttggcaaggaagtatttgaatgatactggtgcaaggaaagatacagcctcaagttggatgtaggcaaagccgcaaagg

SEQ ID NO: 52 - DNA, 4626 bp, Zea mays
ggaatattttgtggtgctttttatcaactgtctctagtagtctctacctcatacagtattagactactgaaatttttattctgtctgcttctgcatcctcaaaatgttagggcgaaaggacaatcatgataagggtttagggggcacaaggggagctggaagtcaaacacttcacttttttcctgtgaggaattgtaatcgtcttattcacctgtgattggaaaatattaggtttgcttttttgtattcttcaggatttcattccatgcaagccatttaaagatgaaaaagttatcttaataagaaatatgagccttcccttcagtttctatgttgttctttggaaaaagtaaaacaatcagttgcttagtcaaaataaaagttaggtgggtgaaaaaaatagaatgttactccctggaaaacagaaggtacagaggaaaagtacaaacagggaaacagaagtcctatcagccaatctattatgcatctctttattgatagtataacatattaaaaaggtgtcagctgaaagaaactgaactactaaagtacttaacttgttatctattcaataactccaaagagaaaataatatcaatgtggaaaatttaatagcatgctaaggtaacgaagcatatgtacctccattgtcatgctgaaatttctcccatgagctattggggaaaatgccatgtgtcacatatgcactgacctttgcagctccatgagcagccagtactttctggacaggaaaaaagaacgctaaattgcaactctcaagataatatacatcattagaagccattataaattgtttctagcaaaattaaggcataaatgtgcgcacccgaaataccagaacaaagtgaaggtcatcaataatcactatacacggcataaagaaaacaagtcatggacaattcttttacctggcactcaatcaaagtactgccagactggaccaagtcatccactataacaacatgacggcctctaggatctccctcctttatccgtacaattctctgctccccttctctaactttgttacatataaccttaaaaagcaatttatgaaaacaatccattaagaaaggggctagcctttttgtttcatgatttggaattggaggcagtactcaaacaaaaagatataccataggaaaatgttgaagctgcttatagaagcgtttccatgcaccgtcatctggaaatgctatagttatctaataaagatattaaggattatatcagatgatacagtacataatgtcaacaaaataaaacttgttgttcacttagtcaggtgcactcacattatgggaatcaggtagctcctgaagcttacttttcagcaaggggatgccactctcaaaacatggtaagaccgagtctccaaagtagaatctctcctgatgagttattaagcgcaaggttatttacacactgatgttaatgtctttgacagaccaagccaagaagttcaatgtattatatgtaataattttacttgcctgcaaagcatggatatcgaaaattactaaactcgatggtccgcctcgtgatattggtatatttgacaaaaatctggcaagtgtaaacgcggttgcaacatctccctcatcttccatgcgctcagaagtcccggttgggaaaaacgggagtataagagtaaacgaagaaataaacaactttggcagattatatatgacagatagttgctcaaatatgacgctgggcgagctaaacgaagccaaaaaggcaacatgctgcccacgaatgttatgggcattcgagatgaacagattcgggtatccgtctggaaatgtcctgaaaaaatagtaccaaagttagaataaggaggaaggttggttcacttctgctgaaacaaaaagttgctgctggagtatgacatacaaaataatctgagaacaaatgtgactgccacctagaaatagaataactaagataagaacattcgaatgattcattttaaacctaggtcgttcactgaagcaatcatgtaagtaaatggcccaactgaatcgttatggtggcttcatatgggtggcttgaatgtagcaggatcgtgatgtcctaaccacaacacagctcctaaaacagtgtacagctcgcactcaatagccatgtttggttgcaataaaggccaacagagtgtatagagtagagtactggcgaactcattgtgaaacctatagtatttggtcagcactgccccaccaaaatggtgacatatattcgtactaatttcccacccgcagcttcctccctgtttcccctgaacgccattcatcgtctggagggtaaaggtatactgtcatattgtgtttgtttgtctgtgtagagttctggtgttgacaaacctgccacgaaagtggtaccgtaataggactcctttgctagacgcgattcgaaccccaattgtgaacccaacggattcctattgcgaggttataatcaataactagcagcgttagcagcagcagcgaaatgatgctgggagagaagggtatgtgacctccatgagatggatcgaagttcgatgtcatcgttccgggcgaccacctgctgcgcgaggtcccgcatctcctcgcagtagaagagcaggacgttcttatgggtcttcatggagccggccatcttaggcacggcgagcggcgcgaccgtggggggcacgtggagcccggttccgtttccggcggcggcggcgctgctgctgctggtcgagcccaggccgccgaggtggaggctggcgcgggacctgctgcaggcgggggtgcgcggcgaaggcctcgcgaatgcggggctcggggtcaggaccgggtgcgtgctcagcccacgggctggggctggggttttggcgccgaacgcgccgggggaggcggaggcggaggcggaggcggaggtggccgttgccatccgcgcccgccgcacgcggcacgccgcggtaaagagggaggaggttgttggcgaaatagcaagccaaggtgcgccgagtagcggcgttggcagacgagacggactgtgcgtgtgcggtggatccttttgagtgcgataacgtaattttatagcggcggggttggatgaagtgcaacggcgtaggcgcgccggcgcctggttgttgggtcagtggcagtgggtgcagacggacaaaccgcggaagcgtgcagcactggcacgggtgtctgctcatgtgtgcagccaagatcccgtctgctcgcttttgttaggctgcggcagcaggcggggtccgcgtcgactgttattgtttttttggtctggcacgataaaggcatttggtgcggcttcgaaaacgaacactgttccagtgctatagagcaacgagcagcttgtccgctggcagctggctgcatttagcaagggatctaattgactaattctaaatgttcagctaaaggtctcctaactaatgaaaatcatattgtcgtactagttgttttaacttaactaaaaccagctaaaagtagtgaataactaaattatcatcgtatttttactccagcgtgcctcttatttcttaaccctgcatgtttctttttccctccaccacgtgtgctcacgcttagaaccctagtcgttttccgccacaactcagtcgcacacttcttccacgagttagcttcttctcccagtgttgtcacctcctcaacatggacagttagtatgagtttgtagatgatgaagtgacctaggatctgttatacctcatatctatcgtcgcaatagtcgtgtccaccttcaccacactagccgctccttcgttggggatgcttcaatgacttggacctcaactcgttggtggacgtcgacgacatgtcctttatagacatccttggggcagtagaggaattgttggatgtgtcatttggagctgcagaggacaacgacggtgtgcgtcaactctcgctatgggcatggctttgatgctagacagacacccattgatggttggggtccaaccgaaggtgatcatggcacgggctctgttcatggggtagctttggctatggtgttggcaattgcagtgccagtgctacctgtggagcttggactcgatctacagaattactaacaaagttcttttctgggggatcgagatcctttgctcccccttttttgttgtctttgtttaaaagatcctttcaagttgtctcattctgattatatcatttgggactcagcaaggcttagggatggcaacagggaattcctcgtcgggttttagctccccatctctattcacacgacaaaaaaaatccgcggtgatccccacgaacgcttgcaggggacatttcttccccatccccgttatcggagataaatctccattggggatccccgtccccacttaaattacaattagatcgtacttcatttgttattaatgtaaaacattgtcacttatacgcattgttagatgtaaaaatcattatgtgtacattaaaaagaacacatttgtacaatgtgtgatctcttgacacagtgattatttatttttaccattaactattatatgaaaacatcgtcacatgtaagtgtaatgggtccccgcagaaactgggatggggaatgcttcctcggcca

SEQ ID NO: 53 - DNA, 4623 bp, Zea mays
ctccatttttactttcataaaaactctacatctttgtcattgattttctatgcgttaaaaaaataaacatttctatgatttacagaaaaacataatactcgttaaactatgaaaggatcatgatagatacgtctaattgatgcctgctatatcctaaggttggacagtcttcaccaaaatcattagttgcatgaaatgacctcaaataccggccttcatagctgcaagaaagaacaaaaaaagttcatgaatcaaaaaacaatgcatagacattagaaggtgtttatctaatatgagaaggtaatcattaagtagaatttagtgtgttctcttcgaaaagaatttggcatataatatttatactcacaaagaaaatgtgttttcctcataagaagcaccaaacctgcaaaatagaagtgaagcaaccgtttctttgcttgtccattcttcataaaatgtgattcatcagctacgacaatttggaggaaaatcattaagccacgtcacaatcattatgatggtttttccctaatggaagcaaatacagtcaaactaagccaaaaattgtctgaaaccaatttgaattgttttagtttttcaggaaacagaaggcgaggtagttacataaaggcaaacaattttaggaaatagcatgatatccgagttcacatatttaaaaatgctattagtagctataaatatgtaaagataaacaatttcaggaaataacatgacatcatgttcacacatttaaaaatggttttagaagctataaatatgcaacatattttccctcactctaatgactatgtcatcgttttctaagaaaatatgtaaacctgaaggatatactcatgtttatccaaatcacccataaaacatgaggtaaatgaaaaggtccagtgaatagtgatggaaacaaaataaaattgcatgtcacgaactacttttggataatgaattacacatggtgagtacatcattagagatggaccaatttgagttcgttgttggtgtcacaatacttacaggatggaagttctgcctattataaacgagcctactgctgcatcgccagtatatggttttgataaaaagaacaatgaaacaattctggttaagactcaagagaattcagtgtatggtgaagcttagagcaaggtaggataaaacacaaggaagaggagaggaaaatacatagttgatttgtatgagaagcacatgatatttaagataacagagaagaaatatatagccgacttccccataacaatttaatcttttgcgaaaatggcaggtcataaatgtggaataaatattccctagattaaccgatgctctaccaatctgaagtaccactatctacgcagtgaggaccgagaagcatttgttgctgccaaatttgaaggatgaaaaagcagcacataacgagtggaattataaaggcatatatcacacaaagtggaggataaaggactaatccatcaatgcatcagaacatgcagttagcatctccattactttccttgcacatgcctaaaacagttgagttgtcctaacaaactgtagtgaaatggtctatcaagtatcaagcaatagcaaaaatgtacaagagaatgagcagatactgcctacattccataatgataaaaacattctgaatagggaaaagtcatacatcccagaacaaaaggaagatagaaaagatgttccccagtgacatcgcatagtagcaaatttcatgctggaaatgagagaaaaatataagcaaaccaattcctttattgcaagcgaatgaaaatagatcatccaccaacgccacatgcagatcaacctctgcctcttcaatttctagatatgcacagttttcacagggttagcgaatcacatcaaggctgacccaattacaatataccgagaaacagtacataggcttggtggcggggcgtctggatccgaggcgggaaagctgtcaaagcgcggcgtgaggctagaggtggtggagggggcagatctgagcatttgaggaagacatcgatatggaggcgctggatccatgtcggggaagatgccaaaacggtggtgggcgagcgcctcccgtcggagccaccatggtgtgagggtaagtggtgggcccctttggttgccgctcgtgggaggagggaggggagggaggagacgtcaggatgcatggaaatcactaagaacctacaaatctatgaaattatgctggaaccatacatgaagtcgaataggtcttggggaagaggaagcatctcttctaatggctgcatgccggtgcaggtacgacagagtttgcttgatacctcgttggagaagctcgaaggggagatgtgggccatcgcggcctcactcgacgacgacctttgttgtcttcttccgtcacgacgacaccgctgggcgaggaaagcaaatgaaccagatccatatatcctcttgcgtgtagacgacgagatgaagaccactccgatcgctgggagatatgcgccatcgactttcgcctcgccttcatgagccttttccaaaaagagccacgaatgggaggcgagcagacgtgtatagcgtccccttcatgaaggggagagagacgacgccgaccggacagagggcgaggctacgaaggagagggaaccattgtgtgagtgaagaaattggcactgtagcatctatagtcggggggagggagtcatagggtaggttatagtagatgtgggccccatggatatgctacctggttgggacagatagcggaccgaaccaaacctttggactagggcttgttttacttattgaaagcttagggcttctaatacataaactatatatataatctagtaaaaaaggtaaattttaattttgggacggggagagtatataactgatgcttgaagtataatgattaaataatatattatcgatgctcgaaccaagtatattttataaaatcttgatcgcgttataaattagggagtaaacagggtaaaaaccaggcataaataagttataagcaatatatttatactttaataaacacgcgttgttccaagtggatcgggtaataataaaaaatgtatgcatgggatgcaaaatgattagtgctctcccgtagacccgtataccagattatagatctcaaactaataataatataatcgaccaacctaatctacgacaaagtatactccctaatctacgagaaaccgcgatacttctccattgtggccgtctacttgttctcctgctggtcgccaatgggcaaaatggtggcgcttgtttgtccgcctacttgtgctgctggtcgccggtggacgaagacccttgttcctcttacggagcttgtgcgagaggcatggccagcgtaagtctaaggtcgatctcgctgatggtgtgagccacgggtggtgtaggcgtcgatggcatggccagtgtaagtctaaggtcgatctcgctgacgctatcggcctcgctgacgatgtcagccatgggcggtgcaagcggcgacggcgtggccagcgtaagtctaatgtcgacctcgttgacactagctacgggtggtgtaggcggcgacgacatggctaacataagtctaaggtcaatctcaccgacggtgttagccacgggcgttgtaggcagcgatgacatagccagcgtaagtctaaggtcgacctcgccgttcaccctgacgggtgtaggtggcggacacctctttttgatgttgagcctgatcggcgggctagcgtagtgcttcctattggggcctccatgcaacgatgagctgtcggtgcaatcctgcggtgactcaacggctggtgtcggcgagcagatgacgacgatcccagatgtggagctgccctgatcgctgatggtgcgaccagacccggacgaaggcgtgggcgacgacagtggggtgtcgacctggcccaccgtgtcgttggcgttccctgcgtcgcgctggtcgtcgaggcgtgagtaatccatacgattttttctggctagctgtgtctactgggcgcggcttaaatagggagacgagaggaggttacgtgaggaatccatacgatttttgaacgattttttattcgtacgttgtcaagttctttttagataactccattacaacaacatatctgatctctttcttaaggattagttagatctgatcgtttgaacagcagatttaatctaaaacatatctgttgtagagtggaatagtagatcgtttaagcattagttagatctaatcgtttcctcgtgtgtatgtacacatgctgccgtccgtatacttttttccctcgtgatgacatatacatccggtgcaggaacgcggcgcatccgaatccaatcacatatattggtggtacgacaggtatctgtaattttacacttcggaggtatagagttaaaattccgaatattcttaaatctaaaaatgaaaaaagaaaaaacctcaaggttttgatcccctatctctctagcggcagtataaatggtagtggtagtgtaaagtattcttttatactgtgtttgtactgtagattacactatttacaaggtagtgtttgaaatagagagtggaatagggttaaagataatctaaggttg

SEQ ID NO: 54 - DNA, 4534 bp, Zea mays
taatttgagaaggtttacacttgtgctccaaacaagataggttaaaataggagtgtatgaagtgtttggacgagtaatgatagcacgaacgactttaacagttaaaataggagtgcatgatgggtgggcatgactttgtgctgttacctgtttcctgtgaagagctaaaagtgacgactatatgttcaaaacccgcttcccctcttaactaaaaggcaaaaactcttgccatgtttttttaacgcagggtacctacaacaacgaggcacttcgatgcttgtggtcgatgtaatacacagacgctaatttcgttttatctatatgttctctttgtttggtgacttagcatgttgggtttggaaaaaaaatttggtgcagcccggatgcaaaccagcgtgtttacaacccctcacaaaaagaaggataaacctcacccgcagcagcaacaacaactaaaacgttatttggtggacttgcaggtgagatatgtcctcctttttgtgagaggatgtaaacacctgatttgcattcgggctgtaccaaaatttttcccggtttaacacagctgcctagctagacctgtctggtactaaatgactttcttgtatcgtgattactgccgatacccgtcgcagtattttacatgcaacaccttccttctaaattataacttttctagatacatagattttactatgcaattaaaacatatattatatctagatacataacaaaaactacttaggaaaagccaaaacattttctcaatggcttgacagatgagtaccccatctttcttttttaacccctgaaacacttctctttaattcttggcctacgaaaaaaagctaaccatgcgccacagacaaaaaaaaaactaatgttaatcctattattaaagatctaggttgacatgaagaatcacgttccttcgcactgaaaaaagtttggtggcgagcattattagagcttaacacggacccccgaattaagttccttcaggtacaagatatatatgcccatgggttagtgacatggattttgttttttaacactatctgaacacaagctttggagattctccccggcctgcagctttataagctgtagctgacccacatattccccgagctgcacccacaaagatcgatcggttcggacgtcgatctcacgaccaacttcagcactctctttttacagggtgtgtacatgtcgtattccgatacagatggacgacaataccttgaactgagtacgatgtgcttagacaaaggagtacaatttcaatattaaggatacgataagagaggctaggaatgaacaaagcacgcaccttctatcttctctacctaaataggagatccccactacatgattttcatgacttttcataaagccacgtcatcatcaggcatatgaaaaaaaaaatcatgtctgccatttcttctttttgtggttttgcagtttctccgtccccacattcgcattcttctataacccttgccatttttaacgtgatactacatgatgaatttcatcaattaccttcagttgttaatatatgtaactacatgtgctctcataatgcatgttttccataagctatttcaaaaatgacagcccgcagcgaagcacggaatatcatttagttagtggagatgttttgcatcaatccaaaacagccactgtgttttgtagtacgaataatgatgcatactccaggcataattgctccaccgtgtcatgccacacacttttgatgtcaaacatatacgtaggccttgcatgtcgcatggaggccggtaaagcattggtagtttggtactcatggcctcatgggccatggcaatgatcccggtctggacatgtttaactaaaagcacacccctttcagccaaatggacagagtaagagtagcatgtttttttttttggtgtggtaagagagagatggtatttgattttttttaacataggtatgttgtgacctgtgatggctgatgatgactatgagctatgcacaaaaattgatggaacaactgctactactgaggttctaataatgttctacattctggactgaaatttggcggaccaacggatctatagtgatgatttgtttgcgacagcaagttgaagcctggtgatgaattcatcgacgggcatcgtgccgatctccccgttgtgcctggacctgatagtcagggtcctggcttgaacttctttaggaccaacaactgccatgagtggcaccttttgtgtttcagcattccttattagctttggtaggcgctctccatgacagacttcaacacgtagccctcttgatttcagttcggaggccacctcgttacagtattgcaactgaaaatacaaagccaagatgtcatggactcatggttacataactaatactaaggcaaacacctatctgaactataaatgcctcttcaatcgaaagagaaacagataatccagaatatcagtgaacatatgctttcaattctaacaacacatggtgaaaggtaatgcaaagcaaattatcaaacctcattgtctgtcacaggtagaatacgtgtctgggttggggcaagccaaagtggaaaatcaccagcatagtgttcaatcaggacaccaaagaagcgctccaaagacccaaggatagctctatgaatcatgatgggtcgctttttctcagagtttgaatcgacataggtaatgtcaaaccgttcaggcaaattgaaatccacctataacatatatggaaatggagtgttagtgtatcccattttctctttaaacaatttgagtagaacaaatcgcattacagggcatcaaacttgtgttgtacatgcaaataagtgaatcacctgaggtgtgccaatgtcaccatgcaaataaatgcaacctgtctaatcacgctaacatggactccaagttttgttcaacatggcaatgggttcacagtagagtggtgtgccaatggtttatgacctttgcattgaacccctgcatgctaatcatattagaacaaatatgttcacaaactatttcatgtgtttagacattgactccagcgttgggtagtgacatgacggccacaagacggttagtattagtgggcatgatgtgaaatggcggcaacattttcactagggcacagccacaggaaaaagaatctctgtatacgggatgcagagaagtttatatgcagcacaactcagatgtcatcaatgtgtgcatcggttgggttgcgcctgcgtgatggaggcgtggttacagaaatcactgggttgcatgcatgataggaaaatattcagacggcaactaaacaatgctgcacgatgctgctctgcatcacaaatgcagagattttttttccacgcatgtatttatctggcagcagcacactagccataaagtggttagcagagcaatttgcattgggtaggtgaaaactagtatactaccgtgtagaaagttagggcaatttataaggaacatatggattaaaggatattggaagatttttttaattattataccacatccttcactatgatttccatgtcagtgttcttagattgacagttcgtcgtggtacattattggtaatctcagaccatccggttagaaagtttagtcatggattagattaattttgaagaacggcgacatatttacatgtacaagacaattttgatgactttcaatgccattttcacatttgagtacctcttatcccataaaaaatatatgatttacctgcacagtggaacattgccatttccttccaagagcatcctcaatttttagatcgatttttggaccataaaaagcacctccaccttcatcaaccttgtattcccaacccttatcatctaatgcattcttcaaagcaattgttgctttttcccatatgtcatcagtgccaacagatttttctggtctggttgaaaggtttatctcataataccgaaaaccaaattgtccaagtatttgctcagttagatcaagaacacctctgatttcatcttttatctggtcctccagacaaaatatgtgggcatcatcctacataaacagaaatagttgaaatctgcgcatcatcctacgtaaatagagatagttgagaattgaaaacaacaccgagagtaattttgaactttataaagtagtggtgagaaaattctagtaccagccatccagtgctatgattgttagcaaaatgttacagagtagactatccatattccataacttaagtcttaagaatagtatgcttagaaaagaactgaaacaacaggtgctgagagctctgctgtctgctgtgtaaacgaatcagaaaaaggtcatatgtggactcctgctggctatatgatattacataaccatgcataaaggcataaagcaattaataatataatgccaaaaggtacttcagggaaaggagcaaaggctgcatagcagtactaaaaagaatgtcattcaaaaataaaaacatcctcagtattgttcatctcatctagcagtag

SEQ ID NO: 55 - DNA, 4489 bp, Zea mays
acaacttacaggtaaagctgtctacttaagcagatcaaaatctttttgcataatgttgatgagctgcaagtgggagcccaaataaaggatggtgaaattgttagactataagtaatgatgacaaatgccaaatatagtatgcaatttattgtgtatgcacataaaaaattgttctcttttgttaagcataaagatcttaaaagtaataaaaatgaagatcaacaagagacaaaaacgtatgagttagctacattcgagtttagctgatccaaatgatgcctaaatatataacctttatgacacgtggttagtagatctaaaaaaaatatagtgtctcttgtttacagcgacggtgcaggcctgaaatttaatctcgcatttacatgcgatcatacacccgacttaattttctctcttaaggtgtattgtgttctatgggatagctcatccgtcatagttggaatcattgttcggtttatttatatgtccaattaggtgcgctttagtcagacaatgtaggatctgtctcctctaggtgtcaacaaaaccttatgcatgcttttcttcagcaaattgtgtctcgtgggtcaggaactgttgtgcgaccttgctgcaatcgggtctcagtggctagtttgacaaacatgcaagttattgattgctactttcttatggcaaagtaggtaacttgttgtttgtcttttggggcctgctagagtaaattgcccacgaggtcaataaacttgtctatagagactaagttagttcacattcttttagagaggaaacacctatttctgttaataggaatacaacctagtcttcttacgagtggatgtgacatgatagaggttttacacacataaaaaatcgaccagcctcagaagtttctcacccaataagaccccagtaaccggctaaccatatgtcataaagttcatatagttgggcctcattttgatcagttaaactaaactgcacctaactcttatgtttagtctctagaagagtggatgtgacatgattcaggttttacccacatagcaaaatccaccgacatcagaagtttcttaaccaataagaacccagtaacctgctaaccaactgttcatataattaggtctcatttggattagttagtctggactacaactaaatcttgcattttagtctctgtttgattttatttttataagtttcaagatatttatctttgaccaatgacgataatttttgcacctcatcctgaagaaaagacatcctcaatttggcatttgtcgtcaatatttttagtctaacaatttcatcattcttcttttgggcaaccatttccaactcttcaacattatgtaaaaactttttaatggcttcagtatcctgtttacctctatattctctcttaatggtcccagtgtaagcatcttccattgtcttaagctggttccaaacaaaattcttttccgtagttatgctgaattttctttgttcttctctgatctcataatcttggaagctttctttagttttattatctcttatctaatatcttcgtaactattttttgcgatccaaattgtcgggactaaattttatttcataaattagtattgacaattcggatacccaaaaaattggagaagatattagggaagtgattaaaaactaaagaaagcttacaagatcctaaaattagagaagcaccataaaattccaacataacaaacgaaaaagaattttgtgtggaaacagcttaaaacaatgcaagaatgttacggtgggatcattgaaagaaacaacttacaagtaaaactgtctacttaagcagataaaaaacttttgcataatgttgataagctgcaagtgggagcccaaataaaggataatgaaattgttagattataagtaatggcgagaaatgccaaatatagcatgccatttattgtgtatgcgctgcaaacattgttctcttgttttaagcataaatatcttaaaactaataacaaatgaaaaagaattatgtgtggaaacaacttaacacaatgtaggaatgttacggtgggaccattaaaaggaacaccttacacgtaaagctgtctacttaagcagataaaaaacttttgcataatgttgatgagctgcaattgggagcctatataaagaataatgaaattgttagactataagtaatggcgaaaaatgtcaaatatagtatgccatttattgtgtatgcgctgcaaaaattgtcctcttttttaagcataaatatcttaaaactaataaaaatgaagatcaacaagagacaaaaatgtaagagttagctgaagtcgagtttagctgatccaaatgatgcataactatatcaactttatgacaggtggttagctgatctgaataatatagtgtcgcttgtttacagcgtcggtgcaggcctgaaatttaatctcgcatttacatgcgatcatacatccgacttaattttctctcttaaggtgtattgtgttctatgggatagctcatccctcatagttggagtcattgttcggttcatttatacgcccaattaggtgcgctggagtcggacaatgtaggatccgtctcctctaggtgtcaacaaaaccttatgcatgcttttcttctgcaaattgggactcgtgggtcaggaactgtcgtgcgaccttgctgcaatcgggtctcagtggttagtttgacaaacatgcatcttattgattgctactttcttatggagaagtaggtaacttgttgtttgtcttttggggcctgctagagtaaattgcccacgaggtcactaaacttgtctatagagactaagttagttcacattttttcgagaggaaacacctatttctattaataggaatacaatcgagtcttcttacgagtggatgtgacatgatagaggttttacacacataaaaaattgaccagcctcagaagattctcacccaataagaccccaataaccggctaaccatatgtcataaagttcatatagttgggccttatttggatcagttaaactaaactgcacctaactcttatgtttagtctctagaagagtggatgtgacatgattcaggttttacccacatagcaaaatccactgacatcggaagtttctcaaccaataagaacccagtaacctgctaaccaactgttcatataattaggtctcatttggattagttagtctggactacaactaaatcttgcattctagtctctgtttgattttatttttataagttttaagatctttatctttgaccaacgacgacaatttttacaccttatcctgaagaaatgacatcctctatttgacatttgtcgtcaatatttttagtctaacaatttcatcattcttcttttgggcaaccgattgcaactcttcaacattatgtaaaaacattttaatggcttcagtatcctgctttacctctatattctttctcttaatggtcccagtgtaagcatcttccattgtcttaaactggttccaaacaaaattcttttccgcagttatgctgaattttctttgttcttctctgatctcataatcttggaagctttctttagttttattatctcttatctaatatattcgtaactattttttgcgatccaaattgtcgggactaaattttatttcataaattagtattgacaattcggatacccaaaaaattggagaagatattagggaagtgattgaaaactaaagaaagcttacaagatcctaaaattagagaagcaccataaaattccaacataaaaaacgaaaaagaattttgtgtggaaacagtttaacacaatgcaagaatgttacggtgggaccattaaaaggaacaacttacaggtaaagctgtctacttaaggagataaaaaacttttgcataatattgtcaagctgcaagtgagagcccaaataaaggataatgaaattgttagattataagtaatgacgacaaatgtcaaatataatatgccacttaatgtgtatgcgctgcaaaaaatgttctctttttttaagcataaatatcttaaaactaataaacgaaaaagaattatgtgtggaaacagtttaacacaatgcaagaatattacggtgggacaattaaaaggaacaacttacatgtaaagctgtctacttaagcagataaaaaacttttgcataatgttgatgagctgcaattgggagcctaaaaaaataatgaaattgttagactataagtaatgacgacaaatgccaaatatagtatgccatttattgtttatgcgctgcaaaaattgttctctttttttaagcataaatatcttaaaactaataaaaatgaagatcaacaagagacaaaaacgtaagagttagctgaagtcgagtttagctgatccaaatgatgcataactatatcaactttatgacaggtggttagctgatctaaataatatagtgtcgcttgtttacagtgtcggt

SEQ ID NO: 56 - DNA, 4460 bp, Zea mays
  misc_feature (298)..(299): n is a, c, g, or t
cgcgacttcaagtcacgtgcccgtcgaggatcgagccatcatttattccttggttgagcacggcgtcatggaccggctcagtgtcgaataccggcaggtcgttgaggttgtccgagtcggtgtcgaagacgggtgcatcgtctaggtcggcgtggaacagctcccggtcaaatatggttctcccgactcctcggatttgagcggaatcgagagagaaatagggtagggtaggatggaaaaaaaaaattcttcaaggattggaacggctctgaacaccatctgtgatgacccgtagccnngtgtataagagacagccggtgagccaccaccaggacgttagggccgccgtcgagcgttggcgaggtgaatggcgcctctggatggtacacggcgatgcgatggaagagggtaagacccgattcttttcttctcttgtacccatctccgagttgagttgagccgtgggttgggtcatgtgacaacaggccgccagaaacaagccactcacccccggtccggtcgcacgtcccctccgctgcttctctcccactgatccgatcgaattatcaccctcctttccgtatccacgaacctgctggttttgtgttggatcatcttggatctggatcgggataagggctgatttggtggttaggtatccctagaggatccatggggagaaatccccttccaattcagcccggtcaccaaatcagccctaaagggttcccctgcccttccgattttctaagactcccactggttgtgttgatgctttgttcgtttgtggagcaccgcaactacaagatcatttataggcgttgacagctatgaggtgcgaacccccctgtacctctgcgctctgtctggtctggtttcatcagatctcgtggatcgttatctttgtttgtagttgtaccgctgctacgtaattcctgtttgtttatttgtttgtagattcctttccctgtaactgtaagatactcctatggcctgctgcaattctttctttacattgggtatagtcaatataagggcagtaggatgctaattatttcagttatatttggttgtttggaaataatgattttcttttcactttatttgtgtttccacttaccactacaacctaaatttttttgtatcttcatttcgttcccttatttctggcaactacatttatccaaatataaatagatatgatattgcacgaaatgcaggctgagcttggagccaatgccatgctgatagtgtcaattgcagtttgcaaagctggtgctgcttttcttctaaaatcgtcataatttgataaacgtgtcatgccaccacacataattcttattctcggaacattggatgcttgttgctatgcaggttccactctataagtaagcaattacaataattaatggttgaaagcatgctggaaatggtcttcccattcaagtattcctccaaaccttcagaatctgagaagttgaaggcaccattcccttttttggcccacttgagtcaccttttgcctaaatagaaacatattaagacagttagttgttcatctatatccaccatatcaacatgtttagttgtagttccgtagtaactataaacatttcttatttgtaggaaactatgatcgttccttgctggtgctataaactttgaagaagcaatgcagatgggttcagaggcctatcacaatctcaaggtagccttcacttctaactatatgtgctgcagatataacataagtgctacatcaaatttaaccttatgattcttttcagcggcagcagcttccgttgcctgctcctcataatatcccaattcccaactcaatttcaagggcatctagcttcttacacaattctttaacttcaccttctttctgtgatattatttcaagagcctcacggaactgagtttcaatttcttcattctttgatttagctagagaatggagctctaagattcttgtgtgtacctctgtcaggtgtgagattgtcctctcatgaactgctagcttctctgcatcatcttccttctcagcttgatgagtaaaaccaaaccgttcctgtagctcatcaaacatgaccagcatagcatccactttctcttttaatgcttcgttcgaaccagtcatctattctcaatttctaacaaagccagcttctctgtcatgtctgtaacttcgccttctttttgtgctaccttttcaagaacttcatgcagcaatttctttattcctagattcagctacagaaaggagcttcaaacctcttgaggcctcgttcattttgggcgtttcagccggtttctggctcgttccgggtggaaagaaatggtccggatcagaatctagccatttcataatgagctattcgtttagaccaaaatcaaaaacgggagtgacctggtttgggatttttcctatcttttatggtccggttcgaatcccggctaactatcctccggatcggatcttggcaacgacgcggacagcactggtttgagtgaaccgaccggattcactgaatccttgccttagaatcgttcaggttggaacccattgtaccgaatgagccctgagtgttcttctgtcagcctatcccttaccttctctatgttgaaaatcaagagttagaacatcataaaactgacacatctcttctatcaaatgttctacataaaggagctgcaaacctcaggattacataagtctgaaatgtctattttacattaaaaacatcattaaacagaaaactgataggctgaactgtcaattttgggctgtggtattttcctcaatatagttgttttctctatgttgcaacgatgccttctcgttgaaatgaactctgcatttccatgtagttgaaacatcccagtcgacggcgacatgggcgatcgagccggaacagcaagaaaacgacgtctaggttgtggatgcgctccctttattttggtggaccggctggatttcttccagatataaggcccctttggaatgcaaagaaattgtcaaattagtttattttcgcaggaaaaacacagaaaataggaaattttcttgtattcgaaaaaaaaggacatattgtgcgtgatcattttgcgtctttacaagtcacgtcccgacgatagctagctagctgctgtgccgtgtgctcggtagagccgcatgggcaacaagggagcagagacagcagggagccacgcctacggacgtgagcagggaccagcacgcgttcgatccgagtccatgtaggtcgcgtccaatccccaacctgtttgctacgccgtgcttctgccaaacccacgcacagtaacactgcgcaacctccagactccatcctgtttgtgcctccatgagccacacgggtgataggtcttgtgctttctgctttccaccaaattgattgaacaagagccttggataccaaacttttctgatacagtcattcttgttttgcaaaaagtaaatttatgttctatgttgtcgcataacatacatagttttattattagaaacaactaaaagcttcaaaagttcaagaacaagctacatggatcaatagatgaaaggggaacacctgccactgttttactatctgagtatgcttagattatagcatattttatgtagcattgcgctaacttttgagccttcctatcgtgattaattgcagatattttgcaacatatgcttgtgtagattacttggatgttgttcttccactaattaactcgcttaaaggttctccaataattgcttaattaccatgggaagatgaaacaggttggtagagcaaagtacttttttcatgctctctctgtccaaaaaaaatgagacacattttgactctctagaagtgagtttgattggaaacttctctttgaatattttagagttctaaaatcacgataatacatccacctgattgatgtgattccccacctgatttttaactatgttctgcattccttaagtgcaaagaggaactcgagtgtggtggcctatcaagtattgctttttatttttggtccaatccatgaatataatcattaatcttctgtgtagattgtgcactctgtttacatcccattggttctaggctattagaacacagtacccatttattcgcttttcagctaacagtttagctcattaaactacttgtggtcctgctgatcataatagctccataagttagctatccctgttggtgggtgtttgtgatttattgttcctgtgtactaggtgttcctatgatatttgtagttttctttaatatatgaatttatcatttctgcaggttaaacatgaattagggaacaaaagtttatgacagcaaaacataggtgtgtctttcactatgatcttctccactccgagtttttgatccacttttgaagctggttgagaagccagcagtaaagaaaccttctaattaagttgaaag

SEQ ID NO: 57 - DNA, 4440 bp, Zea mays
gggaaaatcaaaagggtcatggatgcacagatgttcaaaaattctgttcaagagtggagaaatacatgtttgttagcagcaaatggtgcaaaactctcatatcaacgtgctttgcatcttactccctgggaagctaatgttcacaatgatatggctatttgtcttgatctaatttgttctatggatgataaaaacagattcaaccccaatgtttggtaggttttttttgttgcgtagtctaataccatatcgcttttcagatggtgttttatgagttgtctaatagtattatatttttcctttttgtgcaacagggagctgccagagaaaatgtcactgggtgccttgatgttagaaccagttaataaggatttttgggttactctgggttcaatgtcaagttatctggctttgaagcagcattcttttattagggcacttcatctcgatatgtcattgtctgaagcttgggcatgccttggaaaggtactgctgttaaagcaacagctgatttatatctgctactagttggtggtatctaatagtttgcccttcagatttacaggcagtctggtgataagcaattggcaaaacaagcatttgatcgagctcgaagcattgatccatcgttggccttgccatgggctggaatgtcggcggaaaattatcatcaatctgggtacccctcacccctcgattcatggaaaagttttctatgctgtgctctgaaaaattagttactcaagctgttttttctatttcgtgtgattttaaaggagcagtcctgtaaatgaatcttttgaaagctgcttgagggctgtgcagatcctacctgtaagtgcatttttttaatatcaataatctattcgcttgttagtataacaattttctgttttttcttctccgagctagccctgacttcattctgttatgttattgcattagctgccagagttccagattggtcttggaacaattgcagcccgttctagtaatcttctgtcacctcaggtatatttccagttttgtattcgtggttgagacttttaggtggcaatggtgtatccaactctatggcaatttttttagttgaccttcattcttatattctacattatgtaaccgattgacactaagagatacatgatgattcgctaaatcataaagatatttatattgcataatctactacctaaaacctcagtgcctgtgcttaacaaatcattttcttatacttggttccattatgtaggtattgatggctgtaagacaggctgttcaacgagcacctcattatccagagtctcacaatttaaatggcttgatttctgaagtgcgattagatttccggtctgcaatcacattttacttgcaagcgagatttgctttaggcatgatgtacaattccatgtcagataatagacaagcctttgctgatgtttcagtgaatcttgcccgtgcactatgcaaggtaagattgttaacggctattttacatctgctttgatgaagttaaacatattaagcaggtaaaatcatggtgttttggatgatacatctgagattctaatcatcatagtcgttaaggcgtcgcataggcggtaaggcgagctgggatcgtaaggcgtcctcctcgccttagtctagagcttaaggcgggtgctacgcggcaccacggcaaagggtggcgcagcgggcagcggagagaggcacgtcggctgctgcagagggcgacacgatgacgggcggagggctgcgcgacgtcggctgctggtagagagacagggagaagcggggagagggagggaggcgctggtgctgggagagagagcgctaggagaggggagggaggccggaggtggctggtgctggagagagagggagctgtgtggctgggagaagagaagggggagctgtgcggctgggagaagagaataagaggggggtgaataagtgggcttaccctaattttaatgggccaggtggactaatttgggctggctgagttaccctttttcttttctttatcctttttctcttctttattaatagttttgccctaaacaatttcttaaatatcaatacttttctatttttaaatatatttaaggcgtcgcctcgccttacgctttactgcttaaaaggtaaaaagggggtcagtcgccttaccgccttaacaactatgctaatcattgaactaattgcaggctggtcttgcaagtgatgcagcgctggagtgtgaagagctgagatgtcaaggtatattgtttttatttcacttgagcaatggaagagttctgttccctaatttggcagatagtattgacagcagaccctttcaaaatattttccacatgcatatataacatataaactaacaagtaattcatcctaattttgttaggactgttgagcgttgatggattgcagatatatgctctggcattgtggaaaattggacaaagcaaggaagctctttctgtatctggaagcttggctgaaaatttaagcggtataaaggtggagagtgccactgcagcttggggattcatatgcaccttgacgtatggaatttctgggaaggactctgcagctgccatgattcagaagcttcctgatcaactcaattacaactcacagttgaaattcattatctctgcattggatgctttgcatccaaccaaacgtctccagctgcctcagttgaatatgcctcctaagcgtacagcttatgaagtgatgagtgaagtacactcgaatattgctcttgggaaggctgtaagcattttaaaatactgttctatatttctatggaaaactagtttattttgaatacatgcttgatgtactaatatatataaaaaatccttttagattggtgtgggatttgacaagcctctgagggttgatggtagtttgtcttacctgaaaaaagtactgcacatgtatcctgactgcagtttagtgaggtgattttcttgctgggaatggtcatatcaggtgttcaaaaggttactaaacttgaggctcgagtcaaaatgttgctcaccattttctcatgatgcagaaaccaacttggatccctgctgctgtggagtggagattggatggcttctcacaaagcaataagggttacctctctgtcacatgggcacacatccagtatgggcctaagatcaccacatcacattcaagcctgtgcaatggtttcttgctatgctacctgctgcacgtacacaaagttctcttttgcaacatgtgaacaccagtacctaagtggacctgatgcaatacaccacctgcaaaggtacatcttctacttgttgcattgacaatgtatgcctttggtaggagagctattcatgctatttttttgccttcaaggtgggttcattgtgaaccatggaaccaagatgcacgctacctgcttgtacttgccattttccaaaaagcacatgaagagaagtaccccaaacatacctgtgttattctgaagaagctcattatgcaagtgttgtccaatattagcaatccacatgagaaagaagctatgcagtatcaggtgttcctgctacttcttctgtcatcagaggtctgtttgcaatctttagactatgaaaactgcatcaccgaagctaaagaagctctaaaactcaccccgtcaagccgtgtggatactttttttgcaaatttgcaactgtgtcgggcctatgtggtgcatggggatcttttgaactccaggaatgagtacatgaaatgcttgagaaaccatacaaatactgagattggctgggtaatgctgaagcaacttgaatctgcatgttctttggagggcttttctgacgaaatagatataaaactgcatgaatgtgttaaaaggaatggcagcgactcatcaaaatggacatcccttttcaatctggcgtgtgctcagtgctttctgtggggtggaaactttgaaagcgctgaaaaagctcttgctcaggcatgtagtcaagtagatccggatagctgcatcttgttccttaatggttagctgctttcttctcacaaagctcatattagttgtcaagggttctctaactcctttgctgtttatggtatgaagcaaaaccgtgaacttggttgttctcttccctccattagaatcctggaataaacttggttgctattggatcaacaaactttctgccagtcttattagattttgatatacattccttgtactggtttttgaatgctactaactattcgctatgctaatagtaaattaaggaaagcatgtgcttagatgttactttgttgataatttattttgtggaattaaattgatccaatctttatcgatgctgtgtgaagaactctgcttctaaattctagacctgtgtttatctgcatggtctgggacacagagtatagtatataataagccttaccaat

SEQ ID NO: 58 - DNA, 4320 bp, Zea mays
ctccatttttactttcataaaaactctacatctttgtcattgattttctatgcgttaaaaaaataaacatttctatgatttacagaaaaacataatactcgttaaactatgaaaggatcatgatagatacgtctaattgatgcctgctatatcctaaggttggacagtcttcaccaaaatcattagttgcatgaaatgacctcaaataccggccttcatagctgcaagaaagaacaaaaaaagttcatgaatcaaaaaacaatgcatagacattagaaggtgtttatctaatatgagaaggtaatcattaagtagaatttagtgtgttctcttcgaaaagaatttggcatataatatttatactcacaaagaaaatgtgttttcctcataagaagcaccaaacctgcaaaatagaagtgaagcaaccgtttctttgcttgtccattcttcataaaatgtgattcatcagctacgacaatttggaggaaaatcattaagccacgtcacaatcattatgatggtttttccctaatggaagcaaatacagtcaaactaagccaaaaattgtctgaaaccaatttgaattgttttagtttttcaggaaacagaaggcgaggtagttacataaaggcaaacaattttaggaaatagcatgatatccgagttcacatatttaaaaatgctattagtagctataaatatgtaaagataaacaatttcaggaaataacatgacatcatgttcacacatttaaaaatggttttagaagctataaatatgcaacatattttccctcactctaatgactatgtcatcgttttctaagaaaatatgtaaacctgaaggatatactcatgtttatccaaatcacccataaaacatgaggtaaatgaaaaggtccagtgaatagtgatggaaacaaaataaaattgcatgtcacgaactacttttggataatgaattacacatggtgagtacatcattagagatggaccaatttgagttcgttgttggtgtcacaatacttacaggatggaagttctgcctattataaacgagcctactgctgcatcgccagtatatggttttgataaaaagaacaatgaaacaattctggttaagactcaagagaattcagtgtatggtgaagcttagagcaaggtaggataaaacacaaggaagaggagaggaaaatacatagttgatttgtatgagaagcacatgatatttaagataacagagaagaaatatatagccgacttccccataacaatttaatcttttgcgaaaatggcaggtcataaatgtggaataaatattccctagattaaccgatgctctaccaatctgaagtaccactatctacgcagtgaggaccgagaagcatttgttgctgccaaatttgaaggatgaaaaagcagcacataacgagtggaattataaaggcatatatcacacaaagtggaggataaaggactaatccatcaatgcatcagaacatgcagttagcatctccattactttccttgcacatgcctaaaacagttgagttgtcctaacaaactgtagtgaaatggtctatcaagtatcaagcaatagcaaaaatgtacaagagaatgagcagatactgcctacattccataatgataaaaacattctgaatagggaaaagtcatacatcccagaacaaaaggaagatagaaaagatgttccccagtgacatcgcatagtagcaaatttcatgctggaaatgagagaaaaatataagcaaaccaattcctttattgcaagcgaatgaaaatagatcatccaccaacgccacatgcagatcaacctctgcctcttcaatttctagatatgcacagttttcacagggttagcgaatcacatcaaggctgacccaattacaatataccgagaaacagtacataggcttggtggcggggcgtctggatccgaggcgggaaagctgtcaaagcgcggcgtgaggctagaggtggtggagggggcagatctgagcatttgaggaagacatcgatatggaggcgctggatccatgtcggggaagatgccaaaacggtggtgggcgagcgcctcccgtcggagccaccatggtgtgagggtaagtggtgggcccctttggttgccgctcgtgggaggagggaggggagggaggagacgtcaggatgcatggaaatcactaagaacctacaaatctatgaaattatgctggaaccatacatgaagtcgaataggtcttggggaagaggaagcatctcttctaatggctgcatgccggtgcaggtacgacagagtttgcttgatacctcgttggagaagctcgaaggggagatgtgggccatcgcggcctcactcgacgacgacctttgttgtcttcttccgtcacgacgacaccgctgggcgaggaaagcaaatgaaccagatccatatatcctcttgcgtgtagacgacgagatgaagaccactccgatcgctgggagatatgcgccatcgactttcgcctcgccttcatgagccttttccaaaaagagccacgaatgggaggcgagcagacgtgtatagcgtccccttcatgaaggggagagagacgacgccgaccggacagagggcgaggctacgaaggagagggaaccattgtgtgagtgaagaaattggcactgtagcatctatagtcggggggagggagtcatagggtaggttatagtagatgtgggccccatggatatgctacctggttgggacagatagcggaccgaaccaaacctttggactagggcttgttttacttattgaaagcttagggcttctaatacataaactatatatataatctagtaaaaaaggtaaattttaattttgggacggggagagtatataactgatgcttgaagtataatgattaaataatatattatcgatgctcgaaccaagtatattttataaaatcttgatcgcgttataaattagggagtaaacagggtaaaaaccaggcataaataagttataagcaatatatttatactttaataaacacgcgttgttccaagtggatcgggtaataataaaaaatgtatgcatgggatgcaaaatgattagtgctctcccgtagacccgtataccagattatagatctcaaactaataataatataatcgaccaacctaatctacgacaaagtatactccctaatctacgagaaaccgcgatacttctccattgtggccgtctacttgttctcctgctggtcgccaatgggcaaaatggtggcgcttgtttgtccgcctacttgtgctgctggtcgccggtggacgaagacccttgttcctcttacggagcttgtgcgagaggcatggccagcgtaagtctaaggtcgatctcgctgatggtgtgagccacgggtggtgtaggcgtcgatggcatggccagtgtaagtctaaggtcgatctcgctgacgctatcggcctcgctgacgatgtcagccatgggcggtgcaagcggcgacggcgtggccagcgtaagtctaatgtcgacctcgttgacactagctacgggtggtgtaggcggcgacgacatggctaacataagtctaaggtcaatctcaccgacggtgttagccacgggcgttgtaggcagcgatgacatagccagcgtaagtctaaggtcgacctcgccgttcaccctgacgggtgtaggtggcggacacctctttttgatgttgagcctgatcggcgggctagcgtagtgcttcctattggggcctccatgcaacgatgagctgtcggtgcaatcctgcggtgactcaacggctggtgtcggcgagcagatgacgacgatcccagatgtggagctgccctgatcgctgatggtgcgaccagacccggacgaaggcgtgggcgacgacagtggggtgtcgacctggcccaccgtgtcgttggcgttccctgcgtcgcgctggtcgtcgaggcgtgagtaatccatacgattttttctggctagctgtgtctactgggcgcggcttaaatagggagacgagaggaggttacgtgaggaatccatacgatttttgaacgattttttattcgtacgttgtcaagttctttttagataactccattacaacaacatatctgatctctttcttaaggattagttagatctgatcgtttgaacagcagatttaatctaaaacatatctgttgtagagtggaatagtagatcgtttaagcattagttagatctaatcgtttcctcgtgtgtatgtacacatgctgccgtccgtatacttttttccctcgtgat

SEQ ID NO: 59 - DNA, 4423 bp, Zea mays
tgaatggaaatggaacaatgtcatcgtgtggaaaaaagtgaaaaaaaaactgaataacactgcaggccaatgagtgaggcttgtaagaactgcgtgtggtgaggaattcctcccgcaggccgcggcacacactcagattcaatttagagcatgtggaatcaatcaaacacttactccagtgaggagcgagctgattcagccgttggagaagcacgggtactatttaaaccgctgcggatttattatagaggaaaccgacgttacctccgaagaggcgcccaacaagaacagcgggacgcctttgtcgtcctcggcggcggcgcggagctgtggttggacagttggagcgactcttctgtcggacaagacgatgagcacggcgcaccctactttgaggccacacgtccacaacagccgtccgatcgcacgacgacggcgcaaagttgaaccgagcgaggacgggtctgggctggctctggtttgagccgacgaccggacgacgtgcttcgcagttcgcacgaacaatctggactggagtcgagttctgcgcaagagcgggcccgcccaaaacaataggtggcctcctgctctcccatgcatctccgtcggcccaacaatacagagtggcccaacttctccaatgcgcaactgctgtacgctcgacgtgaaggcgcttctcccaatctcccctccgactcccgttcctgcgccccaaaccctaggtccgttcgcggcggcggtggactgccagtggcagctctccgctcggcttggcttgggcagctgccgcgccgcgcacctacgggcagcggctgggcggcccgcgctcgtggcagcactcgctgagactgagaccgccaccggcggttcctgggctggaagccggtgcagcagcaggcagtagccatctcggccgccagttccaaaccctaaccgagtaaccgcagccgcagccgcagccgcagggtgcaggcacgcaccagcctcacgccagccgcgccgccgctccggccagccgcaccccgtgccggccagctgcgcccacgaaggtgaaaagcagctttacttgccggcttggttttaagtacaattcacatattaggcttgtgtcatcaagaccatgactaggttagcatctctctgtttaacacttcaacatctgatattgcactgtttctgataaagttcaactcgagtatggctgtgtttcatactgttcgatgtgcccttacgctcggtgtttcttttcctgatttcctttctaaaaatagtttaatattttgggttgtaacactggaaatctgctcctttaacatttggaggtggttattccctgtttatcagggttaaaagccaccttttctttatttcttcactggaactctactttctagtaatatgacaaacaaggttaattggtgactaaaagaagtttgactctgaagttcattatgttgttaagtacagctgtggaactctatttgcaatatgtttacaatttattctgatcacgatcacattttaattttcttgattatatgtcagaattgcttaatctgaaatcttcagtccaagggaaagggaaagttccttcaggctattttaatgctctctataattaagtggagcttggttgactgatgccaaagagaccaagcatctagcttcgactgatatttcatttctttgtactacttgcacctaaaggcttctccattagttctttgagatgaagtaaaaaaaaaggctgttccatccaagtgggatcctgttgcattgtcattaggactaaacgtcggccatccttgttcattgattgtggatcagagcagcagtggcatttcaatagtctcgtgagggtaaaaaaacccaggcaaaatgagttaaaaagtttattttttatctttcacggctggttactctgggagagctgggtcgttaaatgggtcaccacctagcgccttttctaaccttgagtaggtttgttgtaagcatgcttatttctacctattaatctaaatgtgcagcaaatttagatttctgacgtcctttcagttgaccttgtttgcagttccattatgacaagttctcctgtcgtatactgttttcctttcgcttttgtatacccacggtattgatattgtttatcagtattttgtgtataggaatctcaacttctttgccgaggtttatcgacagttgtatttgttgggaaaagtagcagtttgactctatataatagagagtgccatggacggacctgagtctagtagaggtcgcagtaagcaggaggttgatgataatgttaatgcaaggaatacttggaaggaggagcaagaaaatcaggagaatgtggatagcagaaattattcggatatatccagaaaacatggatatgaacatgaaactgggcatcaggatgataatagaatgattacaccttcaaatgataggaatgaatcaaggaggaatccagatagaagctcaggcctggctcgaggtgccgacgatgacgtctataatctgagaagggactcacgatctcctaaagttcaaaggagaagccctgatgattccaaggatcgagactatgatagaaggaggggaagaggggacaataatgattgggaaccttcaagaagatttagccctgatgcttctgctaggagttcagagagaagagagggtagtagggagaagcaaggacaacgggatcaagatgaaagggcatcagtcaggagggtagatgaagtttatgttgatgaaactggtggttctcttagagttgacacaagagaagcttatagagatgataaatctgacagagggagggataggaattggaatgagaaaacccgagacattgaaggttctaaggactatgggaggaacactcaattacgagatactaaggagccaaatgattttgaatggaggaatgcacaggaaaggctagatggcgggaatttccatggccgaactggatatcggagagattctaggggtagatctgaaagtattagaggtccctcaaactatgggaaccgatacgacaattcagactcaatagagattcgacctaatagtaatcttaactttggaagagagggctctgtttctggtagaagatttgaaaccggagcacaccgagattcagtacctggaggaactgatgataaatcctctgatcatcttgaaccagatccaagtggtagcacaagcatggtttcttcgtttcctcaacaaggtccaaaaggcgataggtcatctagaggaggaaggggtagaccaaatggaagggattctcaaagaattggagttccaatgccaatcatgcctcctccatttggtcctcttggacttccaccaggaccaatgcagcatatggggccaaatattccccattctcctggtcctcctctcctacctggcgttttcatgccgccatttccagggcctctagtgtggcctggagctcgaggtgttgatgtgaatatgctttctgttcctcccaaccttaccattcctccagttgctccagaacataggtttgcaccaaatgtgggagctgggtctagtcataatatccacttaaatcaaatggacactgggttaggtggtccagcagatatatcaggtttgggttacaataatatgggtcctcaaagccgtgaaatgctccatgataaacctggttggatgccacataggaacagtggaccaaacagaaaagctccttcaaggggcgaacaaaatgattactcacagaactttgtggacactggcatgaggcctcaaaatttcattagagaactggatcttacaagcgtagcagaggactatccaaagttgagagaactcatacagaggaaagatgaaattgttgctaagtcagcttcaccgccaatgtattacaagtgtgacctgcgggaacatgttctttctccagagttttttggtaccaagttcgatgttattcttgtggatcctccatgggaggagtatactcaccgtgcgccaggaatcacagatcacatagaatattggactgctgaggagattatgaatttgaagattgaggttttccccttttctttatcctttctattttgtgatttcatttatgctgcagaattaatatttagaagtgtattttttgaatcaacaggctattgcagatacaccctcctttgtgttcctttgggttggtgatggtgtaggccttgaacagggtcgtcagtgtttaaagaaggtagagcctgctatttccgtacttaaatgactgcgctctatattattattgtaatgccattcgttttgggggatggggtgggatcttgaaatcattttttaggaggtcacccaggttcccgcagcttcaaatcaatttttgccctctgatgttacttctcggacatgaaga

SEQ ID NO: 60 - DNA, 4416 bp, Zea mays
gaataacggagtccccactatcgagtgattacaaagagaataactgaataattcagttatgactgcgaaataactgagtaatgagcagagaataactgagtcatcacaccagaataactatatgcgcccattagaataactgagttccgacaaaagaataattgagtgacgaacatggaataactgagtcggcacatcgcaataactgaggtattataacataataactgagggatcagaaccgaacaactgagtgccgacaccagaataactgagtctgcacacaataataactgagtgggcacattccaataactgaggtatgatgataactgagggatcggaggagaataactgagttagcccacaagaataactaaggtattggaacggaataactgagttctgtcaccataataactgagtgcgtccattagaagaactgagttgttggaacggaataactgagtaatgaacagataataactgagtagtgaacatggaataactgagtgtgcacaacagaataactgagtaatgaacaatagcataactgagttacttgaacgcaataactgactgtgaatagagaataactgagtaataaacaccgcataactgagtgggcacattacaataactgaggtatgatacaggataactgagggattcgagtagaataactgagtaatgtcacccgaataactgagtgcgtcgattagaataactgagtaatgaacgcacaataactgagtaacgaacagagaataactgagggatcagaaccgaacaattgagtgccaacaccagaataactgagtctgtacaccataatcactgagttagcccacaagaataactgaggtattggaacggaattactgagttctggcaccagaataactgagtgcgtccattagaagaactgagttgttggaacggaataactgagtcatgaacatataataactgagtaggcacattacaataactgaggtatgacacgggataactgagggattggagtagaataactgagttctgtcactcgaataactgagtgatgaacatggaataactcaagacgcgcattagaataactgagtaccaacattagaataactgagttaggaacataactgagtgggcacattacaataactgaggtatgatacaggataactgagggattggagtagaataactgagtgcgtcgattagaataactgagtaatgaacgcacaataactgagtaacaaacatagaataactgtgggatcagaaccaaacaactgagtgccgacaccagaataactgagtctacacaccataataactgagttagcccacaagaataactgaggtattggaacagaattactgagttctggcaccagaataactgagtgcgtccattagaagaactgagttgttggaacggaataactgagtcatgaacatataataactgagtaggcacattacaataactgaggtatgacacaggataactgagggattggagtagaataactgagttctgtcactcgaataactgagtgcgtcgtctagaataactgagtaatgaacgcacaatacctgagtaacgtacagagaataactgagtgttgaacatggaataactgagggcgtgcattagaataactgagtaccgacattagaataactgagttaggaacatggaataactgcggtattataacataataactgagggtttagaataactgagttaaaaacatggaataactaaggtattataacgaaataactaagggattggagtagaactgagttggcccacaagaactgaggcatgagcagagaataactgagttccatcactagaataactgagtgatgaacacagaataaccgagtactgaaccgagaataactgagaaatgaacatggaataactaagtgcgcccactagaataactaagtaccgactccagaataactgagacatgaacatggaataactgagtgcgcccactagaataactgagtcatgagcagagaataactgaggtattagaacggaataactaagggatcggagtagaataactgagttggcccataagaataactgaggtattagtccagaataattgagtacgtccattagaataactaagttgttggaatgaaataactgagtggcgaacatggaataactgagttaatagaacgcaataactgactgtgaatagagaataacggagtccccactaccgactgattacaaagagaataactgagtaatgagcagagaataagtgagtaggcacacgagaataactgagtcatcacaccagaataactatgtgcgcccattagaataactgagttctgacaaaagaataactgattgacgaacatggaataactgagtcggcacatctcaataactgaggtattataacataataactgagggatcagaaccgaacaactgagtgccgacaccagaataactgagtctgtacacaataataactgagtgggcacattccaataactgaggtatgatgataactgaggcatcggaggagaataactgagttagcccacaagaataactaaggtattggaacggaattactgagttctgtcaccataataactgagtgcgtgcattagaagaactgagttgttggaacagaataactgagtaatgaacagataataactgagtagtgaacaatagaataactgagtgtgcacaacagaataactgagtaatgaacaatagcataactgagttacttgaacgcaataactgaatgtgaatagagaataactgagtaataaacaccgcataactgagtgggcacattacaataactgaggtatgatacaggataactgagggattggagtagaataactgagggatcagaaccgaacaactgagtgccgacaccagaataactgagtctgcacatcataatcactgagttagcccgcaagaataactgaggtattggaacagaattactaagttctggcaccagaataactgagtgcgtccattagaagaactgagttgttggaacggaataactaagtcatgaacatataataactgagtaggcacattacaataactgaggtatgacacgggataactgagggattggagtagaataactgagttctgtcacttgaataactgagtgatgaacatggaataactgcggtattataacataataactgagggtttagaataactgaggtattataacggaataactgagggattggagtagaataactgagttggcccacaagaactgaggcacgagcagagaatagctgagtttcgtcaccagaatagctgagtgatgaacacagaataaccgagtactgaaccgagaataactgagaaatgaacatggaataactaagtgcgcccactagaataaatgagtgctgactccagaataactgagtcggaacagtagaataactgaggtattagaacggaataactgagtaattagtagaataactgagttattagaacagaataactgagtgtgcacattagaataactgaggtagtagaacgtaataactgagttctgtcaccagaataacttagtactgacaccagaataactgagttattagaatggaataactgagtaatgagtagagaataactgagtgtgcacattagaataactgaggtagtagaacgtaataactgagttctgtcaccagaataactgagtactgacacaagaataactgagtcgccacactagaataactgagttactggaacagaataattgacttgtgaacagagaataaccgagtgggtacgttacaataactgagttattataacggaataattgagggattggagtagaataactgagtcacgagaagaaaataaatgagtcggcccacaagaataactgaggtattagaatggaataactgagttctgacaccagactaactgagtgcgtccattagaacgtagtagcacggaggaagtaaccatcagcatattggtcactagcaccccaagcccttctcagcataaaaagaacaaagtataaataactgacatggctacaaaagagaaataggcagaaaacaaaataagggcttactgctaaggctgcatgaacacgactacaccttcactccaaattcaatagctgcatcataccttccaaagagtccttaagttcttgttccttattttgtaatgcatcaatctccttcgtcagttcatccactctgtctcgcaagtcccccaacaaattcatgatatattgaggaaaaaccggatgatgccattgaaagaaatcgcatctctatgggtcagactaatcacatctctctaggtcccgaccctagttc

SEQ ID NO: 61 - DNA, 4412 bp, Zea mays
gcccccatcatctccccccgtgtcataatttaattccgtggattccgctctaaagacgaccattatagctctgttttcaccccgaaccagcatgggtcgtataattgcaacctggatgacggaatggcgtggccagtttccccctcaatcccctccaattctcgcgggattctggatcaccaaatcagctctaacggtgtaagctgggacgaaccagctgctgctaaatcactggcggagagaaccgtagcatcgcaattatgcccccatcatctccccccgtgtcataatttaatttcgtgcattccgctctaataacggccattatagctctgttttcaccgtgaaccagcatgggtcgtcaaattgcaacctggatgacggaatggcgtggccaatttccccctcgatcccctccaattctcccgggatcccggatcaccaaatcagctccaacggtgtaagctgggacgaaccacctgctgctaatcactggtggagagaaccgtagcatcgcaattatgcccccatcatctccccccccgtgtcataatttaattccgtggattccgctctaaagacggccattatagctctgttttcaccgcgaaccagcatgggtcgtcaaattgcaacctggatgacggaatggcgtggacagtttccccctcaatccccaccaattctcccaggatcccagatcaccaaatcagctctaacggtgtaagctgcgacgaaccagctgctgctaatcactggtggagagaaccgtagcatcgtaattatgcccccatcatctccccccgtgtcataattcaattccgttgattctgctctaatgacggccattatagctctgttttcaccgcgaaccagcatgggtcgtcaaattgcaacctggatggcggaatggcgtggccagtttccccctcaatcccctccaattctcccgagatcccggatcaccaaatcagctctaacagtgtaagctgggacgaaccagctgctgctaatcactggtggagagaaccgtagcatcgcaattatgcccccatcatctccccccgtgtcataatttaattctgtggattccggtctaatgacggccattatagctctattttcatcgcgaaccagcatgggtcgtcaaattgctacctggatgacggaatggcgtggcaagtttccccctcaatcccctccaattctcccgggatcccggatcaccaaatcagctctaacggtgtaagctgagacgaaccaactgctgctaatcactggtggagagaaccgtagcatcgcaattatgccctcatcatctcccctcgtgtcataatttaatttcgtggatttcgctctaatgacggccattatagctctgttttcaccgcgaaccaacatgggtcgtcaaattgcaacctggatgacggaatggcgtcgccaatttgcccctcaatcccctccaattctcccgggatcccggatcaccaaatcagctctaacggtgtaagctgggacgaaccagctgctgctaatcactggtgtagagaaccatagcatcgcaattatgcccacatcatctcccccgtgtcataatttaattccgtggattccgctctaatgacggtcattatagctctgttttcaccatgaaccagcacgggtcgtcaaattgcaaccaagatgacggaatgacgtggccagtttcgccctcaatcccctccaattctcccgggatctcggatcaccaaatcagctctaacggtgtaagctgggacgaaccagctgctgctaatcactggtggaggaaaccgtagcatcgcaattatgcccccatcatctcccctcgtgtcataatttaattccgtggattccgctctaatgacgaccattatagctctgttttcaccgcggaccagcatgggtcgtcaaattgcaacctggatgacggaatggcgtggccagtttcccctcaatcccctccaattctccggggatcccggatcaccaaatcagctctaacggtgtaagctgggatgaaccaggtgctgctaatcactagtggacagaaccgtagcatcgcaattatgccctcatcatctccctctgtgtcatattttaattctgtggattccgctctaatgatggccattatagctctgttttcacagcggaccagcatgggtcgtcaaattgcaacctggatgacggaatggcctgaccagtttccccctcaatctcctccaattctaccgggatcctggatcaccaattcagctctaacggtgtatgctgggacgaaccagctgctgctaatcattggtggagagaaccgtagcatcgcaattatgcacccatcatctcccaccgtgtcataatttaattccgtggattccgctctaatgacggccattatagctctgttttcaccgcggaccagcatgggtcgtcaaattgcaatctggatgacggaatggcctagccagtttcccctcaatcccccccaattctcctgggatcccggatcaccaattcagctctaacggtgtaagctgggacgaaccagctgctgctaatcactggtgaagagaactgtagcatcgcaattataaccccatcatctccccacgtgtcataatttaattccgtggattccgctctaatgacggccattatagctctgttttcaccgcgaaccagcatgggtcgtcaaattgcaacctggatgacggaatggcgtgactagtttccccctcaatcccctccaattttcccgggatcccggatcaccaaatcagctctaacggtgaaagctgggacgaaccagctgctgctaatcactggtggagagaaccgtagcatcgcaattatgcccccatcatctccccccgtgtcataatttaattccgtggattccgctctaatgacgaccattatagctatgttttcaccgcgaaccagcatggttcgtcaaattgcaacgtggatgacggaatggcgtggccagtttccccctcaatcccctctaattctcccgggatcccggatcaccaaatcagctctaacggtgtaagctgggacgaaccaactgctgctaatcactggtggagagaaccgtagcatcgcaattatgcccccatcatctccccccgtgtcataatttaattccgtggattccgctctaaagacgaccattatagctctgttttcaccccgaaccagcatcggtcgtcaaattgcaacctggatgacggaatggcgtggccagtttccccctcaatccgccccaattctctcgggattccggatcaccaaatcagctctaacggtgtaagatgggacgaaccagctgctgctgaatcactggcggagagaactgtagcatcgcaattatgcccccatcatctccccctgtgtcataatttaatttcgtggattccgctctaatgacggccattatagctctattttcaccgcgaaccagcatgagtcatcaaattgcaacctggatgacggaatggcgtggccagtatccccctcaatcccgtccaattctctcaggatccaggatcaccaaatcagctctaacggtgtaagctaggacgaaccagctgatgctaatcactggtggagagaaccgtagcatcgcaattatgcccctatcatctcccccgtgtcataatttaattccatggattccgctctaatgacgaccattatagctctgttttcaccgcgaaccagcatgggtcgtcaaattgcaacttggatgacggaatggcatgaccagtttccccctgaatccccccaattctcctaggatcctggttcaccaaatcagctctaacggtgtaagctgggacgaaccagctgctgctaatcactagtggagagaaccgtagcatcgcaattatgcccccatcatctccccctgtgtcataatttaattccgtggattccgctctaatgacgaccattatagctctgttttcaccgcggaccagcatgggtcgtcaaattgcaacctggatgacggaatggcgtggccagtttccccctcaatcccctccaattctcccgggatcccggatcaccaaatcagctctaacggtgtaagctgggacgaaccaactgctgctaatcactggtggagagaaccgtagcatcgcaattatgcccccatcatctcccctcatgtcataatttaatttcgtggattccgctctaatgacggcattatagctctgttttcaccgtgaaccagcatgggtcgtcaaattgcaacctggatgacggaatggcgtggccaatttccccctcgatcccctccaattctcccgggatcccggatcaccaaatcagctccaacggctgtctcttatacacatctgacgctgccgacgagagtcatc

SEQ ID NO: 62 - DNA, 4412 bp, Zea mays
aaaagagaacaaatttcccagcgcatcctcaagaaatagcatattatctttggcatttatcgccactacatatcatctaacaatttcaacacctttatttgtgctcccacttgcagctcctcaacattatgcaaaagcttctgagctgcttcagtagcccactttacctgtaagttcttcctcttaatggtccaaccgtaacattcttccattgtcttaagctgtttccacacataattctttttcgtttgttatgctgaaatttcattatgcttctctcatcttaggatctagtaagctttctttagtttttaatctcttccctaatctcttctccaattttttgggatccgaattgtcaatactaatatatgaagtaaagtttagtcccaacaattcggatcaccaaaaaagtgaggaagatattaggtaagagataagaaaactaaagtaagcttccaagatcatgagattagaggacagtgaaaaaagaattttgtgtggaaccagcttaaggcaatggaagatgattacactgggaccattaaggggaagaaaatagaggtaaagcaggctactgaagccgctaaaaagtttttgcataatgttgatgagttgcaattgggtgccaaatgaaggatgatgaaattgttagactacaaatagtggcgacaaatgccaaaaagaggatgttgtttcttgaggatgagctgcaaaaattgttgtctttggtcaaggataaagatcttgaaactttataaaaataaaatcaaccagagactaaaatgcaagatttagttgctgtctagattaactaatccaaacgaggcctaactatatgaataggtggttagcaggttactaggttcttattgggtgagaaacttttgatgccggtggattttgctatgtgagtaaaccctgaatcatgtcacatccactcttctcaagactaaacacaagagttaggtgcagattagtttaactgtggcctatataaaataatgtgtactaacttgttctctatagaaaattttttagtgatctcgtggaccaaaagttagacgaaaagttacctacttctccacaagaaagttgcaattaataacatgcatgttggtcaaactgaccactcagacccaattgcagcaagatttggcacacggacgaactgcaaacataaatgaacagtcaggactcacaaaatcaataggcttgtgctattgctctctctctctcactcaccgagaagacatgtacacaactctctatcttgtgagtattaggagcatcgtcttgctagctttctcctaccagagcaccacactttctcatagcactagatggcacatcattgatggatccctacatacaacgctagcacccattaaataaatagaagtagacgacgacatgcctagaaactacacctctcgtctcgtctgggccacatgatgcacgcgtcttaccatgagaagtggtcactactgcaggccaaccgtacatgtctctccaaacataggctgcactagagcgcgttcttcaactagtggacgcaagactcgcactaaatggaggcatggtctgcatgcacaaggcgctagcccgcacgcctcctccattgctccatgatatggggcgcgtcctttggctctgcaatccacctgaaccgctccactttttcatgtactcatcgttaaactccagcaggtttcatataaactcatgcatagtactagtatatggcatggcactccggtcgaaatccaggactgatggtctgatgtgctgcacgcatgttaggtaggcttcacacatcagtcgtgcttgcttgttcgtggagctagcttgctagcctttccctttctggtgttcttgcacctagctacagcagatcacgagagctttcaagcccgttgtatgtgctagaggccagaggctcttcgtagctccatctgaaaaaggctgcagcaggaaatgacttttgatcgagccgctactgctggtgcttcatctcttaggctctctattgatccatatcaatgtttggcactagtacggcgcggtcgtcagcaccacacacaacacagttcgatcctagtgtaatgtaacacccctggtgtttatattctgctcgacaacgagtatgaatttaagcacgtaatatcagtggataaaacggatgccaaattttaattattttcgtttatcgcgattttaatatcgcatctgtttcgtttgtcgcgagtgagatatcgtttttatttttatctatccgggctcttcctaaatttttgtgatgttcggaacatagtcatttcgaaaatcggagcgtcccatggttatttaaaattcatcgctcgcgcgaatacgaattcggaagcccgccccactttgatgattttattccgagcaaattagtttgaactggacaactaaaatgttcggggtaaaataattcgaatcgcgtgaaatcttgcacgaggttatgacccaatttttcctccagcacgttgttttggcgagcgtaagagtaataattgggcctcttttttctagtgtgttgtcttcggcagagtaatcgagtgcttgattagtggatgagattattaggttagacgagttaagccccgactaaatactgacgccaaaatctgtctaattcggtctatttgcatcctgtccgaagcaaaccaaaccactataattagtactgacagcaagtaattggtaaatgatttagtttgctaaaacattagaatgagatatgtagcccgtatcatcgaccctttaatcatcgctaaaaaaattacgtgttcatctcccttcattccttatcttgagtccgtgcttttctccggaaatatcccacagccctctattcctatgatctaattatctttatgtattcatttaagaaaatgggggataatccccttttcttctcaaccccacgtcatcccctcccaaggcttttagccttaccttctgttgatattatcttcagccggtacaagttcacaggtcacgtacatctcctagacgctagaaactttcctacgacatcctcttccttatccgcgtgcatgtttcctgctcatctccctatcatgtccaggctgtaggagcccccagcaagccacgtgctcccctcgcctaggtgcctggccgcgtgcccttcccatcgttctcctagccgccgctgggtatctccctcacacgctgatcttatcctcagctgtactcgacctccctaccgccgttcgtcgagcccctgttccgagctcgccgggcctcaccactacctcgccgtcacgctactggccagcaacactcgatcctggccgccatcgccgcactgcgcgtcgtgcacttgggctggccacctctgcgtgtggcctcgccggacaacaccgtcgtctgcaagctcaaaactgacatcgatccagtcgtcgtagctccgctgtcatggccgatctcggtttcatccgtgacaccgactgtcgacctcgtcgttgcctcacagcactcggacaccgctgtcgtcactcagccccgtgttcactcgtcaccacgccatcttcagcatcacagttctgcaggactccacgcactcgtcgacacccggctgccaatctccaccacgcagcgccactccggaccttcggccgtgttctcctctgctccaactcacgtccatgcccagaacgagctcgcgcacgtcgtcggagtcgctcaactcacccatcgcgcctaggccggtcgccattctgttcttcataagtcgtgctttggacgtcgtcgttgtttcttgttctcgcctcgacagaaccacgtccatgactcagccgttccaataatttcaccgcgccgcccttcaagttcgttgtcctcatccgcagaatcgtcgttgacctcgcggattcgggtcgagtttagttatggtgagttgattcgttattcccgtcaactagatagatggttcgattaaatagatgtatcgattgcgatgattctcttgtctattacttgatgcggaggttaaagttgaattttaggtttatgtgataagtatattggtaaatatatatgtggtgtgatgattgtctacttgatagattaagtatagtgtgatgttttattagtttggatattataaaggttaattcaaaagagtggtttaaatagttagttaagttgcttctgtccatagttctagtttggtgtcccaaaataatgagcctaagtctcgttcactttttggtgtgttctatagctaaggttgatataatacttgtgcttagtttattatcgcttgctgcttgaattggattcggttaagttaaaataacgtggacgttgtacttagtaatatcttgacatctagtttttttttcttttaagtgttatta

SEQ ID NO: 63 - DNA, 4336 bp, Zea mays
gggggggggggggggtttcggcaggtaggtagagatagaggccatgcaaaacacagaaatagagacatccatgacaccatcgcgtggctacatctacaacattgtttacaccaaggcagacattatagccagatgggacgtcattgaccaataggggttgatagccataattcaatatgtgccacctgtcttaggcgaatagggtgaaaagagggcaactttattccaaataaggggtctgactcatggctcacgtagcttgatctggaaaggagtcagtttggcagggaatattcattcagcagatcatcaattaggcagaggagcttttctcagatggaacaatgtgagagactaaacttgtctgtgcagcaaaacagatttattgtatgcccacattcgcaagaaaatttgggtggaataaggttgtcctgcaaagcaagttttttgctaggcaaaacagtaaccagtaagtatcaagcaaaaccattgtagataagaaacttacagaccaaaatatcaaaaatgtcgctacagttttgagtttctagtagcttattctgttacatatttacatgacacaacaaagtcattacacatgctattgctacctcattcttagatgacaagttagtaacaagagatgtttggaactaactaaagatcaagggaagctaacaacaaaacgaagacatgtctaaaacaagaagcctcaaaatttagctctttaatggtcatatcaaatagaaaaacaaaagagaaaggtttaaccagatacatactgagcacattctgccaattttcctaggttctgattttccaaaatagccaaaataagctgcttattctcatccagatactgcagggaaaaaaacaggatcaatcagaaaagttacaaatgtgcaacagatcaaacataaaactgattaacctggaatagaaagccaaatgtgccatataaattaataaacattgatagtaagtcataaaattgcaatatagaagacaaggtagtcctgtgagaatacatggaaaatctagattatcacaagatatttataaatcaattgaatgagcatataaagaacaatacaagcatagctggtctggtgttagatgtaaagtatcaaagatcagttagagtctgtctagaactgtattcttgaactgcgaatgtttcggtccagtgggctacataaacatggggtcattgctatgttgaaacagataaggcccgtatttcactctatgtttttctagaaagaaccaacttggctacaatagtttggaattatgtaagtaaaacaaagataaacattcttcagcgcctatttataagcattatatgcattggcagtctacaactaacaaaattaatattagttactagaaaacttaagtacaaaattcagaaaaaaaaacagacaataagcacgaaatcaatatatgagagaccaaagaacaaattagcaaagctgtcactttttctttttaactgagcaacaagttgaagattaaaaataagaaagataacattacatctccaatgaaaacatattgaggcattcccataactgggtaaaaaaaattactactgctagttccagctataacttggaaggtatgtcaatcataaactcatgtcccgagtgtgtgtttgtaatccataaatatgccgctgattctccatatgagccacggcatcttccatcacaacaacaaaaaaattatgccatcaagagaagggaatgtacacacagagaaggattgcaggttacgaagtgaagagtgtcagcgtgaggtcaacaccacaaagcacatatggaaaacatcagtttccttttgttcgaagcaatgtgacataaggccatgctacaagaaaggactcaagtcccattacccaaaataaatgatacattgaaatgttgtgctcctatacataaatggtcatatccttcgtgtggtaaaatatttggtgcaccgccaccataagaagacaaatatattatcaacgaagcatcaggattcatgtctgatagtttaaaaaaataatccatgtctgagagcaggatcataacatcataccaaatatccaatagatcaacagaactcctacaccagcttcaggtgacgcttgtcaaatctaccaagaaatctagaaagaaacatactaatccactaatccgatacatcagtaatcgatcccagctcatacggatgaatgcattagattggactggcaagatgatccaatctttgaccgaaatggcgcccaagaaaaccccacacgaagcagggatgcgaaccctatcacaactgcgagggggaagtgagggagcaaagaggaaccttttggatctgctccgtgctgattccggcagctggggttatcgccggcgcctgtggctgcatgtgcatcggctgctgcatcccttcttctgctggctttggtatctcggggtcgcaggggcttgggttttggggggttcgagagtttgggggtcggcgcagcgcagggaaggtcaaagtgactgcgtgacatgttggctcaagtgtcggaacatgtaaccgaaaaaaaatgacatatggtaccttgtgaaacgaaaatactccatcagtccaaaacgaaagaaaaaaagttccctccatatttttcaacgagccagatctttactttctctatcctaaatagtgtccttcacattttattaaaaaaactagatgttttaattttaactagatatatatatataactatcaataattttggacacttaggaacagagtgtccaaagaaagcccaataagactcttgaaaacagctcaaatcacttacgagcaaccttgtgaggcggagcggacgactaagtccctaccgatcaaccttgcgaggcgaaacggacgatgaagcccctgtcgagcgaggcgtagcggacgactaagtccctgccgagcagcctcgcgaggcgtaacggacaaccaagtccctaccgagcaaccttgcgagacggagcgggcgaccaaatccctgccgaacaaccttgagaggcggaacgaacgaccaagtccacgacgagcaaccccgccatgaggcgcgagcaaccggatcccgcgccagtctgactagcgtaagagaaaggccagcccaatgatgcgagcccacgtcagcaagaaaagataggtcggcaccaagactacgctcggggcttgggtacggcatcgaaaggtccccgacagacgtcagacggcacctcgccaagtactgtcccacacaaacccccactggcgagtagggccagccaaccccggtcgaagggatcttatcatcagagtctctacattgacccacatgccggaaaagatgtaacgaataccccataccggtgtatgcctacgcatgccagtaggtgacacaggtccgtgacgacgggtgaaagcctcgctacgcatggccgcaccgtagggcaatggaccaccacgcaccactacgaaagatgtcagcagaggactcgctacagggactcgtacgacaaacaagcaagatgatacgctgagcactacgtcaaaccaaggggtggatggccctcatgcctgtagagaacagacctcctctgaaaggtcctacccttgagatataaaaggagagggcaccctcctttccagacacacaagcacacaagttgttacatgctcaaagcaatactacgatcaacactacactggactagggcttcagcctgaaccaatataacccccgtgtctctgatctctcattaaatccgagcgaatcaccattcggagtgagtccgcgctagcatcccccaccaaacacaaatctcattgtcccctagttttcgaaacaatgacagttaacgccaggtaggggagctagtgtactaagtgacgccttccactttgatggcccagtcatcagcatttgctggaggcgagaccttcgctccaggaagccacatcaccttcggcaccctcgacttcttcaccaccaccaccggcgaactcagcctcgtcatccccaacgtggcagcaccatgggcacgcaacccacatgttccaccaggagcaaggcgaaggagcaacgcctgaaaaggcacatcgccgccctaaggcggcgcctcaatagacacaccgagacaaaggtggtggaagccacgtcctcgactacggtggcagtcatcgatcgccagccgatgtccatcctcgacttgctcgaggacgatttgagccacggctcgatcggggctaactctagcgccgaagaagcgtcgaaaagggcctacttcgtgtgatgccccctaaaagggaaatagggtttaac

SEQ ID NO: 64 - DNA, 4244 bp, Zea mays
agaagccgaaacaaacaggcccattatataatagaacacagttgaaactgttttttataaaaaattggagccattttttatgagttgaaacttttatatttccaaacagttgctcgtgggcaggcgtttcctctaggcccatttacgtgcgtctccagagtccggaggtagatagccagccgcctgcgctagggttgggctgttggcctttccctccccactcgtgctcttctgaccctcttcctctctgggtcgcggtctccctcgtcttcatcgctgcctccgtctcgctgctctcctcgctcgaggtcctctccctgacgctattcctcgccgccggttagccgaatgcggcccctcgaactgacgcggttggtttgtttctgcgaaaaaaggtgagaaatcctcttgtgtcgtggccttggttgcatcgctctcgttctagatttggagaaggaaatccggctaacgggattcgagtcaaaaggtgagttgtcatcccgcgccttccccttgtctggaaacggtagtttcgtgtgacgatatggctggccgcgcgcgcttgatggaggttagggtttcgttcgactcgcctgatgcatcgatgatcattcacgaggccatcctccacaccttatttttcggtttggtctatttttttttgcgatttgcagccctattattcttcctgacgtgttgtcggcccttcaatgtgatgtttcatatacaaactcaaggattagattcgaatgtgcacttttttctatggcggctattattaggttggagattctgtagttccttgcatcggagctgaacatttttgtggatgctagatttgcgtttgcttgttttgaaattgtggtctatgtttaactctgattgcttggtagattttttgggcttgcaacattttgcgcctattgttgtttagctgggctttatgaatggttagtggctttgcgtttgttctggttatatttttaattattcatatagatttctagaactaaggtttgttaggggataaaacagtagtaattttgtttgaattttgttgtggaacttgagataattttcaccctaccaaacaggcactatagatggacccttaactggagatgatcagtttaactagagatggaccctaccaaactagccaagttacttaacttgacatgagaagtttaattcgatgtcccaccctgtttggtaggcactataagctcttaaaatatgcataaggtgaataattcgataatcaacttcaccaaacaaccaattaataaaacaagatcatttatataaaaaataatttcacaaaacaacataaaaagttatagtattaacaaactgaatatcaaagtgtgcaaacaaaaaaatgatgcatttgttgcactactgttttgccctgtttcgattttttattcttttaatataattggaagttcttcttctagtcatttcacacaaaaaagaaaaatacatctggcttacctgatttttcgctataagtcatctaagagcaatgcaacatagaatgaaataatcaaaggtgcaatggcggagtagcacaaaacaactgttgcgatgagcatgtaaattggagccctggtgttatattgtagaacccctagagaccatgttgctttcacttcatccttcgtcttgcataaatacttttctttaagatagaaaatgatgggataaaacaatcaagagagctcaaagccaacaaagaatctatcaataacaacaatttaatagttagggtgtgaagttgttatcaaatgcaaaaattttaagaataatatttcgacagtaggtaacgataaagtgagacaacataattacttgaacgcaacaaatctggggaagaatgtttgtacttccagacagatatttgacaatcatattcacaatcttaatataatgattgagaatgtctgttaaagatttaaacaatgtgcttacaactgtcgaaaatagaaaacattaaaaatgatgaaatagaaatatttcacttatgtccttctaactgcttggctctgcgaagggatccactattgttttgagagaaacataaaaagtgtattaggcatgagagtaatataatgagtgcaatttgggggaaggtttgagtgtttgaccctaaaccatcttgatttctcgttgctccaccactactttaagaaagggtaccttctccatattttctaaagttgtaacaacagagatatcagcaagaaaaatcatataaaaacaaaaatgagaaacaatgaaaaagataataacataaaccatagattgtctgatttgcttctcatatagtttccttagattagaaggttgaactatattatttgacgtcgtttagtagcttccataattgtctattcatcagacttgagcatgaagattttgagatttatgacatacatcatatctactactgaagaagacaagaagggtactctactgttcagcctctaatttgggcaacaattccttagtataaccactacaatattcaattgtgtcaacctttttatcaataagcataagtaaattagtcctattaatatgctttgtgcccttgtattactttcaaatttcaagtttacatatatgactttaacgcgacaatgcggacaattttctccctatgacattcgatctcttggtatattttatcagcctacaatgcaatgtaatcagaatagaataaactttctatttcattttctgtagggttatttttggacatgtatccctctctataaataaagtgtagaattacctttgtgtggcatatcacaaccattgatctatagaaagtattttagtgaagcaataaaaatttatagtttcatttgaagacggtacaaggatatctctcaccaacattacaaaattatctagtttaatatctgatgtggattttgcagtagcccttaaatttaaaacatgtttgtaagattttgatattatgaaaataagtgacaaagtaaacccaatagactaacaacagaaatgccacaaccttatacttttttcatgggaatgtttgtacatacataaaaagtttagttgtgttgtgaacaattaaatatacatcatttgtgacattggaccactaatgataagcaaaattagagcatgaaaagtatgtatttattattttaaattgcaagtatgacaaaccgttaaacaaataattaagcacttgtaaaaactattataagattacttatagaaacattacccacccctagtctttttatttacgagaagttttaaattaattaattaagtagatgatagttaagacatcaccagttgcagcaacaatgagatgaatcggaagtagtacaatcctacagtatacaaagatcaacaacattggaatatcaagtacacaattttaaaaaacataataatttgttaatagttgaagaaaatcgttaaaaaaatctaccaaaccccaaccaccaaactaaattttaaatgtatttattttggtttggtgcttggtgtttgatattttttgttgaaagtttttcttcaagtgtcaacaaattatgatttttttaaaaaatttgtcattgatgttcttgtgttgtcgatgtaggtgtactctgggattgttttgcttcggttctcctctatttgctataactagtgttgctctagctattatctctaccaataaatctgcctaattgattcatgacttgtcatcaatataaagactagaagtggtcaatgttcgtataagtgtttaataatatatttaagagtttgtcttaattgcaatgaaaaactctaaacacatgcttttcatactctggttatgcctgtcattaagtgtctattgtaacgaatgttgtatattcagttatttacagcataactaaactctgtacgtctttacaaaccttactagaaaaagtatgaggttgtgatcatttcttttgtcagtctatttgattttctttgtcacctattttgtactatagaaatcctacaaatatgtataagtttgggagctactgcaagatcaacaccagatgttaaaatagatgagtttgtagtgttggtgagagatgtccttagaatgtttccatttgactataaaatattttgaagtctcataatttagcgcttaacccaaatactttctatagatcagtggttgtgacaaaccacacaaagatacttctcttgatatatacagtgagggc

SEQ ID NO: 65 - DNA, 4234 bp, Zea mays
cccacataattagatggtcgcatgccgattaaagttcagtgttttaaagactgagataactttaaaagtatttgaattgctatatgcagatttttcaagataaactattttgcagagttacgacctctattaatggaaaaatagctaatggaagaaaaattatatttccactttcattactcttttctaaatgtcgtcctataagacgtacttgtttaggcatgttacattaaaaacatatatagtgctatttacaatgttcctcatttgtgaacacatcaacccatgtttaaggccgatcaaaacatgagtatgggactaatgggtattatattcttacaagtttactgcatgatatatcgatttcagatgtgtgtcaacttcgatgcattttgaagcgctaaatgttgtattgtttagacagacattttttatggatgggcccaacttgttttttcgcatgcaccatcattagcccatatttaagacaaacgtatcatgagtatgcgaccctagattgtcacatgctagcactagatttggtcatatgaaggatggtgactctaaaagcgcttgaagcacaacatgtagatttttttttcagatcatcaatttactatagtcgtgagctatgcaacatgtttcacatgcttcatcatcaacccaagtgcaagacaacctatagaatgagtttggggcccaagatattggatgtttgaatgctggcactatcgtgtgtagatatgaagaatgaggtaactttagaaatgtttaaagtgcaacatgtatattttttagatcgataattttccggagttgagagccatatttatgcaattctgcttttatttcgatccatgttttaagattccttattattattctattacagttatatcaatgatatttataacaaaagaattaagtatagaaaaaatttcattccaaatttaattacaatttgctctatgctagactataaacaataatagtttaggcatgctatcttaaaccatatgtagcgctatttttaatgattcttggttatggacaacaacgcatattttgaggccactcaaaaaacaagtatgggactcatgatatttatcacaaaactatttaaccaaggaaaattacattacaattttttcatttccaaactataaacattaattgtttgggcatgttatctcataagatatgtggaaagatttcaaatgtttcatggttatggacattaatgtaagtttgaagccgttcaaagccctaaatgatgtaatgtttagaacggtagtttttacaaaaatgtcccaacaagatttgtcatcaaagttttcgcaatgcactgatttgggagtaaagggtcatgattttgtgcttgttttctcaaaaagattttggcatgaaccatgcaaaaactttgaagcttttcgaagccctaaattatgtggtagatttacagaattatccaacatgtttcatacgctcctccatcacctaaaattcaacagaatcaataacttgagtaagggacccacataattagatggtcgcatgccgattaaagttcaatgtttcaaagaatgaggtaactttaaaagtatttgaattgcaatatgcagatttttcaagataaactattttgtagagttacgacctctattaacggaaaaatagttaatggaagaaagattatattttcactttcattactcttttctaaatgtcgtactgtaagacatacttgtttaggcatgttaccttaaaacatatataatgttacttgcaatgttcctcagttgtgaacacatcaaaccaagtttaaggccgatcaaaacataagtatgggactaatgggcattaatttcgtggaagtttactgcatgatatatcgatttctgatgtgcgtcaacttcgatgcattttgatgccctaaatattgaattgtttagacagacagtttttacggatggacccaacttgttgtttcgcatgcaccatcattaacccatgttcaagacaaccataacatgagtatgtgaccctagattgtcgcatgctagcactagatttagtcatatgaatgatacggtgactctagaagagcttgaagcataacttgtagatctttttcagatcatcaatttactataggcgtgagctatccaacatgttgttttacatgcttcatcatcaacctaagtgtaagacaacctatagcatgagtttggggcccaagatattagatgttcgaatgctggcactagagtttgtagatatgaagaatgaggtaactttagaaatgtttatagtgcaacatgtatattttttagattggtaattttccggagttgacagctatattaatgtaattctacttttatttcgatccatgttttaagatactttgttattattctattacagttatatcaatgatatttataacaaaagaattaaacacagaaaaaaatttattccaatttaataacaatttgcattatgccagactctaaacaatactactttaggcatgctatcttaaaccatatgtagtgctattttaaatgattctcggttatagacaataatgcatgttttgaggccactcaaaaaacaagtatgggactcatgatatttatcacaaaacaaattaaccaaggaaaaatacattacaatttgctcattgccaaactgtaaacatcacctgtttggacatgttacctcataaaatatgtggaaagatttaaattgtgtcatggttgtggacattaatgtcagtttgaagcggttcaaagccctaaatgatgtaatgtttagaatggtaatttttacaaaaaggacccaaaaaggtttgtcatcaaagttttcgcaatacactgatttgggagtaaagggtcatgatttcgtgcatgttttctcgaaaagattgtgggatgaaccatgcaaaaactttgaagcttttcgaagcactaaattatttggtagatttatagaatgaaccaacatgttgtttcacacgctccaccataaactaaaatttaacacaatcaataacttgagtatgggacccacataattagatggtcgcatgacaattaaagttcaatgttttaaagaatgaggtaacttcaaaagtattcgaattgcaatatgcagatttttcaagataaactattttgcagaattacgacctcttttaacggaaaaatagttaatggaagaaaaattatattttcactttcattactcttttctaaatgacgtattgtaagacatacttatttatgcatgttaccttaaaacatatatagtgttatttgcaatgttcctcagttgtgaacacatcaactcaagtttaaggccgattaaaacttgagtatgggactaatgtgtattaatttcgtgcaagtttactacatgatatattgatttctaatgtgcatcaacttccatgcattttaaagccctaatattgtattgtttagacagatagtttttatggatggacccaacttgttgttttgcgtgcaccatcattaacccattttcaagacaaccataacatgagtatgcgaccctagattgtcgcatgctagcactagatttaatcatataaaggacgaggggactctagaagcgcttgaagcataaaatatagatatttttcagatcatcaatttactataggcgtgagctatccaacatgttgtttcacctccttcatcatcaacctaagtgcaagacaacttatagcatgagattggggcccaagatattagatgttcgaatgcaggcactagagttggtagatatggagaacgaggtaactttagaaatgtttaaagtgcaacatgtatattttttagatctgtaattttccggagttgagagctatatttatgcaattgtgcttttattttgatccatgttttaaaatactttgttattattatgttacaattgtaccaatgatattagtaacaaaagaattaaatatagaaaaaatttcattccaattttaagtacaatttgctctatgccagactataaacaaaactagtttaggcatgttatgttaaaccatatgtactgctattttaaatgactcttggttatggacaatattgcatgttttgaggccactcaaaaaacaattatcataaaacaatttaacctaggaaaattacattaaaatttgctcattgccaaactgtaaacatcacttgtttgg

SEQ ID NO: 66 - DNA, 4208 bp, Zea mays
cggtgaaggtgtggacgctctccttaccctcttaaggagtagtagagaaaggtctgatgcagaaaattgtggtccgacatgtgtaaattttggtgcgagtcacatcaattagtcattttccaccggcccatatatggttaaaggtgcgacaatatatggttaaactttaaagttgctactctattcatccaaagcagcccaggtagcccattattctatcgcacccacacatttttccaccggcccaccatcaacaccggacatcccaggtcaatcccacattcacctccaaatgatcgcaccttctaaggattttgatccatttgttgataatagttagctagttaatagtttttctagctaatattagctagttttatcttaaataaaaaagtagtttaatacaaccagtaaaatagttttgtcgaagattttccgatattaaatttatgggatagattgtgcgatcgacaactaaaggtacaagcacggatgacatgaagatttatatacgttcaggatctcgagatgagataatactctacgtatgtcttgttcgtgactagtgttgtattctctcgtcatgtgtgatctctcctcttgtcttgaggctagacctgttcaaacgtcgggttgaatcaaggttggatcgtgggtcatttggcacggcccttacccggcctgtgcctagtgtcggggcagggtgtgttggcccgtgcttctctattaggcgtgtcgggtcgggtttttcgagttgggttgggtttttttggctttgggtcgagtttttttgggtcaggtcataaatcatggctcctgcctgacccgtggattgttgtgggtcaaaaatatggacattattcgcttgttgcattgatcgaatcaagtcgggtcgggtttttttggtgagtcgggtcaagttcgtctggtcgggtggcccatgatcaggtctacctgaggctccctagtcccctccccttttatatgcccaagaaggggcaacatttacgagataggtaccaagtcggttacctaatacgagttgttatcgagtaggacccgagtcatatgcaagttgtactctattcttttatatgtatgcctttcttttctattaggatatcggcatgtcgccatatccatttgattcttgaccatatttgtgctgataaaatctttgtcatgtttatccttctagaattctcctgatgataggtatcctcctaatctggatcacataggcattgggctctcgaccaagcccatgagctcatctttacttgtactccatctcaaagctcgacatggtacccatgatgtggcagtagccttgagtcttatttggtcatgttatcgaattgggcaagtaaagctctaatattgaatcttctatagcaacttgttttttattttataagtcgatctttctcgagtcctgtggttgagtccctgactcaaccatcgagtcaatgcactgttcaggactcgtcgcttttcctaaacacatgctcagactatattttgtgcgtcacaacttccacatcccattataaaagaatttccccatgacacttggtcttgtttgagctgtccattcacactcccacttttccatagaacatcacatttgtcacgatatctctcgaagcactttctaacctcatcttctcctctgacgccagattcccaaactacaatcatggttgcctctcattcgcatgaatttgaggtcgccataattaagtccaaggcccttaaatctttggtcatgattgaattacttcaagagaaaatataatccagtggaaaattacaggtaaagaaacctatcccatgactaatgctgacgagatcaccatcttttcttccttcttgatgcaaggatttagtctccctcttctcaattcttctgggatttgctccattattatcaaatcgagcttgttcatctcaaccctattctattctgcacatcaccatcttcgcgcacctttgtgaggcatatttggaaattccttctgtctttcccccttttagtatcttttctttcgctggccttgtcccagcaaagaacatctagctatagttgggattaagcttcgtgctaacaactaatacctcaactgtcctttgaaacctcccataaatactagcacaaacttttgttttatgttgaaaatcacgcccccaaaccacccgagttccttggaaaacaccctattccttgacttgagtagatgagtgacccactatccaagcacatcgatgccatctctgctacgatgagcaaaccaggagttgagagccctcgtcctctcgatggtgcatgtggtagggagctggacctagcgatgagcccccctccatgagaaagcaaactttgcatgtgaatatgatagagagactaatccctatcaatcaagagttcaaaccatcattatgccaaaggcggaggactagcttcaccagggattctcacccatcgaagactgaccaaaaggttgattgacaaaggcatattctatacttaagccatgacccaaggtactttaaggactatgccacttatcatttttttctgatcttgtttaactctgtcataatcattcctcacacttttaaatgctaaaacattatttgcttttacataaatttacttgggcaccaatagatgatgaggaacctgactcgagccacttacccaagtagcttgctgagcgagcccccatgagtcctcatgccgctaagaagtcgagtactcctcgtccatagaagaacgaggaaatagtctgagtcaatgactcagacaatgatgataatgacgattctcttcaaccctggctccaagtccatgatgctccaagaatcctatatttggcatttagatcaggaccctctcggtgacttagaaccggtgacagcgatgacccacataacccttcagccataggtgtcgccgagccagaggtctatgatgaatcgacctctaagaccgagacccaaaggtgctcctctactccaccaaaaaaatttcaaagaaattgcatgactaagattgtgaagcttcccacaaacggctgatgcaagactatttcaacgacccatgtgtctatcccctactctactttcgtcaaaggcaccacatgcgaaggagtctttttttcttcaaattttaaagaggttgggtaagcattccccctattttactatttgggtcatgtcactcaaccgcaatggtttgtcccctcacaaaaaatgcactgcttccctccacatgcttgcctatggtagcattgctgactacattgatgagtatatcaaaatagggaaaagctctcccttaaactaccttgaatatttctataagggtgtcatttcatgttttggtgaggagcatagttgttgtcatactactgatgatcttaggcgtattttagttaaaggagaagagagctaatttcctagtatgatagagagtatatattacttgcaagaaattggaggaactgtcccattgaatgaaaaagggtagtttactacgagaaattggatctccaaccatcatgctcgaatattgactccaacaaacctacaagcgatctgcaatcatcgcgtgaactacacagataggcgaatcattagggaagcgaggccatatcgaccgaactagcaaagtttgcgatcgagaactcaggttgaaaaggaggatctagggcttcagcatgagcttggatgaatctcgattgtatggagccccacggtgcctgcagatgaagctcgcacacaatgacatcgtcggtgaggaggacagaccgtggacgaggctcacgaccccttcgactccatcagatctactctcctcgcctcatccaccgctcgatctcccagcgatgggataaggaccgccaacaacaactcaagggacatatgaagcaatgatgacgacggtcggcttccatcagatgtattgaagcctaccgacgaagctagggctggatctccatcaccatagggagaagttcctgctgccgcaagatgcaacagacgactggcgagggaaaaagacagcttacatcacaaacggggtaagattcatgcgcacgcgggggagggggaagaacaaagggggtgttgttggaccccttcatattgaccagggcacactccgagggagagggggcttcgatgaatagttgaagagcttctta

SEQ ID NO: 67 - DNA, 4201 bp, Zea mays
caaagaggacgtagggtattacacatttgcagctcgaacctctataaatctcatgtgtgtggtatctaggcaacacccaggatcagcaagcatccagcctgctgccctctctctatccttctctctcttggatacctacggtatcgtggtgtcgttacccgacgacaacatcttagttcaatggtccatgtccagttcaaatatacatacagtaaaacaacctcgcatccaaataatgataattaaactaacgcagtctttaaatgtgccttgcatgctcatcttgcaaaatccttgagcatctatatagtaacggaaggggtgcaaatacggaacaagaaatttgtattgtaggcaacttacttgcattttatcttgattttcatccaatgccgcagacagagcctcagcagaagcaacacgaacattgtaatttttatgggaaagtgcattgaaaatatcagagtaatcggtgatgacatcaaaaccaaagcggtcccataactcctctgctaattcagcaaccacctagagaaggtacatgagccaaagaacaagaaaataaatataatttcttgctctagaaagaaaaaagttcaacatatttcactaacataaaaaaaagatcaatagttccaagttcaaagggatgttacaaaccttctcaggatcatgagcagcaatccaaaggctcgttgacacatgcaaatctcgttgcacagagtgcacaggaacacattttatagcagttaagcaggcaagcctaacgtgcacttcttttgcatatacaccaataaaagcctgaagaaagaaagaggtaagaatacatagcactagatgaaataaaatagaacaaaataagctgaagaacagaatacaaaataacaacctgcgctaactcatggcttcttagacctaggcatagctcattcagcataggcccaactgaaggatgataagcaggaacagtgcttagcacatgataaagaacctagccatagaaaaattaagatagtaaattctagaactaggagtctatgagaacaaaacaaggaacatcattaagtctgaaagaactaagaatgtttaactgataacatcctaggacgaggaagtggtagtattggatccatatgcaaagatagtacgtggagcacatcatcatgaagacacgtcttttttgaagatagaaggatcctttccatgatctgaaccaaatggtagcagcataaataaataaataaaaggacaaaaacaggttaaagtaaatgttggaagggaaatatcaaaaggaatagaaagtgaatttatggttggactaaagacagtggacaccataccggaaagacaaaagtaaacgaatctgctggaagaggacctgctttgcacgcaatagtcagaccatttactatttgttcaaagaggccagatgatggcttcttgctatcatcttccatgatcacaggggtaagatccaaaacgatttcaagatcaccaacagatatcacacgaattgcagcagcaatctcgggtgcccaattgcaaagaggaggggctgtgcaacgagctagcctcaacaatgtacaaaatgcagcatcgcttactattgcagaacttagcaaaggttcaacataatttacctgcatagcacaacatcaaattctgagccacaacagatatgataaatataaatgtagaaaatgcatcactactaatagcagtgtctcatgccaaaaaatgataacaagaggatataagaacctaaaaggtttctccaagatatgttccatttcactgataaccaaatacaaatttcactattttttgactggatatatgagggtcaattattacatacttgattatcatgatttggctgttcgtaaaagatactggtgcggaaacaaaataacatattggtgcatttattaagacataaatcataaacatttccaaaaacaaaaaaatgtaaacctcgctgcagacacaaaagaaaaggtcattttttgttcaaattaattcttatcgattattcgatttttttgggtagctttctaggtttaaaaaacgatcttaattaaacaagatatagccaatgtgttcaatatttactcctagatgtgcacattactccctctatctaacacccttcaatgttgtgatgaagttctgccaagcatggtctatgggctggcaacatagtaacagctaacagtaaaaactgaaagaaactacagagggaaggaaaagattgctaaccagagatggcagttgaccatgagtaaatataggattagcaatagccaattcgccaagagcatccaacattaaggagagattcttctgcacttgcccaaccttcatacgtacagatgcttcctccttcaagagcaactctctggcctcctctttagcagtcttagccttgtctataggagctggaaatattagaaaataaattttcaccaagcaacacactatgcacctattgtcagggctaagaggtcgaagtaccagtcttctttgtagatttcccagcttctcgcttgccagtgcctgaagattctctcttctcattctttgcaggaacaacagaccgagctgtctcctacaaattatagcaacaacaaaatttggcatatacaatagattaaagccatattcactggctatcaaataataatactagattgcacatttggtagattttctttctggcaaagacttagaagctacaagttcatcacaaactacaatcaaaatatttaaaaaaaacaacttgcaagaacaaaatattactgcatcttgatcatcatatgcacggaaacgcccctttgcaagtttagagtttttggaagcaacagtctcagcaatgtaaactccttgctcggttgacaactgcccctctggagtatagaatatctacattggaattagaagaatttgtaagaatatatgctaaaaaactctagctaattatgaggctagtgatagaatgcacaaaagtaaaaaatagtagaccttaattgcacacaagctaacaaccttgcataaaaactataaaccttgtctgtatgtcagcatttaagccactccagaaatcatggaatgcaagagctttagtaccaactagtatctcaaaatattctaatgcacaaattatgcagtgagacaattggtatgccatattcgagaaaaaaatggaggattggtatggccattgtctgcatcaaattgtgagagtttgtagaacaaaagaagcaacacaaaccatctgtgagagcagaaccaaaaaaaagaactttcatgtataaacaaaaaaatgaaaaatagcactagaactataccggtaatgtagacatcaaatagagtttgagtttgtgcgaaaaaatagtttgagtaatttggaccattatgacctgaatttatggaatagcctaacgaaaagacttctaagaattttatttatttcattcagccaaatttcaaagaagtcgtcaaagcccaccttaatatcagtctcagaaaaggaatcatgcaaggtgtgctcctggagtcctatgaagtgctggaaaaataaaaatatcaataaaatgtcagggaaagatattagaacttccatttgggataactaagtgataagataaccttctcaaactctagaaatgtttcattaggagtaattgtcataaatgtcgacagcgaacgtaatgctgcactctgtacttgcttgttggaactaaatagaccgtcctgtgaaattaattcctgaacaacaaatatactggttaagtggttattgacttggatggtatgtaacaacaatactaaaaagtggcacaaataaagaatgtgacagaacagaatttccataaaaggcaatgtatagtagcgttcaaaatatattttaaaaatgaaaaggtctaaattactcccgataaatatggccaatgtccagatggccccactaaactagtgtttgcatcaatttactctcccaactatttaagttggtccaataccccttaacaaaatttgtcattttttgtttcttcgcatacaatttgagccttaatttcaaaatttgttagatgatagcaaacattatattttatgttaaaaaatactaacctttcattattaagtttgtataattttgtaaatcagagtgtttatctatcattaaatgtcctggcctatc

SEQ ID NO: 68 - DNA, 4189 bp, Zea mays
agaggccaagtatggacgaagtctctttgagagattgtgtgaaattggttatcacaagcacttactaaatgtgcagtatagaatgcacccttacatcagcaaatttccaaacgaaaatttttatgatggaaaacttatagatggtactaaatacaagagctctatggatatttttctcggtcatatttttggtatgtattcattcattcatgttgaagatggtgtagaagagcaaattggtcagagtttacacaatttggttgaagcttatgtagtatccaacattgtaggcagacttgttgaaggtatagtatgtaaatttatagaattttataaataattagtttagggctgatctatgtatatttcgtcttaaactactgcagcatgcaacacacagaagaagaaaatcagtgttgatgtaatatctttatatgctgcccaagtgactgctttgcaagaaagaattagttggtttcagaacaatgagtttgtttctattaaagtacaaactgttgattcatttcaaggtgatgagaaggatatcataattctttcaacggttagatgtaatagtggtgggaacataggatttctcgattctgatagaagagctaatgtggccttgacaagagcaaggtttgttaacttttgtcctttttgttgcaaatgaaatacttttaaatcctttgataattcaatctcccactatatttttatttaaataaattattttcaccacaggaactgtctttggatccttggacatgaagatactcttagtagaagtaattcaatatggtctaacctagtcatggatgcgaagagacgtttgcgttgctttgatgcccgtgatgaccaatatcttgctaaagaaatcaatagcttcaaaattatgcaaaaagtttcaggtacagataagaaccagctatccagtctatccccatcccgatgcagccccatagatgcacaactcacagttgacagccaagcagagatcacattagaggaagacaaggccacaatggacgtagatgctcaattcacaaatgacagccaagtagaggccgcaatagaggaaggtgctgatgtagaagtagcacaagttgcagaacctgcaccctcacaggcagtagaggctacaatagaagtaccacaagttgtagaacctgcacccttagaggttgccatagaagttccacaagtttcggaacctacaccctcacagacagtagagtttgtgatagaagcaccacaatttgcagaacatgcacccttacagacagtaaaacctacagtagaggaagcacaagttatagatgcacaagtcccagttgatagcccattaaaggctgcaatggagaaagaagacatagatgctcaacacacaaataacagccgagtagaggccgtaatagaggaatgcgctgatgtatcgcccaggcacattcgtttaagaaagaggtcccgttctttgcataaattagaagtaccacaagttgcagaacatgtgaagggcaaagctgttgccaatatgaagggcagagctgctgctgatgtgaagggcagagctgcaatgcagccttcttcctcttctgaagatggtgatgacgacaacgatgatttcacaaggccctcaccaaaatggaagaagggtcagggttccccaattccagaggtatggtcagttattctgttctagtgcctagatatttttttctaattcttgttattttttctgttctagtgtctagatattcttttcttatccttatttattctttccttagtctcggttattttgttttttgttatttgattacggttatgttgtccaattttggttcagttgttattcgtctatcaatatctttttattttttttgtagaagaacaaaggacacttctcaatcatgaggtgctctcccaaggttgtgtatgatttaatcaaccctatgtctgagcattacaagcagaggttgagaagtttgggatttggtgattttttgcggtttggtattagcaggctgttagacagatctttagggatgtttttgatgaagaatgttaagggtgacccactccggatcgaattttctggaaaggttttacctgtcactccacaagtagtgcacctgatctttggccttccgattggtggaaagccaatcccaaagtttggtgaggacgaaaagataaaagcaagaagcgaccttaaaaacaaatgcgacgacaagggaatgcgacgtatgtatgagatggctaggatggataattatgaccgtttacagagatacgttgttcctaggtggattcttgagaattttgcttccaccagtgctgaagaatttgatgattgggctgtccagtgtttcttcatcatcgtttgtagcagctttctttttccaaccagcagctactaccctcttggttcagattacctcatttgcaaggacttgaacgctttaagtgaatttgattggtgtcaagctgtggttaatgacataaaggacaagtctgccatatggaggaagaatcatagaaagaacaagaccccagtcatccaaggctgcactgctctcttgatggtaagaaatgaattttatttactgttcacttctttttcatattttcttaattgttttgtcaatatatattttgattttcacatatattattatgctgttttcagctctactatcttgacaacttagattgcccaggcgttgaacataatactgttacacctcgatggtcacagtactctaatgatcgtattggaaaaataatggatgctgaccgattgacgtcgagagacggcagtgtgtcctatggaaagttgaatgtaagtaataaatttctttcttctgtggttattctgtttttatagtctgttttgttgctaagttattacgtttgttcactcggttattctgtcccttagtatgtttgttcactcagttattatataccatgctcactgtcatcccttatttgggtcatccctcccccttgctcgcgcagccgccaccgatccctcccctcttctccccgcgttaacacgagctatatgctagtggttaaatgtagtgcagtgtccattcagtcattgtgtcccttttggtatgatgagatcgattttttggtttttttaatcttggtcacaaaattgtttccatgttttagttgttgagcagggatcgaactgtttattccaacatacggactgacgatgagccacagactagaggacaaaatgtgcagcagcccgctccttctgatgttgtacgggccaggtcgaaaagtgctggacctgaaagtattcaatttggcctcgttcagttggagccgttgttggcgcagtctattgcttcttatgttgttgatagtacccagaaggatgctgtgaaggatgcactgagagaatatgattgcagcgtggaaagagcgtcttgcgagatttcagagggtcagcgtaggtttgctgatgctgagcgcgctattgagaatgcaaagagacaaatccagagagggcagctggatttgcaaaaggcgcagaagaaaatgttggatgaggtgaatgcaattatgaaatttaatgatgagacacaacctcctgcatcctctccatgcgaagaacatgcaaaacggtgttcttctgtgagtttgctggcctcattcattcccttaattttgttgtcattcatttatttattaatgcctttgtcattgttgcaccagataactgtctctaggctgcatgaaaacaacagaaagcgcaaaaaggtgattattgctgaagggcgagatactgctcaagtggaggatacccgccatacaccttcaccttctcctgctcggtcaccgggctgtgattctgacacagctcatgttgtgcgtgatatagaaactgtcagccattcaatctactttgttatgtcacagccacttaatactctggtgtgctgtcagttattgttgttctgccttttgatatataatttttcagaggcaagattcatctcctccagcacagtcgccggatcgtgatgctaacgccgctcgtggcaggggcgattcatcagaacaacctgtcagtcattctgctttactatgtctgtcatttttatgctagtctttattcttctgccttctgttctatatttttcagatgcatggtgatcaaaat

SEQ ID NO: 69 - DNA, 4152 bp, Zea mays
aatgcagaattatgagtattattgatggcagtttggatgctcacctctacttccttggctgcttctgcaaggtcctcatccatcgatttgctaagagggggcatttcaatctgggtatagcaacacagcatgagcaaggtaaagaacgaagaaaaaaaaaggtgttccagagtatggtcctacaaatttcatgtgactacagtaatgcactagctagcgtgcagtgttttataaattgaaatctacagagtgaaactaaatatatttaactacctctttcagtcgaggtaaggttgtttcgatttttttccctgcaatgttatgaaggtaaccatacagcttcttcattgtctttatgaagttcgatagaacctgttccctttctatcccgagctcttcctgtgattaaataaattagagaacagctgtgagaaatcttgatgagaataccaagtactttggacttgcttgggattaaacttgagctaaccttcacagtgcctatgtctttgtcctgcaggcctagacaaaacaaaacagctgcttgggcaccatgtaatgacactggaagcctctctgaaaaatactgatgtgcaaggatgggtacaagatccaggatctgaaataccaatcgcattcaaattcagagtgatgccttagatgcaaaagacagttatttcacagcacagcagaaaaatatactctgcaaatgcatcaaaactacatacaccttatatattctgaattggataattgggtttcttaccagatgataatcgactaaattgtttgaatacgcctctagtcgtttcatgtcatgtggtgatagcatgtcttccaataattttgaagtgctattattatcgtattctgaaggctcatggtttgagtaatcaatcttcgaagccaagacactagaaaatataaataaaaaagaaaaaaaatcagaatacagaaaaaatactgcactaatgtagttcaaaagtgcatacctcattgcaagcttaaaattaagatgccggaaagaagttcccaaaagccgcctgaatctttgtctgaaatctgaacataggtttcaaatttagctaatgcacccaaaaaaactttacgtaaaaaacgatgcaagaaaaaacaaaacaccatctgtgcatctaagattaggaagtttaaactaaatttgtttactgaaattgtggtaaatacactaagcagtttcagctagaaatgtaaaatagattgaacaaaacacacaaaaaatagtaccttggtaaaacggatccaaaaatccatgtttgtttgactcactaacttcgatgtcatcactgtttaagggtctcaacaccatacaggtatgctcaccagtaacagcactctgaaaaaatgaaatagcaataagcacaacagaaggtgaaacactaagtactgtcaatctgttatggcaagtccggttagatatgattactggaatctggccgacatagaacgggtagaagttgtgcttccgccaaaagcggaaaagctcttgggtcagtccaaaagatacaccaagataatggagcttctcaggacgacgttcatgaagatgaacaaggagtggtggaagatttgccctaggttttatggtctcttctagcagtgaagcctgaaacaacatataccaagttaaaagttgatgtctctttggagacattcgataaaagttgttagactcagtgctagcatatttattatatgttaaatccttcttacgcctttattaaccagcagaataaataatagtaattttatcattagtaatacaatcaaatagaagggtatatgcaatgataaatatccaaaggaaacacatataacaaattcactattcataaatttcatgaggcaacatacaaaaattccaatgtataagagatcattcaacaagtgcgatgtttaactcgaaattgaggatgaaacttgcataaaagtggacaaagtaaaggattgtgactgggtcatagtatggatacaaccaaattattcaaaatagaaaagaatgtattgataactatatgcctgaaccacctagtaaacaatcatatactccatattgtacagtagaaaaaaaattgaaaacatgtcatatttttctaccaaatagtttagctgtaatagtagtgggaataacaatacaattttcagtagttagtgttgtatggtttgcaaaaaataaattagcaacaataacagaagatatgtgaaatatatccaagttcctctgtaagcttagttccagctactttcaatatatgaaatacaagaatgaaaacatttaagcgtatgattgagtacagacagctttggattcaaaccttctctgcagcttcagcaatcttcacatcaggctcttccgtttcctcctcatcgtcatcaaataatcttctcatttgcccttcatagtaccttcaaggaaaaaaaggtagctgtcaaataaatagaaacagctatagctgtattaggtatttcattcagtccttttcagacaatgtgactcataaacgagaacctatgaatatatttcaaagaaatacttatgtacaaaagttgacatgggtgaaaaagtgtaacatgattggaaaacgtaaacgtttaatacagaaaatcaggagggtggatatcaccacaatggttaagactgtaagggctgtgtttgttttagagtaaaaaataaagcaccagtgatcgatatatatcaggtgcaaagtaaagcagtgtaaagaagagtacaatttagaatcagaagcaaagcgccagtaatcattatatatgacttatgacataaggatgcaaactgaagcagtgtaaagaagagtaccgagatagaaggccaatggcagctgagccatacccaagctacacaaggcaaaaaacatagaatgatatacaaaatgatgtcaacttacataaaccaaatcacataaatgtaaaaagaatgtaccctcaaggcgctaggatggacagcaattcgcactatacgagctcctgagagacttggaaatacattgtcttggaactgttcacaaaatttccatggtatttgatcaccggaaggtgaacggccctcactcaggcttttcatagctgactttcgagagatttgtccttccaaacaaacctgaaatacaaattaaaatattacatatataatgtttctgcattacatggcgcatatagtatgaaatacgcttaaaacgaatctaatatcaataaactgaacagtgtagatcatggtggaatatgaaacttgttagtggctttggtgtttgattagaatatcttggattgaagccaacaactaagaatgctagttctcatggtgacacaaaaagaaattaaagtcaattaggtcaatgacatataactatagtaaaaaaaattgctgcacttggtgtctatgttaggagaaatattatgcatatatgtggcaatggttcatgtgacccggggtgctgtacagttgaagaaccccagggcttcttcattggcagtgaaagtgagccttgagctgatgtagaagtgaaccaaaaaggtgagagaagaaccaaatcttgtttatgagtcggtgcaagtgctttgaatattttggctgccgaggcttcttcataggtctacttgaagacatagttgcactattttcttaatcttgttgtgggtactacttgtggagtgattgaccaagaataactttttctaccatgcatgtgcacagtgtcaatgaatcaatgcagagctaatgctctaagacaacaatgagaaaaatcaggagcaaatttcaaaataacatcaaaggaattaattctataaaatgatcagaacctggattacacacaggatatcagggagctggtttttggactcatcaacagggcctatcaaacaaagaaacacaagtaggtagggcacaataacagtatcatatcgaacatatattattgcaagaggatcagtccacataccaagcaatacaaacaaatgatgtgctggtgcatctgccattaattgcatgtcattaggcgaatttttatagtgggaagcaacataaagtgccatcatccgctgaaaaatattaatgagaccactgtccatttaggaagatgaaatacattctccttc

SEQ ID NO: 70 - DNA, 4146 bp, Zea mays
gcctatcctacgtcatgtaagtgagaaaaaaacaaatagaaaggcgaaaggaacagaaaccctcgtgtagcagcctacgagcgcaggctttggcctctgcgtatcttgcgcgggttggccaccgttgggcatggccaacggacagccgccgccacgctgcccaatgtgcggtgcgagccactcgccgcacagccagcctcgcctttgaagctccatgcattgccttgctccatttcttttcattcgaacgaaggagcacctgcagtatgcagcccgaccttcttctacctctagccttccccagtagagctccttggaacatggaattttccacctctactgcaccttccctggctacgcacttggcctcacctccccgccatctccctcaaccagcagccaccatctccctgtatttccaagccgtggagcccaggatgccgaccagggacaccagcaaccggcgtccccagctcgagcaggtgctctccccatggcgacccctctcctccccacatagtcggcgcaggcaccttctcccatggcgctcagccccgcgctccctgcgtgggtctccagccggctccccctgccagctccctgccccacgcgccctcagccatggtgcgggaccttctctggtccgagctcaagcagcgcctggactgcgctcgccgagctcctcctcacgtgctcctccaccggtccgcgcccccgcacttgcagcagcggccatggattccctctgcgtcgcgccttcggcatgctcgacgtaatgccgcagcaagcagcagcagcgacgccctccactgcgtcgctctcgccaggtcgggcctcacgccgtcgatctgcgcagcgcttgcgcgttgtcgtcgagatccttgtgagcccctcgctagtatcccattgttttttagatctcaagtgcttgataaaaatgtttgaaccactaggtgttgttaatcgcagcaagatgttgttgttaatcgcagcaagatgttgccgctgcgcctcgcgcgacacatgattgggtgaagcagctaaaccgtggatgcatgcgcaactccactcgggtttcggccaggttgttcgctttagagaaaattgtgattttgtttatttacgattcagtcgatggcgtgaatatgtgtgtgaaaatatatttgtatgaatgaaagcgtgtagagaagaaaatgaagtaaaaaagaactcggatgtttttatgtttttggtaggaatgtattggatgtgtggtttgctgtgaggattaatcttaaaatgcaggttatgttgtggggaatgcatcaatggtgtttacgacttacgagacaagtgctccatttcttttcattcgaacgaaggagcacctgcagcatgcagcccgaccttcttctacctctagccttcccctgtagagctccttggaacatggaattttccacctctgctgcacctcccctgggctacgcacttggcctcacctccccgccatctccctcaaccagcagccaccatcttcctgtatttccaagccgtggagcccaggatgccgaccagggacaccagcaaccggcgtccccagctcgagcaggtgctctccccatggtgacccctctcctccccacatagtcggcgcaggcaccttctcccatggcgctcagccccgtgctccctgcgtgggtctccagccggctcccccctgcgagctccctgccccacgcgccctcagccatggcgcgggaccttctctggtccgagctcaagcagtgcctggactgcgctcgccgatgtcctcctcacgtgctcctccactggtctgtgcccccgcacttgcagcagcggccatggatcccctctgcgtcgcgccctcggcgtgctcgacgtaatgccgcagcaagcagcagcagcgacgccctccgctgcgtcgctctcgccaggtcggtcctcacgccgtcgatctacgcagcgcttgcgcgttgtcgtcgagatccttggtgagcccctcgctagtatcccattgttttttggatctcaagtgcttgataaaaatgtttgaaccactaggtgttattaatcgcagcaagatgttgccgctgcgcctcgcgcaacacatgattcggtgaagcacctaaaccgtggacgcatgcgtaactccactcgggttttggccaagttgtttgctttagagaaaattgtgattttgttttatttacgattcagtcgatggcgtgaatatgtgtgtgaaaatatatttagggccaattccctgtatgccactggaaaatatactcgttccttgtatgccactggccccacatgtcatagacacaaaaaaatatacctatatgccactcagtggcacacaaggaatgagtataaaatcggatggcataccaggaatttttccatatatttatatgaatgaaagcgtgtagagaagaaaatgaagtagaaaagaactcgtatgtttttatgttttcggtaggaatgtattggatgtgtggtttgatgtgaggattaatcttaaaatgcaggttatgttgtggggaatgcatcgataggtgtttacatgaaaagtgtatttgttttatacatgtgatcggtgattgtggtagtcgatgcgattgaggagtatgttggtcctgttggagtcacttgtgctgttgatgtcatgtgcataatgtggggacacgtatgtgtgtgcgtgccgaagtatcataatagtggttgcgtagagttgtctgaagtatttttcggatgcatgctgaaatgcggttgcattcgaaatagggaaggaggtgtgttgtgtgatgagaaggctagattgattttataggttgtatgaaaaacagtctcttaagtgtatacgtcgagtgtgttaattggatcctacatatgcagagtgtagtgtattggttagacgaagagttttggaatagacgagtatgaggcgtgcagttaagccgagattgaagtgcaaatcctatgcaatatgatgggattcgtgattatataggggttatatttgttgatgtgacgagtagtttagaaaatgctagtttgcgtgggggatgtattgttaaggcatgagtgtcggagttcatatattagtggttacgctacgatgatcgaagtgtctcgagtgcacgccacaacatggttgtatgcgagacagggtaaaataaggtgtgctcgacatgaatgttcggtcgttgtaggtagaaattgtcttggcttaattagagaggtggtgacatgccaaagtagtcatcgcttgctctatgtttataagtcgatacaatgcgtattatgcgttcgtaaaattatgcttcacatatagtgtatgattgtgctcacgatttcgagtagacacttcaagtaaatcaagtaggttcgtgatacaagtagtgtaatggagttagtttgctttagaataattattgaaatgttttgatcatatgataaacatgtacgtgttcatgatttgggaagtaagcgcatggtggttgcgagttggagattagtggtttacgattcgtatgatttggtcggtgtgcaaaaatacttgtgaatatgtgtgtttataaaaatgttttagtgtatgttgtgtctcggattgcgataataataggcaagccgacgtgtatgttatttagcgggctatgtcattactctagttagccgaattgttagatggatgtggttaagctcgtggtcacgatgattttcttgttgtagcctaaatacatatggttatggtcgcggatgaaaagtagtagtgctcatgtggtgtctaagttaaaatgcaaactagtgtgtgaagagcgcatcgatatacatatatacccggtctgagtattgtggtgaatgcatttgttaaacatgtgtggtaattctagtgcacggaatgacatggataaaaatttgtaagtctctttgttagtcctcatttgattaatttaactctaacaaatggtaaagtgttagaataattcaggtctctagaacatggcaatttttgaagtaaataggagctgaaatttattagttgctgtttcgggctgcacccactgttttcgtcgtgctgtatgtttgatgatccatatagaaaagttgtagatccatatagaaaagttgtagatccat

SEQ ID NO: 71 - DNA, 4145 bp, Zea mays
acataccctctattagggttgctcagcaatttacaaaagaagaaagacgtctttggggtctggcgggagcaaggaagcacctagaattaggctaggagcatgttaacttgttcgggtgattagttgatgtttcgttggtcttcggagggtggctcttaggatgtgtttggtttgaggtcaaagtagaatgaggcagagtcatctctgatttggaggcagggtcatccctaacggtcaccatttttttggtagaagggatccctgttttcaagtcgtcgactagtcgtccggtcggtcctaggagctcgacttgggggaccggctcgacttttttggcaagtcgggcgacttgtcaacgactggaatttctcaatcgactagtcgtcgacttggtctagcaagtcgtccgacttgtccccagttcggcccaagcaacagactaaagtaaccattgtacaaaatttcatatcgacttatcggcatatcattgtacaaaatgctaaaaggaaccatatcggcccaaccattgtagctactagtttcattgtacaaaatgctaaaaggaaccatattggcatatcatatatccagatttaagtaatagaactaatataatacttaactttttagaatcatataaactgattacccagggcatactgcctatatgaattcagtattgtaccttctcaagcaatgtagagttcagagtgtttccaactatccacagaacacgtgaaagaatttcatcaggtaaaagagcttcagcccaagaaacagacacactggtacgtaaaacagcagccaaaaacctgtcatagaaaaatactacattgactatggctacagcaactttcagtgaaaatacttgttccatctcacattcacttggcatactacaaaagtacagcaatacaatatcaagcgacaatgaaaagcacaagcacaaggataaaaagggcacaaaagaccaataacattttgcataaattatgaattcactgttttttcctattcttctctttccagattgacatgatcaattagatatatggttgtccagtatagaacataaaacataatccaaattttcttacactaacaaagtaaatatagctacatgtttaccaaaaggacagtcggctcaaacaattttgtatcttcaattcagcaaatgacagttgaatgtaactgtatgtcgccacagagcaaatgccacaaacatgactagttttgagtgaggccatttgcatactgctatgatacaaccaaactggacccctgttttcaagtcgtcgactagtcgtccagtcggtcttgggagcacgacttggggagccggctcgacttttctggcaagtcaggcgacttgtcaacgactggaaattctcagtcgactagttcataaacattgcacaaactgattgtaaaggaaacatgaaacaatgtgaatagtacttatgagtctgaaattctgataacaatggctgcattgagattctagatctctttcacatgatttttccaagaccacagaccttagagcgctaaaataatggtggtgcatcaaataatctagtgatatacagtgagtcaatataggaaaagggaaagaattaacagtgtacaagttttgttatagcaaattagatatcaagaagacaactcatggtaatcataactagataaaatctacatcatagtattgaaaacacaacctgaatacttcagaaaggcaagcagagtcgtctagaaatagctgatccataaccgtagcagtcaaaccattgtgcaggctgataacatttactagagattcatgacaggctaggtttcccaggattccaagacagatttcctgtagggataagatatccgatgtacagctgagataatggttgtcgaaaatgtggagcagtgaggggcaagaattagaaaaaggcaagtgttacttcacctttactctagaggattgagtcacatggagatttgccaaaagcacttcaagcacaagattgttcatctacaagaattaaggatatgcattgtcagcactcagcaacactggatccacttacactacaagcctacatgtgtcctcaataacaaaaataaaagtgaaagaaattttagaaatcattagaattgacttcaatatgccaaccgacatctaataaacttcttctgcagttttaaaaattgaatattattactataaaaatggctagatgtatgcatgagtagaatatttattaaaaccattcaactagattgatgtggaagaataatgtatggtggataactttcaacagtaccagctatctattggacaaggtgcaactcttgttattcaaatgttggtcaataccagcattttctgaaaatataagtattttcattttgtagagtttcaacttttcttttggacaaaatagttccaactttaaagcatattctcctggtatttataatttatatagctcgcaagagcatctgctaaatttgtagaacacatggacttagctcacacccaaggacttcatctacctccactaatgagtattaagaggtaatatgaactcacctcatcattcccttggggcaaagaaaaggagtctgaagtagctacgttacttaaaagggcatttgatttctcaagttttgtgcaacgatctaacaacaatacaacattatatattaaaatcccaaacagccatacgatacttatattgaaatcttagtgcaaggtctttgtttttttctacaccttttcttttgcaaagaaagcatatatgagctagaaagctgggtatagcactatagcatagcaatctacattgtaaaatagagtaagaagatactgataacacaccatcagttctgcttgtggtttactagctgcaaggtcccacagaatgcaaccacactcttcccatggatccttataatcaggttgcgctgattccccattaccagaatttgcatccttctcgtccggggcacattgcttcacactgtttagtatcatggagtcatctcgtttgctaacatacaatttcaacctctaaacacgtcgcttacctgaactctttctccacattggaaccctggggtagtagctgccgtataagggagatagtgtagctgggatcaactgttgtcgtgtcatcaagcagctacagaaaatcacaagcatgagatctagcatcagcagggcagcagacagccagccaaacacttccttccaagacgccaactgctcgaaggaatggcagtgaggcggagactccaaggcgacatcagaagtggtgggactgggatgtgagcagtagacataaggaagagggccacgcacctcggaagatggcgcgaacgggaggtgagtgggagcttcctcgtcgtcgtcggcctcctcgacgccgccatcctcttctctctgactcgcttcttcccgttcctgcggtgactcgggcgcttcgtcctgcgccgcttcgcccccctcgagggcatactctcgcggagcgcctggcgccattgcgacgtgaccggcggagattagcgagtacctgagtattggccggcggaggcgcggagcttgaactacaggacgctttcgagtttcgagggcgctgcagaaggggaaccctgaaggcctgaactgagggcaggtttcgtgcggatgcgcattggggattccggcattccgtgttcaggcagcccatcctactcagactcagagcgagttcctcttgatgggcttacgtgatccagtctagtaaaagaaagaaaaggaaatggcgaatttacggcccgagagcggtccagcccaaacacagttctggacacacgaacatcggaacattcgcaagattggtgacccagtgtcacccgaaaccctgcggcggcgaccggctgtccggtgaccggtggccatggactataccctcgcggcgctgaagatcttcggctcccagctcgccagttgcaccgaggcgccgtgctctgagggttgctctgccgcgcagatgctctccggcatccgcttccagcgcgcctgggtccaggtccccaaattaacctcgtctctctccttcctctcccaccttcattttgtttatcgtagcctgaggatttgcagcggcagt

SEQ ID NO: 72 - DNA, 4107 bp, Zea mays
ttatgataaacaccaaataagtgatgtttacagtttggcaatgagcaaattgtaatgtaattttcctgggttaaattgttctatgataaatatcatgagtcccatacttgccttttgactggcctcaaaacatgcaatattgtccataaccaagaatcatttaaaatagcactacatatggtttaacataacatgcctaaactagttttgtttatagtctcgcatagagaaaattgtacttaaaattggaatgaaattttttctatatctaattcttttgttacaaatatcattggtataactgtaatagaataataacaaagtatattaaaacatggatcaaaataaaaacacaattgcttaaatatagctctcaactccttaaaattacagatctaaaaaatatacatgttgcactttaaacatttctaaagttaccttattcttcatatctacaaactatagtgcctgcattcgaacatctaatatcttgggccccaaactcatgctataggttgtcttgcacttgggttgatgattaagcatgtgaaacaacatgttggatagctcacgcttatagtaaattgatgatctgaaaaaaatctatatgttatgcttcaagcgcttctagagtcccctcgtccttcatatgattaaatctagtgctagcatgcgacaatttagggtcgcatactcatgttatggttgtcttgaaaatgggttaatgatggtgcacgagaaacaacaagttgggttcatccgtataaactatctgtccaaacaatacaatattagggctttaaaatgcatggaagttgacgcacatcagaaattgatatatcatgcagtaaacttgcatgaaattaatacacattagtcccatactcaagttttgatcggccttaaacttgggttgatgtgtttacaactgaggaacattgcaaataacactatatatgttttaaggtaacatgcctaaataagtatgtcttacagtacgacatttagaaaagagtaatgaaagtgaaaatataaattttcttccattaactatttttccgttaatagaggtcgtaattctgcaaaataatttatcttgaaaaatctgcatattgcaattcaaatactttgaaagtaacctcattctttaaaacattgaactttaatcgtcatgcgaccatctaattatgtgggtcccatactcaagttattgattgtgttaaattttagttgatggtggagcgtgtgaaatagcatgttggatcattctataaatctaccacataatttagtgcttcgaaaagcttcaaagtttttgcatggttcatgccataatctttatcgagaaaacatgcacagaatcatgacccgttactcccaaatcagtgtattgcgaaaactttcatgacaaatggtccttttgcaaaaattaccgttctaaacattacatcatttagggctttgaaccgcttcaaacttacattaatattcgtaaccatggaacatttgaaatatttttacatattttatgagatagcaagtccaaacaagtgatgtttatagtttggcaataagcaaattgtaatgtaattttccttggttaagttgttttgtgataaatatctcccatacttgttttttgagtggcctcaaaacatgcattattgtctataaccaagaatcatttaaaataacactacatatggattaagatagcatgcctaaactagtattgtttatggtctggcatatagcaaattctaattaaaattggaataaatttttttctatatttaattgttttgttataaatatcattgatataactgtaatagaataaaagtagaattacataaatatagttgtcaactccggaaaattactgatctaaaaaatatacatgttgcactttaaacatttctatagttacctcattcttcatatctacaaactctagtgccagcattcgaacatctaatatcttgggccccaaactcaagctataggttgtcttgcacttgggttgatgatgacgcatgtaaaacaacatgttggatatctcacgcctatagtagattgatgaaacatgttggatcattctgtaaatctaccacataatttagggcttcgaaaagcttcaaagttttcgcatggttcatgccacaatcttttcgagaaaacatgcacgaaatcatgaccctttactcccaaatcagtgaattacgaaaactttgatgacaaatcttgttgggacatttttgtaaaaactaccgttctaaaattacatcatttagggctttgaacgtcttcaaacttacattaatgtccatagccataaaacatttgaaatcttttcacatatcttatgagataacatgcccaaacaagtgatgtttatagtttggcatcgagcaaattgtaatgtaattttgcttgcttaaattgttttgtgataaatgtcatgagtcccatgttttttgagtggtctcaaaacatgcattgttgtccataaccaagaatcatttaaaataacactacatatggttaatatagcatgcctaaactagtattgtttatagtcttgcataaagcaaattgtaatgaaaattggaatgaatttttttctatatttaattcttttgttataaatatcattggaataactgtaatagaataataacaaagtatcttaaaacatggaccaaaataaaaagcatgattgcataaatatagctctcaactccggaaaattaccgatccaaaaatatacatgttgcactttaaacatttccaaagttacctcattcttcatatctacaagctctagtgccagcattcgaacatctaatatcttgggccccaaactcatgctataggttgtcttgcaaatgggttgatgatgaagcatgtgaaacaacatgttggatagctcacgcaaataataaattgatgatctgaaaataatctacatgttttgcttcaatcgcttctagagtgacctcatctttcatatgaccaaatctagtgctagcatgcgacaatctatggtcgcatactcatgttatggttgtcttgaacatggattaattatggtgcatgcgaaacaacaagttgggtccatccgcaaaaactgtctttctaaacaatacaatatttagggcatcaaaatgcttcgaagttgacgcacatcagaaattgatatatcatgcattaaacttccacaaaattaatacccattagtcccatactcatgttttgatgtgccctaaacttggattgatgtgttcacaactaaggaacattacaaatagcactatatatgttttaaggtaacatgcctaaacaagtatgtattacaatacgacatttagaaaagagtaatgaaagtggaaatatagtttttcttccattaactattttccattaatagaggtcgtaactctgcaaaatagtttatcctgaaaaatttgcatattgcaattcaaatacttttaaaattacatcattctttaagacattgaactttaatcgacatgcgaccatctaattatgtgttgaattttagttcctggtggagcatgtgaaacaacatgttggatcattctataaatctaccacataatttagggcttcgaaaagtttcaaagttttcgcatggttcatgacataatcttttcgagaaaacatgcacgaaatcatgacccttcactcccaaatcagtgtattgcgaaaactttgatgagaaaccttgttgggtcgttttgtaaaaactaccattctaaacattacatcatttagggctttgaacctcttcaaacttacattaatgcccataaccatgaaacattagaaatctttccacatatcttatgagataacatgcccaaacaagtgatgcttacaatttggcaaagagcaaattgtaatataattttccttggttaaattgttttgtaataaatatcatgagtcccatacttgttttttgagtggcctcaaaacatgcactgttgtccataaccaagaaatatataaaatagcactacatattgtttaagatagcatgcctaaactagtattgtttatagtctcacatagagcaaattg

SEQ ID NO: 73 - DNA, 4101 bp, Zea mays
tttttagttcttttatacatgattctaattatgaaatagagaatagttcacatctcatgaatttttttggaattataatttatattgtagattatatatagtttaataataattcttataatttcactccaagaacaatttagtttatctaggtatctttttattttagtcaaaaaaatttatattaattttgggagtagtaactttgaaattatgaatattctcaaggaaaggtgttttgatttaaaaacctctggagaatttttctcattttcacaggattgaactttagggtgttacatatagttgaagatagcatgcataaactattattgtttatagtctgatatagagaaaattgtaattaaaattggaatagaattttttctatatttaattcttttgttataaatatcattgatataactgtaatataataataacaaagaatcttaaaacatggatcgaaataaaagaagaattgcataaatatagctcacaactctggaaaattaccgatctaaaaaatatacatgttgcactttaaacatttctaaagttatctcgttcttcatatctacaaactatgtgccatcattcaaacatcaaataatttgggccccaaactcatgctgtaggttgtcttgcacttgggttgatgatgaagcatgttaaacaacatgttggatagctcacgcttatagtaaattgatgatctaaaaaaaatctatatgttatgcttcaagcgcttctagagtcccctcgtccttcatatgattaaatctagtgctagcatgcgacaatttagggtcgcatactcatgttatggttgtcttgaaaatgggttaatgatggtgcacgagaaaaaacaagttgggtccatccgtataaactttctgtataaacaatacaatattagggctttaaaatgcatggaagttgacgcacatcagaaatcgatatatcatgcagtaaacttgcacgaaattaatacacattagtcccatactcaagttttgatcggccttaaacttgggttgatgtgtttacaactgaggaacattgcaaataacactatatatgttttaaggtaacatgcctaaataagtatgtcttatagtacgacatttagaaaagagtaatgaaagtgaaaatataaattttcttccattaactatttttccgttaatagaggtcgtaattctgcaaaatagtttatcttgaaaaatctgcatattgcaattcaaatacttttaaagtaacctcattctttaaaacattgaactttaatcgtcatgcgaccatctaattatgtgggtcccatacacaagttattgattgtgttaaattttagttgatggtggagcgtgtgaaacaacatgttggatcattctataaatctaccacataatttagtgcttcgaaaagcttcaaagtttttgcatggttcatgccataatctttatcgagaaaacatgcacggaatcatgacccgttactcccaaatcagtgtattgcgaaaactttcatgacaaatggtccatttgtaaaaattaccgttctaaacattacatcatttagggctttgaaccgcttcaaacttacattaatattcataaccatggaacatttgaaatatctttacatattttatgagataacaagtccaaacaagtgatgtttatagtttggcaatgagcaatttgtaatgtaattttccttggttaagttgttttgtgataaatatctcccatacttgttttttgagtggcctcaaaacatgcattattgtctataaccaagaatcatttaaaataacactacatatggattaagatagcatgcctaaactagtattgtttatggtctggcatatagcaaattgtaattaaaattggaataaatttttttctatatttaattcttttgttataaatatcattgatatagttgtaatagattaaaagtagaattacataaatatagttgtcaactccagaaaattactgatctaaaaaatatacatgttgcactttaaacatttctatagttacctcattcttcatatctacaaactctagtgccagcattcgaacatctaatatcatgggccccaaactcaagctataggttgtcttgcacttgggttgatgatgacgcatgtaaaacaacatgttggatagctcacgcctatagtagattgatgaaacatgttggatcattctgtaaatctaccacataatttagggctttgaaaagcttcaaagtttttgcatggttcatgccacaatcttttcgagaaaacatgcacgaaatcatgaccctttactcccaaatcagtgcattgcgaaaactttgatgacaaatcttgttgggacatttttgtaaaaactaccgttctaaacattacatcatttagggctttgaacgtcttcaaacttacattaatgttcgtagccataaaacatttgaaatctttccacatatcttatgagataacatgcccaaacaagtgatgtttatagtttggcatcgagcaaattgtaatgtaattttgcttgcttaaactattttgtgataaatgtcatgagtcccatacttgttttttgagtggtctcaaaacatgcatttttgtccataaccaagaatcatttaaaataacactacatatggtttaatatagcatgcctaaactagtattgtttatagtctcgcataaagcaaattgtaattaaaattggaatgaatttttttctatatttaattcttttgttataaatatcattggaataactgtaatagaataataacaaagtatcttaaaacatggaccaaaataaaagcatgattgcataaatatagctctgaactccggaaaattactgatccaaaaaaatatacatgttgcactttaaacatttccaaagttacctcattcttcatatctacaaactctagtgctagcattcgaacatctaatatcttgggccccaaactcatgctataggttgtcttgcaaatgggttgatgatgaagcatgtgaaacaacatgttggatagctcacacaaataataaattgatgatctgaaaataatctacatgttttgcttcaatcgcttctagagtgatctcatctttcatatgaccaaatctagtgctagcatgcgaaaatctatggtctcatactcatgttatggttgtcttgagcatggattaattatggtgcatgcgaaacaacaagttgggtccatccgcaaaaactgtctttctaaacaatacaatatttagggcatcaaaatgcttcgaagttgacgcacatcagaaattgatatatcatgcattaaacttgcacaaaattaatacccattagtcccatactcatgttttgatgtgccctaaacttggattgatgtgccctatatatgttttaaggtaacatgcctaaacaagtatgtattacaatacgacatttagaaaagagtaatgaaagtggaaatatagtttttcttccattgactattttccattaatagaggtcgtaactctgcaaaatagtttatcttgaaaaatttgcatattgcaattcaaatacttttaaaattacatcattctttaagacactgaactttaatcgacatgcgaccatctaattatgtgggtcccatactcatcttttgattgtcttgaattttagttgctggtggagcatgtgaaacaacatgttggatcattctataaatctaccacataatttagggcttcgaaaagtttcaaagttttcacatggttcatgacataatcttttcgagaaaacatgcacgaaatcatgacccttcactcccaaatcagtgtattgcgaaaactttgatgagaaaccttgttgggtcgttttgtaaaaactaccattccaaacattacatcatttagggctttgaaccgcttcaaacttacattaatgtccataaccatgaaacatttaaaatctttccacgtatcttatgagataacatgcccaaacaagtgatgtttacagtttggcaaagagcaaattgtaatattattttcattggttaaattgttttgtaatattatacttgttc

SEQ ID NO: 74 - DNA, 4098 bp, Zea mays
gaaagtattgtcaaaataattttaaacattgtgaaagtaatttgaattcataaaaacacgtaaagtatagaaattgtgcaaaattacactctgaacaggggcattagcgcattatcccttgctttttttaccaagacttaacaccgttaagtacaactaaacgtgttatggctatacaacattttgttttgaaaaacaggagcaaacacgcaaagtctaaataaacagaacaaatctgcagttacaccttaaacaggtgcgataacgcaattgccctagtaataaaactatgcatatttgccaaaaaaggcagaatagtagaataacaaaacaatgtacacagtaacaagtaacaaaaatttatactaactgttaaaaaggggaaaaatgtaaatttccaacggcaaaaacatctcgcctctggaagctccaactccaggttgcttgaactgtctgtaattcttgtatacctgtcctgtatacaaacttgtatactgccgtcccgggaagggagtaaagaaaggaggggaaaactaacatcagggactgaccgttacatcgacgatgacctataactataagttatactgtgggaccgactcttcttttttgctctaccaccgcagccgcactctgcatcctccggtgaaggggccgcaaggatgggggatcttattatacacgaaacaaatcaataaataatggaatggcgcgggggaattacaggatgaacaagaacaatgtggtgttggtgatggactgatggtgcttggtggactggtaaggaggaggtgatggtgacagtgtgcgtgatgcttcgcttttttttttttgggttcgaacgcgtatacgtacggtttgagaagtgtgccgcccgcgcgcctattgaaccatggcaaggaaggcgctggtcggagccgaagtcggcaccgctggtgcaggcgtcgtcgctggcggtgctggtgcggtgttggttgtggtgccgcctgggttcggcctctggaactgtatcctgtactgcattttgccgtcgtcctcgccttcctccccgtcgtcggtgtactcgtcgctgtccgtttcgtcctccgtggtgaactcccgaggcgggtgctcgcttaacatcctggtgatgtcttctggcttcacagcaagcacatatccggtcagcctgcgcgcgtcggtctatccagcacgaaacgaaacgacaaaaggggacgaatgaagaaacaggttggcgcgcacggtgtcgttaccttcttcatgccggtgtcggtgccgaaagcggcgagcgtcgtcgtcggcgctgtctcgccattgctggtcggcggcacctgcgtgcctccacctgatcccccgttgttcctcttgtcgtcgttgatgttcttcccttctatctcgtgccggctcgagttcagctgatctaggtaggcgggagcaggaggagcggcagcggcggcgccgccgctgcggaggtgcttcctgccgatgtagatggcctcgagctggtggaagtacgggcaggtcttggagtcctcgggccgcttcttgttgctctccttcaccttcttgtagtacttgttgatgttctcccacttctccttgcaccgcttcgagctccggttgtaccccagccgccgcatcccggacgaaatgtcctcccagagcggacccttggcacccgtctccaggtagcgcatgtccaggtccatgcgaagctggatgagcgcgtccacctccgtcttgggccaccgcgatgacgacgccgcccttcctagccccgactcgacgtgatggtcggcgacgggcaccagctcgagtgacgggccagaggtcgcgggcgcgctgcgcggcgtgccggcgtcctgctgcgacgcatccttgggctgctgttgtgtcgggtgctgctggagcggcgcggctgagattggcttcggctgcggtgtcgcctgtggcgacggcggttgctgctgacgagaaggttgttttggcggcggcgtggtatgggcagcaggcaccggcgctggcattgggacgacaacggcggtagggggctgcacggactgcccgccgatgcgctggaggaaggcgatgatggcggcgtccctggaggccgcggcggcgcgctcctgagcgagctgctcctgctcgtggttgaggcgggcaacctcctgcctgcgacacgcctcctcccgcgccgtgcgctccgtctccactctccagcgtctccatggtctccaggaaccgccgctgcatttcctcctgcctgtcgacgacctgctgcatgagcccctcgaagaaagacatcgtcttcttgctgccgctgccgccgtcgccgccgcgcttccgcttgccgaggcggtcatggcttccgcctgtctccgccgtcatgtcatctccctcggactccgattccgacatggaagagaagctgaagccttgcagcaggttgaggggctggtgggccccgggcagctccacgagtgtctggacctgccccgccggtgccgccgacgatatgggcgctggctgcatcggccccgtcggcggtggcattgaacttatcggcggcggcgcggatactggcgcggcgaaggcgtgcaacggtggagcggtggtgctcgctggcggcaactgctgctgctgcttctgtagcggcggctgtggctgcggcgcggctgcgtgcaaggcctccagctcgtcgaagaagcggtagctcttgccgtcctgcctgccggtgcggccttcctttgtgcgcttgtagtacttgtgcacgttctcgaacttctccttgcacttcttggcgcttctcttgtagcccaggtcggcgagcttcctgaaagccacagcagtgacaaaaaaagaattgagtgatcggcgaggaagaagaatttaagtactgacggcagcgtttacaggaggaagagtggcattacacatatggaggaaagagacaagaggatggaaagaattggaaatttgtaaaaggacaggcaagactgatgaggagcgaaagcgggccgaaggaggtagaggagggacagtcagtatgctgcagaatggaattctatatagctctcatcacagaccatagcgtctttttagggatcagaggggatgtgaagttgatgatcgatgcactagtgaatgaatactggagtgatgagggggaaaaactggagcgaaggagagagagagaaaaaagaggtcgcattgggatgggagagaaaggctggcctccttgtttacccaaaatctggagccatgaaagcagaaaacagtggcagactgcatgcagcggcggcagcagctagccagctactagctgcttgtctgcctgtactcgcacaccgtggtacgatacgatccccaggcgtccaaattcttcacccctactgctggctggcttggctgctgccatccaattctctctcttcactctgcctccccctccctcctcttccctctcgctgaaatcgaggagcatttgattagtactagatcgggacggaaacgggaaaacaaagcaagattcgaggggaattgggcgcgcagcgacgcatgattaattatccatcatttcatgtgggggcgtctgctgaattccacgaaaccgttagcgctttcccgcaggggaaaaaatcatgccggaggcaggcttgttgagcgtgagccggactgcaaatgcgtttggattccgtctctctctctctctctcccgggtctctcactcactccttttacctggagacgtcctcccacaggtggcccttgagcgtcgcgtcgcggaaggtggcgtccatctccgaccggatcctgatgagcgcctgtgtctccgcccgcggccaccggttgctggacgcgcccgacgacccgccaccaccgcccaccgtctcgtcgtcgaagccgccgccgggccccgaccccgacaccacggccagttcttggtagctggtgctggtggtccccggttgctgcggctgctgcggcggcggctgaggctgcgccgacggaggcctgctgctcagcggcatgggaccggtggcggccgtcggcggcgagaaggggcccatgtccggcggcggagccccgagctgtgtc

SEQ ID NO: 75 - DNA, 4097 bp, Zea mays
caacgataaatgcagttacctttctgacattagcttacacagctttctgcctttcttaaaaatgggaaaatgataaacatgccagtcaattgtactcgatcgtgcacctatatttgttacattgacagaaacatgtttatcattgcattgtcaaaacagcattattttcctttcatatttacaagttgcagtcctcagtacactgcattatttttgttataaaagctattatgtagaaccaacatgctaacaattatttgagaaacaagctttttacatattacctctgtttcatatctcctgaatccttattgtttctttatgtgaatttttgtatctttaatcggtatagttttttacacgacgaaatatgatttacttcacggaaaacatctgaatttcagttcgtggcataccacaattaaataatgttaacaataaaatttagcaaataaatttctaacaaaaatttaagcaaatggtatacaattgtttattttagtgttttccaataagtcatgtactaaagtttgacatacaaaccttgatgtttagaaggacaaatatctagaataaataagaacaatatttagaataaataatgaatgtgcaattaggattacaattttctttttggagtataggctcttcttagttcattttactattgtcatgactcaacatgtggtcttatcaaggagactggagccttgattgtatggcaagcaccacctattatagagaagatggctgctcacaatcagttagacttcaagcaggacccatacaattttttgctctctgttacattatgtctagcctccagggtgatttatttcttaccttttttcgatgcatcaccattcttggtccttgttagtttagttaaaattgtttggatcatctgacattccattttaccagtctgtcatgatggaaaagagtatacatgagaccagattaacaagtggtcagagctgtgatagagatactttgacaattgtaggcagcatcaatagtgtcattgaggtatctgtaacctgtttgtagcttctttgtccattagtaatatataaattttatttctaaggttcatatgacttgccattttaccggtctgtcatgatggaaaagagtatacttgagaccagattaactagtggtcagagatgtgagagagatactctaacaattgtaggcagcatcaatagtgtcattgaggtatctgtaacctgtttgtagcttctttgtccattagtaatatataaattttatttctaaggttcatatgacttgttgaacatcttgaaaccacatactgatgtagtgtcaataaatttttcactttacatttcattgatccctgcaaacaaaaatgacatgcctcttggtgtgggatactaatcagtaaaacacctaaccaacatgcagcagctgttccagctaaggcgttccaagtacgtgggccctatgtaagagatgctcgccgagttatgcagcctgaaaggggactcgcacggcacgaacaagggagctccaagagtagcagcaggccgtaacagtaggtggggcgacgtggaaacgctggtcttcatctggcctctgggggcacctgtccttgagctccatgaattttctggaactcgagaagaggaagaccatgatcttgtccatggttgaagaggtaggctagctgtgcattagtttttggcagagtaggagtctttgtgcttagagtgagcacactgtcacttctgataacattgtaatcctgtttttctacggtctccgattcgttctcccaatttagcgatttgctttttataatttggtgtgaatggttttggcaggtttggcacatgacgtccctgtaccatctcatccacaccgcggcgctgctcggggcgcccatcaccaagcgccccaacgctgtgagtaccagtgctgctggcttcaatattttcgcttcaataagcaaagtctatactactattaagaagctaaagaaggcgtccacagtcttggacgcccccgcctccacgcctgcccccgcctgccatcgccgcaacgcacgctgatggtgctttcctcctctctatctaccctcctctctttcgcctggacggtgcccgcatctacacagagaacaccatctgcaagcacaccgagcacatgacctacctctgcctcgcctcgacacacaagccaagatggtgccatggccgcgctagatcatcatccctgcagcagcgatagaagcacatacgaggtgcagacctacaacgtttcttcatttcttcgattcttatcctgcgttgtcgccgattcaaacagatttagatctgctaatcaattgaatagtccatacggcatttggacgaaaccgatgtgtgacaaagttttcttttgtccttatccgtacacttgaaatttgatggacggcatgaccacaactctcttctcctcgccagcatttgtccttctttgctcgttggactccaacagttcaacttggattcgtctaaattttgtggctaaatgcatcaggttttttgtttgctatactgacggttgaccgtataccttttttgcaggatttatgggtgattcgttgaagagcaacatgtttgcctcattagtatgtatgatcacgaagctcaggaatcttggtctaaaggtaagcagctaaattgttgtttccttacagtgagtagcctaaaatatatttttaaatatttgaatatggaccctgatttttaaaaccctgaaactgtattttgtttatttgcatcaatttggcattatccgtacgatagcttataatatacagttcaacagctcttattgtttctgtgtgatatattattaccctcttattgtttctgttgtgctgccctcttataacgattttatttctggaacttgtattaagagacaactctattagctcgctcatcaacatgtatacaatcttgtttgataaattgctcacgttttacttgatgcatcactccattctcagttatcacctgtacaaattaaagtttttagtgaaattatttgcagattactcaactgtacatatcgtggatttaaaaaaactgataccactaaacatgattttgggagtattagtaaagggtttaataattgattcactgccatatcaccacattttgtccttgaaaagtattgtattctggaaaatcgggtgatatgatccaaaatattgatgaattgcaagtactttttagggatccctactttttaagcaaaaaatctattttttttccagtcaccatgtaaatctatttcatggtttgtaatgcccatggtctattttttgtgacagtttcgaaaacttattattctttgcttgtcctatattcaaacaaaattgatcgcaccacctttttgtgaaacttattgttctaagcttgtcctacatcctacatcagcttgtttgtcttagcaggctgcctttgtgataatttataacccagtgatatttttatccaattacatgatatattgcctaaaagaaaataaatgttcgtagccatttgtgacattaactggtagtcatcatctaatatattagaggttggtcttcttctttgcagcgctacgtggtgcggtgactctcaggaccaaggcactgaaggaggtgcgtaacatcgcagctatgatctcattggagaaggttgcgatggtcagaggcagtgggcatcaccagcacagtgaccacaggcatgaactgatgccgaaaactctctacttcaccatgtacaccatcgattagtaccactctctttaatcaatcatgtgaagggagctgctgctggttggcgtttcagctattctgatcgccttcaggtacgaggagatttagaccctataggtgcacagaaaacttccatatctctatgtcctatgtttccggtgctatttttaaagtttgtcactgtcaatgaagcctctttggatacgaggactaattttccttcaatcaacccgcgattaccaccttcacggctcacaagcccaagatgtcctcctaacgcgtcgtcccatgtgtgcttggaggaattttgcca

SEQ ID NO: 76 - DNA, 4077 bp, Zea mays
atatggtttaagatagcatgcctaaactattgttgtttacagtctagcatagagcaaattgtaattaaatggaatgaaaatttttctatatttaattcttttcttataaatatcactgatataactgtaatagaataataacaaagaatcttaaaacatggatcgaaataaaagcagagttgcataaatatagctctcaactccggaaaattaccgatctaaaaaatatacatgttgcactttaaacatttctaaagttacctcattcttcatatctacaaactctagtgccagcattggaacatccaatatcttgggccccaaactcatgctataggttgtcttgcacttgggttgatgatgaagcaattgaaacaacatgttgcatagctcacgcctatattaaattgaagatatgaaaaaatctacatgttgtgcttcaatcgcttttagagtcacatcatccttcatatgaccaaatctagtgctaacatgcgacaatctatggttgcatactcatgttatggttgtcttgaatatgggttaatgatggtttatgcgaaacaacacgttgggtccatccgtaaaaactgtctgtctaaacaatacaacatttagggcttcaaaatgcatcgaagttggcgcacatcagaaatcgatatatcatgcaacaaacttgtacgaatataatacccattagacccatactcatgttttgatcggtcttaaacttgggttgaagtgttcacaactaaggaacgttgcaaatagcacaatatatgttacaaggtaacatgcctaaacaagtatgtcttttagaaaagagtaatgaaagtggaaatataaatttttccattaatagatgtcgtaactttgcaaaatagtttatcttgaaaaatctgcatattgcaattcaaatacttttaaagttacctcattctttaaaacattgaactttaatcgacatgcgaccatctaattatgtgggtcccatactcaagttattgattgtgttgaattttagttgatggtggagcgtgtgaaacatgttagatcattctgtaaatctaccacataatttagggctttgaaaagcttcaaagttttcgcatggttcatgccacaattttttcgagaaaacatgcacaaaatcatgaccctttactcacaaatcagtgtattgcgaaaacttttatgacaaaccttgttgggtcctttttgtgaaaactaccgttctaaacattacatcatttagggctttgaaccgcttcaaacttacattaatgtccataaccatgaaacatttaaaaaatttccacatatctcatgagataacatgcccaaacaagtgatgtttacagtttgtcaataagcaaattgtaatgtaattttccttggttaaattgttttgtgataaatgtcatgagtcacataattgttttttgagtggcctcaaaacatgcattgttgtccataaccaagaatcatttaaaatagcactacatatggtttaagatagcatgcctagactattgttgtttatagtctagcatagagcaaattgtaattaaaattggaatgaaatttttctatattaattctttcgttataaatatcattgatataactgtaatagaataataacaaagaatcgtaaaacatggatcaaaataaaagcttaattgcataaatatagctctcaactccggaaaattaccgatctaaaaaatatacatgttgcactttaaacatttctaaagttacctcattcttcatatctacaaactatagtggcagcattcgaacatccaatatcttgggccccaaactcatgctataggttgtcttgcacttaggttgatgatgaagcatgtgaaacaacatgttgcatagctcatgcctgtagtaaattgatgatttgaaaaaaaaatctacatgttacggttagcatgcgacaatctactgctcaagcgcttttagagtcacctcatcctttatatgaccaaatctactgctagcatgcgacaatctagggtcgcatactcatgttacggttgtcttgaacatgggttaatgatggtgcatgcgaaacaacacgttgggtcaatctgtaaaaactgtctgtctaaacaatacaacatttagggcttcaaaatgcttcgaagttgacacacatcagaaatcgatatatcatgcagcaaacttgtacgaatataatacccatttgtcccatacacatgttttgatcggccttaaacttgggttgatgtgttcacaactgaggaacattgcaaatagcactatatatgtttttaaggtaacatgcttaaacaagtatgtcttatagtacgacatttagaaaagagtaatgaaagtataaatataaattttcttccattaactatttttccattaatagacaccgtaactctacaaaatagtttatcttgaaaaatctgcatattgcaattcaaatacttctaaagttacctcatcctttaaaacactaaaccttaatcggcatgcgaccatctaattatgtgggtcccatactgaagttattgagtgtgttgaattttagttgttggtggagcgtgtaagacaacatgttggatcattctgtaaatctaccaaataatttagggcttcaaaaagctacaaagttttcgtacggttcatgccacaatcttttcgaaaaaacatgcacaaaatcatgacactttactcccaatcagtgtattgcgaaaacattgatgacaaatcttgttgggtcatttttgtaaatactaccgttccaaacattacgtcattaagggctttgaactgctacgaacttacattaatgtccataacaatgaaacatttaaatctttccacatatcttatgagataacatgcctaaacaagttatgtttacagtttggcaataaaaaattgtaatgtaattttccttggttaaattgtattttgataaatatcatgagtcccatatttgttttttgagtggcctcaaaacatgcactattgttcataaccaagaatcattcaaaatagcactacaaatggtttaaaacagcatgcctaaactaatgttatttatagtctggcataaagcaaattgtaattaaaattggaatgaaatttttttctatatttaattcttttgttataaatatcattgatataattgtaatagaataataacaaagtatcttaaaacatggatcgaaataaaagaaaaattgcataaatatagctctcaactctggaaaattaccgatcttaaaaatatacatgttgcactttaaacatttctgaagttacctcattcttcatatcaaacaaactctagtgccagcattcgaacatccaatatcttgggcccaaactcatgctataggttgtcttgcacttgggttgatgatgaagcatgtgaaacaacatgttggatagctcacgtctatagtaaagtgatgatctgaataaaatctacatgttatgcttcaagcgcttctagagttacctcatccttcatatgaccaaatctagtgcaagcatgctgcaatctagggtcgcatactcatgttatggttgtcttgaacattggttaatgatggtgcatgcgaaacaatacaataagttgggtccatccataaaaactatctatctaaacaatacaacatttagggcttcaaaatacatcgaagttgacgcacaccagaaatcaatatatcatgtagtcaacttatatgaaattaataatcattagtctcatactcatgttttgattgttcttaaacttgggttgatgtgttcacaactgaggaacattgccaataacactatatatgtttttaaggtaacatgcctaaagaagtatgtcttacagtacgacatttagaaaagagtaatgaaagtgcaaatataaattttcttccattaactatttttccattaatagaggtcgtaactctgcaaaatagtttatcttgaaaaatctgcatattgcaattcaaatacttttaaagttacctcattctttaaaacattgaactttaatcggcatgcgaccatcta

SEQ ID NO: 77 - DNA, 3935 bp, Zea mays
tccatgcattgccttgctccatttcttttcattcgaacgaaggagcacctgcagtatgcagcccgaccttcttctacctctagccttccccagtagagctccttggaacatggaattttccacctctactgcaccttccctggctacgcacttggcctcacctccccgccatctccctcaaccagcagccaccatctccctgtatttccaagccgtggagcccaggatgccgaccagggacaccagcaaccggcgtccccagctcgagcaggtgctctccccatggcgacccctctcctccccacatagtcggcgcaggcaccttctcccatggcgctcagccccgcgctccctgcgtgggtctccagccggctccccctgccagctccctgccccacgcgccctcagccatggtgcgggaccttctctggtccgagctcaagcagcgcctggactgcgctcgccgagctcctcctcacgtgctcctccaccggtccgcgcccccgcacttgcagcagcggccatggattccctctgcgtcgcgccttcggcatgctcgacgtaatgccgcagcaagcagcagcagcgacgccctccactgcgtcgctctcgccaggtcgggcctcacgccgtcgatctgcgcagcgcttgcgcgttgtcgtcgagatccttgtgagcccctcgctagtatcccattgttttttagatctcaagtgcttgataaaaatgtttgaaccactaggtgttgttaatcgcagcaagatgttgttgttaatcgcagcaagatgttgccgctgcgcctcgcgcgacacatgattgggtgaagcagctaaaccgtggatgcatgcgcaactccactcgggtttcggccaggttgttcgctttagagaaaattgtgattttgtttatttacgattcagtcgatggcgtgaatatgtgtgtgaaaatatatttgtatgaatgaaagcgtgtagagaagaaaatgaagtaaaaaagaactcggatgtttttatgtttttggtaggaatgtattggatgtgtggtttgctgtgaggattaatcttaaaatgcaggttatgttgtggggaatgcatcaatggtgtttacgacttacgagacaagtgctccatttcttttcattcgaacgaaggagcacctgcagcatgcagcccgaccttcttctacctctagccttcccctgtagagctccttggaacatggaattttccacctctgctgcacctcccctgggctacgcacttggcctcacctccccgccatctccctcaaccagcagccaccatcttcctgtatttccaagccgtggagcccaggatgccgaccagggacaccagcaaccggcgtccccagctcgagcaggtgctctccccatggtgacccctctcctccccacatagtcggcgcaggcaccttctcccatggcgctcagccccgtgctccctgcgtgggtctccagccggctcccccctgcgagctccctgccccacgcgccctcagccatggcgcgggaccttctctggtccgagctcaagcagtgcctggactgcgctcgccgatgtcctcctcacgtgctcctccactggtctgtgcccccgcacttgcagcagcggccatggatcccctctgcgtcgcgccctcggcgtgctcgacgtaatgccgcagcaagcagcagcagcgacgccctccgctgcgtcgctctcgccaggtcggtcctcacgccgtcgatctacgcagcgcttgcgcgttgtcgtcgagatccttggtgagcccctcgctagtatcccattgttttttggatctcaagtgcttgataaaaatgtttgaaccactaggtgttattaatcgcagcaagatgttgccgctgcgcctcgcgcaacacatgattcggtgaagcacctaaaccgtggacgcatgcgtaactccactcgggttttggccaagttgtttgctttagagaaaattgtgattttgttttatttacgattcagtcgatggcgtgaatatgtgtgtgaaaatatatttagggccaattccctgtatgccactggaaaatatactcgttccttgtatgccactggccccacatgtcatagacacaaaaaaatatacctatatgccactcagtggcacacaaggaatgagtataaaatcggatggcataccaggaatttttccatatatttatatgaatgaaagcgtgtagagaagaaaatgaagtagaaaagaactcgtatgtttttatgttttcggtaggaatgtattggatgtgtggtttgatgtgaggattaatcttaaaatgcaggttatgttgtggggaatgcatcgataggtgtttacatgaaaagtgtatttgttttatacatgtgatcggtgattgtggtagtcgatgcgattgaggagtatgttggtcctgttggagtcacttgtgctgttgatgtcatgtgcataatgtggggacacgtatgtgtgtgcgtgccgaagtatcataatagtggttgcgtagagttgtctgaagtatttttcggatgcatgctgaaatgcggttgcattcgaaatagggaaggaggtgtgttgtgtgatgagaaggctagattgattttataggttgtatgaaaaacagtctcttaagtgtatacgtcgagtgtgttaattggatcctacatatgcagagtgtagtgtattggttagacgaagagttttggaatagacgagtatgaggcgtgcagttaagccgagattgaagtgcaaatcctatgcaatatgatgggattcgtgattatataggggttatatttgttgatgtgacgagtagtttagaaaatgctagtttgcgtgggggatgtattgttaaggcatgagtgtcggagttcatatattagtggttacgctacgatgatcgaagtgtctcgagtgcacgccacaacatggttgtatgcgagacagggtaaaataaggtgtgctcgacatgaatgttcggtcgttgtaggtagaaattgtcttggcttaattagagaggtggtgacatgccaaagtagtcatcgcttgctctatgtttataagtcgatacaatgcgtattatgcgttcgtaaaattatgcttcacatatagtgtatgattgtgctcacgatttcgagtagacacttcaagtaaatcaagtaggttcgtgatacaagtagtgtaatggagttagtttgctttagaataattattgaaatgttttgatcatatgataaacatgtacgtgttcatgatttgggaagtaagcgcatggtggttgcgagttggagattagtggtttacgattcgtatgatttggtcggtgtgcaaaaatacttgtgaatatgtgtgtttataaaaatgttttagtgtatgttgtgtctcggattgcgataataataggcaagccgacgtgtatgttatttagcgggctatgtcattactctagttagccgaattgttagatggatgtggttaagctcgtggtcacgatgattttcttgttgtagcctaaatacatatggttatggtcgcggatgaaaagtagtagtgctcatgtggtgtctaagttaaaatgcaaactagtgtgtgaagagcgcatcgatatacatatatacccggtctgagtattgtggtgaatgcatttgttaaacatgtgtggtaattctagtgcacggaatgacatggataaaaatttgtaagtctctttgttagtcctcatttgattaatttaactctaacaaatggtaaagtgttagaataattcaggtctctagaacatggcaatttttgaagtaaataggagctgaaatttattagttgctgtttcgggctgcacccactgttttcgtcgtgctgtatgtttgatgatccatatagaaaagttgtagatccatatagaaaagttgtagatccat

SEQ ID NO: 78 - DNA, 4033 bp, Zea mays
cattcttcattggtatatatagaacaaactacttgcaaaagttgagtgcattatcactgagtttattaccataagagagtgcattatcactgagtttattatcagaagaatattgcagcacttacaaatttctgctttatctttttttttcttcctttgcttcctttgtcttcaagctccttctgctttatcttcttttttcctttgcttcgtttgtcttcaagctccttcacaatcgcttgcctaagattgtgttgtaggtctgcactccaaacttgattcttaatttgtcatattttttatttcgatcatcaaacttgaggcattcaacgaaggcattcataattactttcgtggcagtgccaccttcctcgaagcactttacaagatcaccacatgtcatggtggccccatccacattgaacagcaaagtatcatccatgctgtgccaacaaaaaaaatatgatatgaatatcagtcagtttattcaaacaactctcaacaaattataatcatccataaacttaccagtgatgtttgacacgttggtacaactcagcactctcttttgtactcatggatgaaagttttgtaaactcatctctgggtatggttgaactaatcttccttttgctctttaaaagtggaacattgccagggctcttacctgtactgatatcgtcccattcctcctccaaaacctggttcatctcagtactctctgttgtactcatggatgcaagtttttcaaaccttttgctctctataaatggcacattgcttgtgtccacttccttcttctcgaaaacctgaattgagggttcttcttggctggagtcaactgagagttcttcttggctggagtagttgctagcatcgttcttggctgagaaaacatcttcttcctctagtacaactgcttcgtatgtgagttctttaactgaagttaactgaccatcaggctggtcctcatgcaaggaatgggccctcttctttgaaagactgggctagagcttatcaatatatgttcaatcgcaaaacattgtctgtcacctgtgagtttcgcaaaaaaaaggagctgatactgtcccctttctcctccaaaacttgaatgcttatgctagcatccttcttggttgagtcagggcgttttctattcatatcacgagtgaggaggaacttagtaagctcctttcggagcatcaacacttgttcctgcaattttgaggcataaatcaattgttttagaattcgaatacaacagaacttgaaaaccacaaagctgaatgtttacctcattgatgttatatatctccatctcattgaaccctcgtatatacaacaatacatgaaaaccccagtaatagctgcaagaattcgcagaaagagagatcaaagatggtggaaacaggaagcagcaaggttgcaaataggagatagcatggtaaacactaaagaaaaacctagcagtagttcagtcaattttttttcttataaagcaagatgacaagacggaggaggctacaagactaaggtggtgtacgttcacttacgtgttattttgctgctgaaccatcagtgtttctgtatcataaccagatatgtccatgtgattacgttgcaaaaacgtctgcagtttttcaagcaacgtaattggcacctctttatatatgcctcgacaagagtcggacatatatctttctttgcacagtagaaacaacaactagcgaccaatgatgattataaactataggaacaaaaatctggggaaaaaacaattagacatacagagcattgagaaatacagagctttcccagtaacattgaaatacaaagagcacaaacctgattcacatacctcactttatttggagtaagctccctgttcagacttttagcagttattatgtctttattcaacaaatcattctggaataacaatcaaagatacaacaaccatagttaaagaataacaataactaagtttgagatgacaatcataggtaaaagtacttaccacagcaccttcactaagaataattttatcatgccaccccactgaccatagttcgcataccaaatgaaatacaagggaatgcatatgaccacatggttgcaaacaattaataaaagtagattcccgtacttcacaggaaggaaagtctaaaacaattctgttgtgggatctttctaaaatatgcttcttgtatatgctatctgcatcatttatgtcaagatgctaaaaaagttgaaacagaggttaggtaaatttgcaatagaggttaaaaaattaacaattattctagttttacctcttacaagaagacttctcatgcagcactgcaaattgtctgaagcagctatcttcccagctaatcaactaaaaaggacatcaagggggtgcagtcagtttctttggactacacttccgcatcacctcatagaacaataatagaatagtacttacatcaacatcctccagcaacatcactttcttctgtgcctctgctgccctttccttttcctccgcagccagctgaaagggacataaagaaataagaagttgcattgcaacaatcagatgcagtcaaaatgtcttaaaggttccttttcgtaccctttttgtcctcttactgattttcttaattggttttgcactcaaaaggttatcgaccattgcctccgtatacaggttaattctgcaacattgtgtccaagctgttcctttgaatacagtccatgaaaacaacctgtgaaccaacgattcttcacttagtcactttcctacccaacatgagaaaaacaattactttaaggaattatggatatgctctgcattatcctggtacttactagaaacataaggacacatccattcatatgccccggattcttcttaaagtcagtgcaagagctttctttaatgaatgaaatatcacatatgaccagtcaacctttttcaacttttctaggtcatatacagcttgaagttcaggtgaggttacataaaaatagacttttgtggcagtagcaggttatttaagaccacactgaaaaaatgtctgacgagcatatctgtgtccatgtgcatggagatctcctcgttatccgaatgttgagccaactttacaatgttagtcacggtgaaataggttctcttaacactagcaggtacttcatcgttccgttgaccagcaccaccttcattggtctgttgtccagcaggtacttcattggtctgttgaccagcaccaccttcattggtctgttgactagcaccacctttatttttctgtctcagaggaaacttttcagatactattttcagcacttcgtacattttgacatattgttcatctgctgaagcttttgaagatggacttgggagaaccttctcagagcaggccaagaacttgttggattttcagttgtgggctgcaccgggtttgcagctccttgtcatgctcggcatatttggaaacagagtgcctgcagatgttgctaaaaagaaaattaatcaaaatttcagaaatctacagcttctttgatatgattttgatatttagctttaactgttttatcacaaagaagactatcaactaatgtaattgaaacaaccgcaaaagttgtctaagtggccttgtcggactttgctgcggctgaggcagcctgttcgctgagacgaccagtcctcctgagacttgaaaacggagccggcttccttacgctgggcgcgtatgacgcgacccatctggtcaacggcggcggcggcgggagaggacgcgaagggaagaaaccagagaataactgagtgcgtccacaggaataactaaggtattagaccagaataactgagtgcgtccattagaataactgagttattagaacggaataactgagtaatgagtagagaataactgagtgcgcacattagaataactgaggtattagaccggaataactaagttccgtcaccagaataactgagtaatgaacatagaataactgagttattggaacggaataactgagt

SEQ ID NO: 79 - DNA, 4028 bp, Zea mays
aatctttgcgtaaattaattttagaaattttataatggtgcctaggctcctattgcgggctagctccgccactgctgacaagatggagttcagcgggcttgtgacatctgtgggcatcaacattggcatctgtgtcctcttcctaatgttctactctgttttgagaaatcaacgggccattgtcaagatttacttcggacgcagaattgctgagcaatacagtcggctccgagggggttgtaactttgaaaggtttgttccatcgactggctgggtagtgaaagccctgcagtgtaccgaggaagagctcttagatgctgctaggttggatgcagttgtttttgatagaattatagtattcaggtacagtatgcaaaactttcttttcacctccttgtcccctttgtcatcaagcattcatactagttcatatgtccatccccagcaaccaaattggcagagactgaaacacatatattaatttacgtattcaacagcatacgcatcttctccgttgctacacttctgggtctcttgggaattcttccagtcaattattattttggacagaatacacaacatgtttcaattccttcagaacgaatggatgcatttacagtatcgaatgtgaaacatggatcaaaatggtaagccgagcaaagtttctctctctcttttaatttattatcaactgttgaaatgttgtgttttcgaattatatatatatattgtgatagttaccgacatcttacaagtgttttctaccttgattaattcatccaccatgcttcttcattcacttctttagaacttaaggaagaatgtgcagtgtagaaaataacaaagtgcatgttttgatgattccttgcatgcagcctcttgatccattgtgcggtgctatacataatttctggagtaacatgcttacttctgtacattgtaagtttgtttcgcatttgaattgttgaaaggctccatctccttgtagttggaacgttttctactgatctgttttttcccttcaatgcaggaggggaagcacattgccacgttgaggtccctttatctcaaaaggtcaacgctaaatccaagccaatttgcactccttgttcgtgaaataccaaagacagctaaagaatcatacagtgatgctgttggaaatttcttcacaaagtatcactcgtctagttatctcttccatcaaattgtctacaaagttgggcatgtccataagataatggtatctagcttgtactcaatgcatgcatttctcttttactagtgaagaacatttactattatatattctaagtgaagtataattaatacttcatctcatgattagctaggttttctcataattgtttttgtctttttgacatgaacaagtgaacaaatgtctagttcctccagtgttgaatggtttttctttccttatgcgtgtttgtatttaacctcttggttttggtgtctttaatttatctgacagactggcactaagacggcacataagaagttcaaacatttcatagctgaaatcggcagtcagggatttaggacgacaaccaccaacagttgtttcatgggaccaccctctccaaattcttccaagtttaactctgaaggcgagcaaaacaaggggaaccctgacaatgaagaatccaccataaacttagatcacgaggttaaaattcttgcatgcatgcatttgttaattgcttaatttagcagtaataatatggatagtaatttctatgtggaattacatgcagcaggaatgcgcaactgcttttgtatttttcaaaactcgctatgatgcagttactgcctcaaatatggtgcagacatctaacccactgaaatgggttactagtctggctccagaaccagaagacgtgtattggtccaatctttggcaatccaacaggtgtcgtaaatcaacactagttccaggctgtattatttttgcattcttacttttgatgccgatggtgtgtatacaatcactatctgacccagagcagctgcaacagttgatgcctgcttccttaaaagaaaggttggagaagtaagtactgaaacttcagttgggctatctcgatagatgtgtgatcttatatcgctacaaatatatatactatccatttgacctgtctccatattgcacctattgaatatatattactcggcctatttgcaggaaaaactacatgactaacctaataacgggataccttcctagtgtgatccaacaaattattctatatattgttgggacattgatgatgaaagtttctaaattggaaggtgccacatctcacagtgcaaggaagaggagtgcttgctttaaactgttgtgcttcatagtttggaacatattctttgttaatgtactatccggtacattcatgagtcaattgaatttgttattaagcccaaaggacattcctgtcaagcttgctagagctttaactagacaggtttaacacaccttcccttttctttatggaaagataatatattggttttgtgtatttaattttcatctaccatttctgtttcttttctgtgattttattttttattgcaggctaccttcttcatcacctatgttatgacctcgggatgggctagtttatcatccgaacttttgcagttctataatctgataatgagctttataaggaaatatattttgagaaagggagaatatagagaagatacagaatctgttcccacattcccctatcagcaggaagtgccaaaagttctattgtttggactattgggcttcacatgctctgtggtggctcctatgattttacctttcctgctagtatacttttaccttggtcgtgttgtataccgcaatcaagtgagaacctagatactatattttattttcttacttaccctgaaatttgtccattcatgctaatgtaccatgtgttctttttcagtttctcaatgtttatcgaacaaggtctgatacaggaggattgtattggccaattgcacacaacacaatcatattctctctcgtgctcacccagatcatctgtgctggtgtatttgaaattaaagaatcgcgagtggctgtatgcttgaccatacctcttatcatctgtactctttcatttcacctttactataaaaggagtcttctgttattcaagactattccaacacaggtaatattagttccttaatataatgtgaaatgttcctttccaaaacgataatgtggagatgtgactaggtttactagagcatagaataataattgatggctagagtttgtcatgagagtgagtatctctcttctcgtatggcatttattgttgccttgtgattttgcaggatttagttgacatggatatggaagatgaacgattaggaagaagggaggaaattcaccacatgctccattcttattattcccagttccctaatattgaagaagtacccttagaggaaattaagattgttggtggtgccgaggagcaatgttctagcttgagtacgtccactagtaaagaaacctttgaaaatcctcaaaaggacatgtctcgcccgttaactatatctgtgatgtcgtaatatcgattacatcaaattcttttctcttaacatgtcccactcattaactatatctgtgatgtcgtagagtcaaaattcttaagtatgatttctccacacaacaacacatttgtcattcaccaacctcactatgttacaatgcccatagaggatggtggactaggagtacatagaggatggcatactaggagtcgtgatactggacgtgacagccagacttctggttcctagtgcccatatgtattatggttcctattgcctcatatttaatccataggaccacatcctgctttgaccacatgtattcaatatgagacactagtacaagaggagaaatttgcacaaaccccattagacgacatgtgaaaatacaatagatctattatatccataatgctcccctcaccctcaaactcaaggtggatcag

SEQ ID NO: 80 - DNA, 3981 bp, Zea mays
ttgaatggaaaccgcaagtctacaaactctcatctaccataatggccactatccattgtgaatgcaagcttatgttctctaagaaaattcaaggtgaagtttcagcacaagcagatggaagttcatcaatcacttgccatcagcgatagaacatgcttggatacacccagaagacctgcagctaggtgtaccagtccctcttgaactcaaggttacaatcgttgtctcgattccacacagcatccacatcatgtcagcccatgcaacagaagggcgctccattgtcctaagccggcacaagaaaacgcaggcctccttacatcacaccaaattaaccaaaattcacgaaatcttcctctaatttcggaatcttgcccttattatttgttctgagctgctatacacattttcttaccaaaatttttaaaaaacagtgatccacgtttgaatatcgaacagttactgctttgctactatgatggaatataaatctgttcacgtcaaattccagttccgaattgttctgcctgtcaaccgttacgaattatcttttggttccttcttttttcgctttgacaatatagactggttcttgtagttgtagacgttagtcacacacacatctccatccacaaatctaaaatcccagaattccaaaagaaaaacctaatctagacagcacggttcaaaaactgatctttgggtagacatcgtgggttttcttcatataaatttcaaaagcatacatcaatattttcctcaaaacagacacataacttaacaattacacacacacacacacaaatgaaatctcaaatacaataccatagtgacatcatctactcaaatataagaagtcttccctaaccaaacaactccaaggcaaaaatttctgcaacacaggacgggcacggatcactgtccatctgagtagaacatgctcgggtacacccagaatggctgaagctggatgtaccagtccctcttgaacccaaggccaggatcagtggaatcatcccaaatggcatctgcatcgtcacccagcccatgcaggacccagggttgcctgtaatgcgcgtagtacaggcagttgcttctcccgccccaccgtcctggactcatgcaagagaacggcgggctcctcacatcgcccccgataaagagggcatcattctccagcttcaccacgtccacccaagtcgcaggttcagtggacgtatccaggcggtaggctttgtagttgacaggcgctcgtgctccagacgatgagaagctcaagtagtagtcaacaattagaagcatgccgctgcataccaacagccatggccttcggaatgggcatccaggcatgttgtcccaccaaacagttgccatctcctgcaaaccaagccggggggccaaggacagagtgtagagcctgtagtagctgtccatcacgatgaactgaccgttgaactccacgatctgctcgatcagtgagttaccgagctgtatttccgaccaagaattgcttccaactgaccagtcaagaagggaggctgggatgctgtgctggctggacaccacacagacaaggaggtgcgagttttctagcgcaagaggagctgtcagcatgccagagtagaagaaagtgtcatcgttgagtgggagcggcggtgcccatactctggccccagtgaacacatcgacaatgatgcaatctttgcgaaggccgcatatcagctggccataggaggagccggcgaaatgcatcgccttgcatatttcttgaggaatctggcagcaaaggtctgcttttgtattggctagatcgatgacctgccatctgcgtagctcgtgaccatcaggtgcacgcacggagacattgggcctaacgaggagaggtggaagcaaggcacagaacctggatttggatgggtatgatgagaaggcagcacgccaagaacgacaggtgcttgcgaaggcaaggaggtcaatgaaggagcccaggagggcaacaatagactggagtgggcctccagggagatcagcccacccttgaatcccacatgtatcaggggctgcttttgtggaggcagaggtgccagatactgtgatagggctttgcatgatggcagtctcactgcaacaaagtaaattcaataaatgaactagaagcatgatttgaatacaaaatgagaaataggcagataacttccaagagacacagacaccctacagcaacaaaaaaatcagtacatgtgttgtacagatctgaagccactttttaagttgttatacactattaaattcgaagcggctgaacagttgtaataatcttaatgataagacaaataactgaataagagaaaggaaaaacaaagtttttaatccaaacatcttgtgctctggtttcaattttaaactttcctcactacttcctaaacccatctcctattttcagaacatgtgatgcctacggtacagtacataaacaagtaactgacacatgaaagagaggtgaaaactgttgctgtaattgcagaaatgccaatcgagtgctcaaatcaccatctaacataaaagtggattcttccatcctagccacatcagtcaggcattcgtgtgtttgaatatacttgatatatcaggtccatctgttgtagggttcttctgtaatctgtataccatacggctagtcggctacagcagaatgcagtgcaaattaaccatacaaactagagccaagatctgaccagaaaagtacaaaataactacctgacacaaattgttggcctagtttgaatcgagatgacggtggccatgcaaaaatgaacatagtaaaaaataatcgaggtattaggtgccagggaggatttcagtactcactgctcgatattagcaggtgtcctgaaacaacgttatatacactgatataaaatagacttcagatggtgtgcgcagaactgcagaaggtacttaatgatccccaattcaactagctagtagttcatttcctggtatccttctaccaggatgttcgcatgaatacaaagcaaggttgttcaaactaatatgtcgcttctttttctgtttctgaatttcaagggatcagagctgagcaacatttattaaagagttggactaaagaaaacgaaaaccgacggcattgaatacgctgtctctaagcagccacgtaagcagcaattaaatagaaaaatcctacgtggacgcaaattaaggaggagagagtcatcggtaatgcaaccactgtatgcccaattcactagaaaaatctttcgttaggagacggcttcagtccgtgttccaatgccaagagacggtaatgcaaccactgtatgactccttcagcccgtattccacacatgaattaaaatttttgtagacagtataaatagacaagccactgtatgacttgttatttatattgttcggatgttatttatattgttcggactttggacgtgtttttcaatacacatatagacatctgtgggctatacatgctcttaagacccatacaggaagctaagatatccacatggaaaaaaaaacaaaatttccttcatagtgtagcataataaaagcaaacgtacaaccagttcccgtttgcagaggaaccgtgacatacacacagtcacacacacagagttacacacgacatcaaaattcatgtctgctaggttaaattcatgagggagactactacggagcatcgaagtcgcgtcttttattgtacacatcagttacagcgcataaatctgtttatgtctgctaggtcactgaccaattaggcgcatcgatactagggtttcttccgttccgtacacctcacaagcacagcatcaaaatccaaaagaaaccaaactgcaatagctcgactcgggagatcccccggacaacaagaacaaatgcgccacacgattcctcggaatggttaattaagaagctgaaggactaaagaaaccgcagaatggaccc

SEQ ID NO: 81 - DNA, 3964 bp, Zea mays
gatttacagaatgatccaacatattgtttcacactctccactatcaactaatattgaaaacaaccaataacgtgtttgtgggacccacatagttagatggttgcatgccgattaaagttcagtgttttaaataatgagataactttaaaagtatttgaattgcaatatgaagatttttcaagataaactattttccagagttacgacctctattaatggaaaatagttaatgaaagaaaaattatatttgcactttcattactcttttctaattgtcgtactgtaagacatacttctttagacatgttaccttaaaacatatatagtgcaatgtgcaatgttcctcagttgtgaacacaacaacccaagtttaaggccgatcaaaacatgagtatgggactaatgggtattaatttcatacaagtttgttgcatgatatattgatttctgatgtgtgtcaacttcgatgcattttgaagccctaaatattgtattgtttagacagacagtttttacggatggacccaacttgtttcacatgcactgatttgggagtaaaggctcatgatttcgtgcatattttctcgaaaagattgtggcatgaaccatgcgaaaactttgaagcttttcgaagccctaaattatgtggtagatttatagaatgatccaacatgttgtttcacacggttcaccatcaactaaaattcaacacaataagtaactttagtatgggacccacataattagatggtcgcatgatgattaaacttcagtgttttaaagaatgaggtaagtttaaaagtatttgaattgcaatatgcagatttttcaagataaactattttgcagaattacgacctctattaacggaaaaatagttaatggaagaaaaattatattttcactttcattactcttttctaaatgtcgtactgtaagacatacttgttaatgcatgttaccttaaaaacatatatagtgctatttgcaatgttcctcagtgttcaacacatcaacccaagtttaaggccgatcaaaacttgagtatgggactaatgggtattaatttcttgcaagtttactgcatgatatatcgatttctgatgtgcgtcaactccgatgcattttgaagccctaaatattgtattatttagacagatactttttacggatggacccaacttgttgtttcacgtgcaccataattaacccattttcaagacaaccataacatgagtatgcgaccctagattgtcgcatgctagcactagatttggtcatatgaaggacaaggggactctagaagcgcttgatgcataacatgtagatttttttcggatcatcaatttactataggcgtgagttacccaacatgttgtttcacaggcttcatcatcaacccaagtgcaagacaacctatagcatgaatttggggcccaagatattggttgttcgaatgcaggcactagagtttgtagatatgaagaatgaggtaactttataaatgtttaaagtccaacatgtatattttttagatctgtaattttccggagttgagagctacatttatgcaattctgcttttatttcgatccatgttttaagatactttgttattattatgttatagttataccaatgatatttttaatagaagaattaaatatagaaaattttcattccaattgtaagtacaatttggtttatgccagactataaacattactactttaggcatgttatgttaaaatatatgtagtgctatttaaatgattgttggttatggacaatattgcatgttttgaggccactcaaaaaacaagtatgggactcatgatatttatcacaaaataatttaaccaaggaaaattacattacaatttgcacattgtcaaactgtaaacatcacttgtttgggcaagttatcttatcagatatgtggaaagatttgaaatgtttcacggttataaacattaatgtaagtttgaagcggttcaaagccctaaatgatgtaatgtttagaatggtagtttttacaaaaagcacccaacaaggtttgtcatcaaagtttttgcaatacactgatttgggagtaaatggtcatgatttcgtgcatgttttctcgaaaagattgtggcatgaatcatgcgaaaactttgaagctttttgaagccctaaattatgtgatagatttacagaatgatccaacatgttgtttcacacgctccatcatcaactaatattgaaaacaatcaataacgtgattgtgggacccacatagttagatggtcgcatgccgattaaagttaagtgttctaaataatgagataactttaaaagtatttgaattgcaatatgcagatttttcaggataaactattttgcagagttgcgacctctattaatggaaaatagttaatggaagaaaatttatatttgcactttcattactcttttctaaatgtcgtactgtaagacatacttctttaggcctcttaccttaaaacatatatagtgttatgtgcaatcttcctcagttgtgaacacatcaacccaagtttaaggccgatcaaaacatgagtatgggactaatgggtattaatttcgtacaagtttgctgcatgatatatcgatttctgatatgtgtcaacttcgatgcattttgaagccctaaatattgtattgtttagacagacagtttttacggatagacccaacttgtttcgcatgcaccatcattaacccatgttcaagacaaccataatatgagtatgcgaccctagattgtcgcatgctagcactaggtttggtcatatgaaggatgaggtgactctataagcgcttgaaatataacatgcatattttttttcgtatcctcaatttactatatgcatgagctatccaacatgttgtttcacatgcttcatcatcatcctaagtgcaagacaacctatagcatgactttggggcctaagatattggatgttcgaatgctggcactagagtttgtagatatgaagaatgagataactttagaaatgtttaaagtgcaacatgtatattttttagattggtaacttctcggagttgagagctatatttatgcaattctgcttttatttcgatccatgttttaagattctttgttattattctattacagttatatcaatgatatttacaacaaaagaattaaatatagaaaaattttattccaattttaagtacaattttctcgatgcgagactataaacaatactagtttaggcatgctatcttaaaccatatgtagttctattttaaatgattcttggttatggacaacaatgcatgttttgaggccactcaaaaaacaagtatgggactcataatatttatcacaaaacaatttaacctaggaaaaattacattacaatttgctcattgccaaactgtaaacatcacttgtttaagcatgtaatctcataagatatgtgggaaattttcaaatgtttcatggttatggacattaatgtaagtttgaagctgttcaaatccctaaatgaggtaatgtttagaacggtagtttttacaaaaaggacccaacaaggtttgtcatcaaagttttcacagtacactgatttgggagtaaagggtcatgatttcgtgcatgttttctcgaaaagattgtggcatgaaccctgctaaaactttgaagctttttgaagccctaaattatatggtagatttacagaacgatccaacatgttgtttcacacgctccaccatcaactaaaattcaacaaaatgaataacttgagtatgggacccacataattagatggtcgcatgccgattaaagttcagtgttttaaagagtgagataacattaaaagtatttgaattgctatatgcagatttttcaagttaaactattttgcagagttacgacctctattaatggaaaaatagttaatggaagaaaa

SEQ ID NO: 82 - DNA, 3963 bp, Zea mays
atttgttgtggggatggtccatcacactgacttgccactactcttgtgtatcataaatccattacactataccatcaaatatgattagtgtgccatcgaaatgcatagtcattgtactagtgtactgcggactgcactttttactggagtggactttaaaatagtaagtgagatagggagacacctaaggatggggaagaagttagattgaatcctctaccgccattctccatcttgtactccatcacgtgccctctgtggctagggttcttatccgcaaccactactcgattgatcggcaactggtcactccctcaaacatgtgccctgtgtggctagggttcccatgataacatggtttagcataagccccgatggtgatggcaacttgggctatctggacgggccagccagctggtgattggtgactgcatcctagcatatccgtccccagctgcatgatattctcaatttggtccttcagtatatattgcattagatgaagtctgatgtgctgacaatgtttctgcatatgagtgccaaataggcaatttcagtattgccgcagtataatgctcatttgcaattcagctataaatcaaacgctcacatgcttgtattatattcttcacttgttttgttttagttgaatcggttccaaactatacattattgtatggagaggctcagacacatttaaaactcgcatggaggaaactgctgattattatggtgctttcagccatcttttaagtttcagaaactacatttaccctatgctagttatcttatagaccaaaggcaacttttggccctgcttatcttgtttcagctactttttgcctatggtttatgagctgaaagttgtcccatgcagcatcagatgatgctcgaggaatctttggtggtaataagtatcattattatatgacggtatcatatcccgagagatcaaatgtggtcccattcaatgaacggttcatcttggcactctactaggtgaagagcctatcaagtttgttgaggatgagtttgatgttgagagggttgtcatttggcactaggtagcacaggttgggctctaaatccagagctgtttttggaaaggaaggtccaagctatctggtatcttctcttttgtttgttggcaactacaaatgaactcaaatattaggcattattgttactaattcagaaacaaatgtagtatagcactacacacagaaccacctttttgagtatcaaagctagggagaaaacgatgtcgaccgaagtactctgtgtcggattgactaccggccactagctgcatagccattctcatgcttctggtctctctcttttcagaacgaccgtgatccaaatagatctagaagtacgtaggtaaaccatcagcatcttgtgtaaaatagacgtggcaaatgtagatgatcagaagtggcagcgctcccgtttaaatcaacaggtgcctcattcctaatgtctcaaattcctgtctcatgtttttcttctttcatcttctttttcttgcttttgcagttctctctcatcaatttatttgtttatactaacacattcaccaaaaggagaggcagtgttgggtcgtgtgtggcttgtgcagacatgtgtgcggtgccatatttataatacatagtatccctataggttctattgattgatatgtttagggttttagggttatcagtactagttggaaaccacctatagtaccagattctcaaccattactagacatctaggatgaagtcaccaaactttagtggtggttacgtggcccgatattaaagaggtgcatttataactaatccgatccaagaaccattattaaaaggtcattctttactaccctaccggtactaaacatagatttttagtacttattcgtgccaagaattggtactaagtgtccaaaggctctttttattctatatatttataaagtgatatgtgcatgtctatatgtgtatattgaaaaaataatatatacacacgcattaattgatatgtgtacaataatatatatacaaatcaatagtaatagtgatacatacaaatatacaagtaacccatttgggcggcatgcacagcagcatgagcgcgagccgttggcagcaacgattgccgaagatgaaatcaaattgctgctttacttcttcagatggctttcctagccgaggtgagatcaggaggcgtgaagagcatgtgtgggacctcgcaactagcacaaggaggcgcgtgcgagtgtaagcacacgcacaacatgtttttgcagatgtctaactaatgacactggataaaaaaatattagaaaaactgttttgccaaacgatttacaaaaaaacaatgaccgaggctatttttggaggagccgaagctctaccaaacatgttctaaatatatctttatttctatattctcaatctgcatcatctttgtcttttgatggggagattttgtccatcttaatataactccgtgtttttataagatctcgttattttatgaaccccataacttgttttgaatcgactggatcttttcaaaagggaatagtacttccatcatatattcatctttatcaactgttatttaccaaaagcattaatataaagtattattagatccttgggacttggtagtataggttggcctctaaacatcgaagctggttttagaaagaaagattcaaactgtctcgtatctcctcttctgtgtgtgttggccctacttgaattaaaatcttagcaagttgtgtactgttcgtctcaatatgtcatcgtgttgtcctggcaggcattgctgtgaaactaggggcagatctaggatttggtcatacatgggctggtctattagatgtaatattttttcggtatattttggactaaaacaaaaaatataactgaaattatatggatcatgttctaggccatggacatttagtacgtgtgggaactgtatagctttttgactagatgaaactgctaccacattatcgtcgctaacaacatgacagatagaacttgagcagaatatcatagataaaaatacgtgaaagaataatattagtaagatatgtatacgacatggtattgttgccaattcataaacaagcaagagtagcgtagctctatgcagttttgatcacgaagatggtggatcactctacgttgtcactttcaacatttgatatacaatgacgcttgtcgtgggacactcaacaaaacagtgtagaccagagtgtgcacgatagacaatggtccagttagctaccgatcgctggccctataattatttctcaagctcttgatctctccaactagctcttatagtgtcgaccatgatccgaaaagacctggcggtggacagggaaaccatttgcaacttgagtaaaatagttgtgtccgatgtacatcatcagaagtggcagcgctcgcttttggatcagtaggtgcctcattcccaatgtctcaaattcctattcctcaagcttttctttgttcctcatgtttttcttgattttgccgtcctccctcatgattttatttgtttacgctaacacgtactaatatgttcactaaaaagagagacattgttatgtgatatttagcttgtgcagagatagtagtgtacatgcaagtgggtgccttatttataatcgtatccctataggttcgattgattggtaggtaactaaattgtgcctaattcatataggttctagtgattgataggttcattattgaagaacaagccatcaatactagctacaatatcaaatctccaactgattttagacaatcgggactaagattgtcaaactttaaaccccggttgcatagcctcatactttcattaacaattcgattcaagaaccagtactaaaagttctctctttagtaccggttttaggcttgaatcggtaagtgttcaaagattttttat

SEQ ID NO: 83 - DNA, 3955 bp, Zea mays
ttataatggtgcccaggctcctattgcgggttggctccgtctgtgggcatcaacattggcatctgtgtcctcttcctaatgttctactctgttttgagaaatcaacgggccattgtcaagatttacttcggacgcagaattgctgagcaatacagtcggctccgagggggttgtaactttgaaaggtttgttccatcgactggctgggtagtgaaagccctgcagtgtaccgaggaagagctcttagatgctgctaggttggatgcagttgtttttgatagaattatagtattcaggtacagtatgcaaaactttcttttcacctccttgtcccctttgtcatcaagcattcatactagttcatatgtccatccccagcaaccaaattggcagagactgaaacacatatattaatttacgtattcaacagcatacgcatcttctccgttgctacacttctgggtctcttgggaattcttccagtcaattattattttggacagaatacacaacatgtttcaattccttcagaacgaatggatgcatttacagtatcgaatgtgaaacatggatcaaaatggtaagccgagcaaagtttctctctctcttttaatttattatcaactgttgaaatgttgtgttttcgaattatatatatatattgtgatagttaccgacatcttacaagtgttttctaccttgattaattcatccaccatgcttcttcattcacttctttagaacttaaggaagaatgtgcagtgtagaaaataacaaagtgcatgttttgatgattccttgcatgcagcctcttgatccattgtgcggtgctatacataatttctggagtaacatgcttacttctgtacattgtaagtttgtttcgcatttgaattgttgaaaggctccatctccttgtagttggaacgttttctactgatctgttttttcccttcaatgcaggaggggaagcacattgccacgttgaggtccctttatctcaaaaggtcaacgctaaatccaagccaatttgcactccttgttcgtgaaataccaaagacagctaaagaatcatacagtgatgctgttggaaatttcttcacaaagtatcactcgtctagttatctcttccatcaaattgtctacaaagttgggcatgtccataagataatggtatctagcttgtactcaatgcatgcatttctcttttactagtgaagaacatttactattatatattctaagtgaagtataattaatacttcatctcatgattagctaggttttctcataattgtttttgtctttttgacatgaacaagtgaacaaatgtctagttcctccagtgttgaatggtttttctttccttatgcgtgtttgtatttaacctcttggttttggtgtctttaatttatctgacagactggcactaagacggcacataagaagttcaaacatttcatagctgaaatcggcagtcagggatttaggacgacaaccaccaacagttgtttcatgggaccaccctctccaaattcttccaagtttaactctgaaggcgagcaaaacaaggggaaccctgacaatgaagaatccaccataaacttagatcacgaggttaaaattcttgcatgcatgcatttgttaattgcttaatttagcagtaataatatggatagtaatttctatgtggaattacatgcagcaggaatgcgcaactgcttttgtatttttcaaaactcgctatgatgcagttactgcctcaaatatggtgcagacatctaacccactgaaatgggttactagtctggctccagaaccagaagacgtgtattggtccaatctttggcaatccaacaggtgtcgtaaatcaacactagttccaggctgtattatttttgcattcttacttttgatgccgatggtgtgtatacaatcactatctgacccagagcagctgcaacagttgatgcctgcttccttaaaagaaaggttggagaagtaagtactgaaacttcagttgggctatctcgatagatgtgtgatcttatatcgctacaaatatatatactatccatttgacctgtctccatattgcacctattgaatatatattactcggcctatttgcaggaaaaactacatgactaacctaataacgggataccttcctagtgtgatccaacaaattattctatatattgttgggacattgatgatgaaagtttctaaattggaaggtgccacatctcacagtgcaaggaagaggagtgcttgctttaaactgttgtgcttcatagtttggaacatattctttgttaatgtactatccggtacattcatgagtcaattgaatttgttattaagcccaaaggacattcctgtcaagcttgctagagctttaactagacaggtttaacacaccttcccttttctttatggaaagataatatattggttttgtgtatttaattttcatctaccatttctgtttcttttctgtgattttattttttattgcaggctaccttcttcatcacctatgttatgacctcgggatgggctagtttatcatccgaacttttgcagttctataatctgataatgagctttataaggaaatatattttgagaaagggagaatatagagaagatacagaatctgttcccacattcccctatcagcaggaagtgccaaaagttctattgtttggactattgggcttcacatgctctgtggtggctcctatgattttacctttcctgctagtatacttttaccttggtcgtgttgtataccgcaatcaagtgagaacctagatactatattttattttcttacttaccctgaaatttgtccattcatgctaatgtaccatgtgttctttttcagtttctcaatgtttatcgaacaaggtctgatacaggaggattgtattggccaattgcacacaacacaatcatattctctctcgtgctcacccagatcatctgtgctggtgtatttgaaattaaagaatcgcgagtggctgtatgcttgaccatacctcttatcatctgtactctttcatttcacctttactataaaaggagtcttctgttattcaagactattccaacacaggtaatattagttccttaatataatgtgaaatgttcctttccaaaacgatcatgtgcagatgtgacatggtttactagagcatagaataataattgaaggctacagtttgtcatgagagtgattagctctcttctcttatggcatttattgttgccttgtgattttgcaggatttagttgatatggatatggaagatgaacaattaggaagaagggaggaaattcaccacatactccattcttcttattcccagttccctaatattgaagatgtacccttagaggaaattaagattgttggtggtgccgaggagcaatgttgtagctcgagtacgtccactagcaaagaaacctctgaaaatcctcaaaaggacaggtctcgcccattaaccatatctatgatgtcgtaatattgattacctcaaattctactcttataacatgtcccacccattaactatatctgtgatgtcgtagagtcaaaattcttaagaatgatttctccacacgacaaacatttgtcattctccaacctcactgtgttacaatacccatagaggatggtggactaagagtccatagaggatggcatactaggagtcgtgatactagacgtgatagccagacttccggttcctagtgcccatatgaattatggttcctattgtctcatatttaatctataggaccacattctactttgaccacatgtattcaacacgagacacgagtacaagaggagaaatatgcataaaccccattagacgacatgtgaaaaatacaatagatctattatattcataatgctctcctcaccctcaaactcaaggtg

SEQ ID NO: 84 - DNA, 3954 bp, Zea mays
ggcgtgttcgccttcgccccaacatctgcttttatttcgatccatgttttaagatactttgttattgttctattacagttctatcaatgatatttataacaaaagaattaaatatagaaaatttttcatccaattttaattacaatttgctttgtgctagacaataaacaatactagtttagacatgctatattaaaccagatgtagtgctattttaaatgattcttggttacggacaataatgcaagttttgagaccactcaaaaaacaagtatgggactcatgatatttatcacaaaacaatttaagcaaggaaaattagattacaatttttcattgccaaacaatacatatcacttgtttgggcatgttatctcataaactatgtggaaagatttcaaatgtttcatggttatggacattaatgtaagtttgaatggttcaaagccctaaatgatgtaatgtttagaacagtagtttttacaaaaatgtcccaacaagatttgtcatcaaagttttcgcaatgcactgatttgggagtaaagggtcatgatttcgtgcatgttttctcgaaaagattgtggcatgaaccatgcgaaaactttgaagcttttcgacaccctaaattatgtggtagatttatagaacgatcaactacgttgtttcacatgctccaccagcaactaaaattcaacacaatcaaaacttgaatgtgggacccacataattagatggtcgcatgccgattaaagttcagtgttttgaagaatgaggtaagtttaaaagtatttgaattgtaatatgcagatttttcaagataaaagattttgcagagttacgacctctattaaaggaaaaatagttaatggaagaaaaattgtattttcactttcaatacttgtttaggcatgttaccttaaaacatagacaacctatcgcatgagttaggggcccaagatattggatgttcgaatgctagcactagagtttgtaggtatgaagaatgaggtaactttagaaatgtttaaagtgcaacatgtatattatttagatcggtaattttctggaattgagagaaatatttatgcaattctgcttttattttgatccatattttaagattctttgttattattctattacatttatatcaatttataataaaagaattaaatatagaaaaaatttcattcgaattttaattacaatttgctctatgagagactattaacaatactagtttaggcatgctattttaaaccatatgtagtgctattttatatatttcttggttatggacaacaatgcatgttttgaggccactcaaaaaacaagtatgggactcatgatatttactacaaaacaatttaaccaatgaaaattacattacaatttgctctttgccaaattgtaaacattacttgtttgggcatgttatctcataagatatgtggagaaatttcaaatgtttcatggttatggacattaatgtaagtttgaagacgttcaaggccctaaatgatgtaatgtttagaatgaaagtttttacaaaaacgacccaacaaggtttgtcatcaaagtttttgcaatacaatgatttgggagtaaatggtcatgatttcgtgcatgttttcttgaaaagattgtggcatgaaccatgcaaaaactttgaagctttttgaagccctaaattatgtggtagatttatagaatgatccaaaatgttgtttcacacgctccaccagcaactaaaattcaacacaatcaaaacttgagtgtgggacccacataattagatggtcacatgccgattaaagttcagtattttgaagaatggggtaactttaaaagtatttgaattgtaatatgcagttttttcaagataaatgattttgcagagttacgacctatattaaaggaaaaatagttaatggaagaaaaattatatttccacttttattactcttttccaaatgtcgtactgtaagacatacttgtttaggcatgttaccttaaaacatagacaacctatcgcatgagtttgaggcccaagatattggatgttcgaatgctggcactagagtttgtaattttctggaattgagagcaatatttatgcaattctgcttttattttgatccatgttttaagattctttgttattattctattacatttatatcaatttataacaaaagaactaaatatagaaaaattttcattccaattctaattacaatttgctctatgcgatcttaaaccatatgtagtgctattttatatatttcttggttatggacaacagtgcatgctttgaggccactcaaaaaacaagtatgggactcatggtatttattacaaaataatttaaccaaggaaaattacattacaatttgctctttgccaaactgtaaacatcacttgtttgggcatgttatctcataagatatgtggaaagatttcaaatgtttcatggttatggacattaatgtaaggttgaagcggttcaaggccctaaataatgtaatgtttagaatggtagtttttacaaaacgacccaacaaggtttgtcatcaaagttttcgtaatacactgatttgggagtagagggtcatgatttcgtgtatgttttctctaaaagattgaggcatgaaccatgcgaaaactttgtagtttttcgaaaccctaaattatgtggtagatttatagaatgattcaacatgttgtttcacacgctccaccagcaactaaaattcaacacaatcaaaacttgagtatgggacccacataattagatggtcgcatgtcgattaaagttcagtgttttaaagaatgaggtaaatttaaaagtatttgaattgcaatatgcatatttttcaagataatctattttgcacagttacgacctctattaatgcaaaaatagttaatggaagaaaattaatatttccactttcattactcttttctaaatgtcgtactctaagacatacttgtttcgacatgttaccttaaaaacatatatagtgctatttgcaatgttcctcagttgtgaacacaacaacccaagtttaaggccgatcaaaacatatgtatgggactaatgggtattatattcgtacaagtttgctgcatgatatatcgatttctgatgtgcgtcaacttcgatgcatttcgaagcctgaaatattgtattgtttagacagacagttttatggatggacccaacttgttgtttcgcatgcaccatcattaacccatgttcaagacaaccataacataagtatgcgaccctagattgttgcatgctagcactagatttggtcatatgaaggacgaggggactctagaagcgcttgaaccattacatgtagatttttttcggatcatcaatttactataggcgtgagttaccgaacatgttgtttcacatgcttcatcatcaacccaagtgcaagacaacctatagcatgagtttggggcccaagatattggatgttcgaatgcaggcactagagtttgtagatatgaagaatgagataactttagaaatgtttaaagtccaacatgtttattttttagatctataattttccgaagttgagagctatatttatgcaattctggttttattttgatccatgttttaagatactttgttattattctattacagttataccaatgatatttttaatagaagaattaaatatagaaaaaattccattccaattgtaagtacaatttgctttatgccagactataaacattactagtttaggcatgttatgttaaaatatatgtagtgctattttaaatgattcttggttatggacaatattgcatgttttgaggccactcaaaaaacaagtatgggactcatgatatttatcataaaacaatttaaccaaggaaaattatattacaatttgcacattgccaaactgtaaacat

SEQ ID NO: 85 - DNA, 3932 bp, Zea mays
  misc_feature (2198)..(2200): n is a, c, g, or t
attagtttcaagatttttatgcttaataaatgagaacaatttttgcagtgcatccacaacaatggcatactatctttgacatttgtcgccactacttgtagtctaacaatttcatcatccttcatttgggcgtccacttgcagctcatcaacattatgcaaaaggttttgagctacttcagtagcccgctttacctgtaagttcttcctcttaattgtcccaccgtaacattctatcattgtcttaagttgtttccacacaaaattctttttcgtttgttatgctgaaatttcattatgcttatataatcttaggatcttgtaagctttatttagtttcttaatctcttccgtaatatcttctccttttttgggatccgaattttcaataataatctatgaaataaagtttagtctcgacaattcggatcaccaaaaaagtgaggaagatattaggtaagagataacgaaactaaaggaagcttccaagatcatgagattagataaggacaatgaaaattcggcataactagcggaaaagaattttgtgtggaaccagcttaagacagtggaagaaggttacagtgggaccattaagaggaagaacatagatgtaaagcaggctactgaaagccgctaaaaagcttttgcataatgtttatgagctgtaattgggtgccaaaaagaaggatgatcaaaattttaaactagaaatagtggcgacaaattccaaagagaggatgtcatttcttgaagatgagctgcaaaaattgtcgtctttggtcaaggataatgatcttgaaacttataaaaataaaatcaaccagagactaaaatgcaagatatagttgtagtccaaattaacaatccaaatgaggcctaactatatgaataggtggttagcaggttactgggttcttattgggtgagaaacttctgatattggtggattttgctatgtgggtaaacctaaatcatgtcacatccacccttctagagactaaacacaagagttaggtgcagtttagtttaactagtccaattgaggtccaactatatgaactttgtgacatatggttagcaggttactggggtgttattggttgagaaacttcttaggctggtcgattttttatgtgtgtaaaacctcaatcatgtcacatccactcgtaagaagactcggttgtattcctattaatagaaatgggtgtctctaagaaatgtggactaacttgatatttatagacaagtttggtggtctcgtgggcaatttactctagcaggccccaaaagtcaaacaacaagttacctacttctccacaagaaagtagcaatcaataacatgcatgtttgtcaaactgaccactgcgacccgattgcagcaagagcgcacgacagttcctaatgcacgagacccaatttgcacgatacaccataagggtgaaaattaagtcagatgtatgatcgcatgtaaaagcgagattaatttccaggcctgctctgacggtataaacaagtgacactatattttttagacctgctaaccacctgtcataaaggtgatatagttaggcctcatttgaatcagctaaactcgactgtagctaactcttgtgttttagtgtctttgttgatcttaatttttattagtttcaagatctttatgcttaacaaaagagaacaattttcgcagtgcatccacaacaaatggcatactatctttggcatttgtcgccactacttgtagtctaacaatttcatcatcctttatttgggctcccacttgcagctcatcagcattatgcaaaagtttttgagctgcttcagtaccccgttttacctgtaagttcttcctcttaatggtcccaccataacattcttccattgtcttaagttgtttccacacataatttttttcgtttgttatgctggaattttattgtgcttctctaatcttaggatatggtaagctttctttagtttcttaatctcttccctaataactattctaattttctggggatccaaattgtcaatactaatatatgaaataaagtttagtcccaacaattcggatcaccaaaaaagtgaggaagatattaggtaagagataataaaactaaagaaagcttccaatatcatgagatcagaggacagtgaaaattcagcataatagacaaaaaagaattttgtgtggannnagcttaagacaatggaagaagattacactgggaccattaagaggaagcaaatagaggtaaagcaggctactgaagccactaaatagtttttgcataatgttgatgagttgcaattaggtgcccaaaagaaggatgatgaaattgttagactacaaataatggcggcaaatgacaaagagaggatgtcctttcctctttaggatgagctgcaaaaattgtcgtctttggtcaaggataaagatcttgaaactttataaaaataaaatcatccagggactaaaatgcaagatttagttgtagtccaaattaactaatccaaatgaggcctaactataagaataggtggttagcaggttactaggttcttattgggtgagaaacttctgatgctgatggattttgctatgtgggttaaacctgaatcatgtcacatccactcttctagagactaagcacttgagttaggtgcagtttagtttaactgcggcctatatataaaaaatgtggactaacttggtctctatagacaagtttttagtgatcttgtgggccaaaagttagacaaaaagttaccttcttctccatgagaaattagtaatcaataacatgcatgttggtcaaactatccactgagacccgattgcatcaagatctggcacacggacgaacttcagacagaaatgcaccatcaggactcacaaaatcaataggcctgctctcttgctctctctctctctcacccgagaagacacgtgcacaactctctatcctgtgactattaggagcatcgtcttgctagctttctcctaccagggcaccacactttcacagagcactagatggaacatcattgatggatccctacatacaacgctagcacccattaaataaacacaagtagacgatgacaggcccagaaactgcacctctcgtctcgttcgagccacatgatgtacacgtcttgccatgagaagcggtcacaactgcaggacaaccgtacgcgtctcaccatgcatagaccacactagagcatgttatcctactggtggacacaagactcgcattagctgtaggcttggtccaacgtttgcatgcacaaggcactggcccgcacccctccttcattgctccttgcatatggagcgcgtcctttggctccgcgatccacctgaaccgcttcgctttttcacgtactcatcattaaactccagtaggtttcatttatactcttgtataatactagtatatggcatggaactcagaccgaaatccagaaatgatggtctggtgtgctgcacgcatgttaggcaggcaggcataggtggggcttcacacattagtcatgcttgcttgttcatggagctagctagctagctagtctttcctgttctggagtacttccacctagctatagcagatcatgagagctttcaagaccgttgtacgtgccagaggctagaggctctccctaggttcctttgaaaatggttgcaacgggaaacgactttcaatcgagacgctactactggtgcttcatctcttaggctctttatggatccatatccatgtttggtactagtatggcacggtcgtcagcaccacacacaacactttgtttggtcctagtgcaatgatggcaccttgaccgttgttcgaacttgctaatccgaggacagcaaaatccaatagaaaggaaagaaaacagtttgattctactaaacacaaggcgtta

SEQ ID NO: 86 - DNA, 3927 bp, Zea mays
tacaataactgaggtatgacacgggataactgagggattggagtagaataactgagttctgtcactcgaataactgagtgatgaacatggaataactcaaggcgcgcattagaataactgagtaccaacattagaataactgagttaggaacataactgagtgggcacattacaataactgaggtatgatacaggataactaagggattggagtagaataactgagtgcgtcgattagaataactgagtaatgaacgcacaataactgagtaacaaacatagaataactgagggatcagaaccaaacaactgagtgccgacaccagaataactgagtctacacaccataataactgagttagcccacaagaataactgaggtattggaacagaattactgagttctggcaccagaataactgagtgcgtccattagaagaactgagttgttggaacggaataactgagtcatgaacatataataactgagtaggcacattacaataactgaggtatgacacaggataactgagggattggagtagaataactgagttctgtcactcgaataactgagtgcgtcgtctagaataactgagtaatgaacgcacaatacctgagtaacgtacaaagaataactgagtgttgaacatggaataactgagggcgcgcattagaataactgagtaccgacattagaataactgagttaggaacatggaataactgcggtattataacataataactgagggtttagaataactgagttaagaacatggaataactaaggtattataacgaaataactgagggattggagtagaactgagttggcccacaagaactgaggcatgagcagagaataactgagttccatcactagaataactaggtgatgaacacagaataaccgagtactgaaccgagaataactgagaaatgaacatggaataactaagtgcgcccactagaattactgagtaccgactccagaataactgagacatgaacatggaataactgagtgcgcccactagaataactgagtcatgagcagagaataactgaggtattagaacggaataactaagggatcggagtagaataactgagttggcccacaagaataactgaggtattagtccagaataattgagtacgtccattagaataactgagttgttggaatgaaataactgagtggcgaacatggaataactgagttaatagaacgcaataactgactgtgaatagagaataacggagtccccactaccgagtgattacaaagagaataactgagtaatgagcagagaataagtgagtaggcacacgagaataactgagtcatcacaccagaataactatgtgcgcccattagaataactgagttctgacaaaagaataactgagtgacgaacatggaataactgagtcggcacatctcaataactgaggtattataacataataactgagggatcagaaccgaacaactgagtgccgacaccagaataactgagtctgtacacaataataactgagtgggcacattccaataactgaggtatgatgataactgaggcatcggaggagaataactgagttagcccacaagaataactaaggtattggaacggaattactgagttctgtcaccataataactgagtgcgtgcattagaagaactgagttgttggaacagaataactgagtaatgaacagataataactgaatagtgaacaatagaataactgagtgtgcacaacagaataactgagtaatgaacaatagcataactgagttacttgaacgcaataactgaatgtgaatagagaataactgagtaataaacaccgcataactgagtgggcacattacaataactgaggtatgatacaggataactgagggattggagtagaataactgagggatcagaaccgaacaactgagtgccgacaccagaataactgagtctgcacatcataatcactgagttagccgacaagaataactgaggtattggaacagaattactgagttctggcaccagaataactgagtgcgtccattagaagaactgagttgttggaacggaataactaagtcatgaacatataataactgagtaggcacattacaataactgaggtatgacacgggataactgagggattggagtagaataactgagttctgtcacttgaataactgagtggtgaacatggaataactcaaggcgcgcattagaataactgagtaccgacattagaataactgagttaggaacatggaataactgcggtattataacataataactgagggtttagaataactgaggtattataacggaataactgagggattggagtagaataactgagttggcccacaagaactgaggcacgagcagagaatagctgagtttcgtcaccagaataactgagtgatgaacacagaataaccgagtactgaaccgagaataactgagaaatgaacatggaataactaagtgcgcccactagaataactgagtgctgactccagaataactgagtcggaacagtagaataactgaggtattagaacggaataactaagtaatcagtagaataactgagttattagaacagaataactgagtgtgcacattagaataactgaggtagtagaacgtaataaccgagttccgtcaccagaataacttagtactgacaccagaataactgagttattagaatggaataactgagtaatgagtagagaataactgagtgtgcacattagaataactgaggtagtagaacgtaataactgagttccgtcaccagaataactgagtactgacacaagaataactgagtcgccacactagaataactgagttactggaacggaataattgacttgtgaacagagaataaccgagtgggtacgttacaataactgagttattataacggaataattgagggattggagtagaataactgagtcacgagaagaaaataaatgagtcggcccacaagaataactgaggtattagaatggaataactgagttctgacaccagactaactgagtgcgtccattagaataactgagtggcacataaataacttgcacatattacaataactgagttgcacatattagaataactattcagaataaaataactgagtggcacataaaacaactgagcgttcatcatagaataactgaatttggaacataaataagtgagcatccagtacaatataatcgagtggtggatctcgtcgaggtccaaatgacatcaccctacaaactctaagtagcctgacttggtagcagctgaggcagcctgtcatctgagccgactagtcctccttgcagcaatgaccaaccttttggccaggagagcgtcacggcggatggtggaggtgtgcccaatatgctgatggttacttcctccgtgctactacttgtgcgtagttgccacaatggaggtaaccaccagcacattggtcactagcaccccaagcccttctcagcataaaaagaacaaagtataaataactgacatggctacaaaagagaaataggcagaaaacaaaataagggcttactgctaaggctgcatgaacacgactacaccttcactccaaattcaatagctgcatcataccttccaaagagtccttaagttcttgttccttattttgtaatgcatcaatctccttcgtcagttcatccactatgtctcgcaagtcccccaacaaattcgtgatatattgaggaaaaaccggatgatgccattgaaagaaatcgcatctctctgggtcagactaatcacatctctctaggtcccgaccctaggttcccatctgcattcgacacgggagcctccttctagcgtggcttgtggccactt

SEQ ID NO: 87 - DNA, 3920 bp, Zea mays
aaataatacaattatgaactgggcacagaacagtgtaagcaaaattctactgaagcacacagatgacagatctacataagttattgcaaaatagaacagagtactaatcaggcagcaactttgaaggcaaaggaactaacagtaagcattgaaacttctagattatcctaagcttatgtcaaaaaaatgtgatcctaccaaaatactgccccaatttggaacaaataatgtctataaagcatacgcataccttaaatagaatatacagcataatatcaacaaacaaaaaagcaagtttcaaagaaatgatcatggctgtcaattagcactcgggttaattaaactgttgagcatatatcttcttcaatatttggtaagctgatccaaacttatttccatcaacaagtttttgcagcatgttgtgaatgattgtccaaaccacaggatgtcagaaaagcaacaaaaatcagtccaaattaattccagttatagcttaaatttgcacctcttattcgtagattctttgaagcgcccgagcatttgtatcatggaatcaacgcttatttgtccagagaacatgtgttgaaaatatgcattagcctctacttcaatgtcatctgaccctccctctgaattagtaagttctctcacaacagagctaggtttcctcgattcatacagagcacacaatttctttatttcatccagtattacatctgacaagagctgccccgagtgagattgaagaacctgaaaatgtgcatgacatgaatccatacttgtccccccccccaaaaaaaaatccaaaacagcaaaactgaaaaaaataataaccatgaccatacagacctttatgaagacacaacaagactcccaatataagtttttgacaatagattgaggttgtgacatgccctctaagacattatcagtgttgctcatagttgctttcaggaaatcaacacattcctgagtgtaggcgagttgagttaggaaagacaaaccttataatcaagcattgaaataaacgggtagtttgctaccagaattgaacaacatgatggatgtgggaagaggtcagctgaaatgtagcagcttacaagaatagattatgcatattacctcaacgaaaccttttccatataaagataacttttcagtcagccatttctcaagatgactatagtctttcctcaaggcagcagcagccaattttatagaaaatgcaaatggagtagaatcaaggacagaagacagaatctgtttaaagtagaaataaaagttgagtgaaacaaatttgtgagaaaatagtgttacagcattgaagtaatattgtagcatggtcccaataacaaacagatgaaaaaaaaagttactttcatgtggataagttttgatacgatacaatttcagaaaataaagtgcattcctcttatacaaaccttcaagtcatgacaaacatcaacagttcttagcaaacaatctggatcactatgagcatcaacaaaacctcgaagggtgaagtatgggtttgtatgccagagataattcataacattgtgctttgttggatccttcagtagagcaggaaatatgcaggacagtacttcatactgaaggagattatacacggtctgcaaagagacaaggggaatttatagcactgctaaaaacaaataaaaatagatgcgactcattatgtgggaccagaaatgcatacgtcgatgcagctaacaccaaaaagaaagagataaggggaacttaacactattaaagtcatgaaactagaggcaaacccattaggtgggaatagaaatacatacagtgacatggctaacaccaacaagtaagagttcagggcaatgtcccagtggatactcaagcattgatcgtacagatgtagcgtacccaacttcagctagttggcataaaacttctaaaaggtcaaggcaggaccaagcatgattgccttgactaggacctgccaaatcctgaaattcctacagtatatgacaactgttaggtgtgaattggatagaattttatcaagatgccagatgttgtcagaattaccaagtgcctggacgaatgagcaaatgtaaatttatcaggtgaagcagaaactgcatgcttcaagaacgatatctggccttctctgtttttccacaatgacccacaaacagcatgaagtggaaatggatcctgtataatccaattaatttattaagcagctagttgattttccaagaatagaaatgtttatatatacataccttgcaagcacgcgtgtatatagacatcaataggtaaaagcctgtttcatcaggtatattgaaaccctcgtgatcaagatattccattacacgcacccagtttgtacttggggcctgcgtgttaaagagagatagagcgtaagggtgcaagataaaaaaaagaacatccaataaaaaagcaagaagtcaatagcttacgagttcattgattgaatccacaagaacatctgcgttccatttagtcagctgagatgagtcgttcgtgtggctattaagaatagcagatacaaatgttgcatatctgttatgggcatctccaagaccactatgagtgccaacaacagccccaagcaacttagatatggcgacatcatcaagaggctcaacaatggaaagtatttccttacagcgagtgttgtcaacagtacatccataacccaactcagctacaatgtcagccatgcttatttctttcccgatttcagacagaagtgactcaaaatcatcatttgtgctacccaagtacatatccaaatgtctacatggcacaaaaaaagagggggagcatttgtgaataaataggaatgaagaagtacacatattcagaatttgattagtcagaaactgaataccttgaaagatttggttgtctatcaaaatctccattagtgacaggtgcaaaaaacggcctctctgtgacttttagtagagatacaacattatttaaagtgtccagatgcttcaacaggccatcatactgatgcagaaacacgacaatttcatgaatttgatcatttgatacagattggataggattcatgcacagctcttcaatttgagcaattgaaaaccattgccctggaacaagaggcaatgtcaatgatcatctgaaaataagagaagcggatatgatatcactagactcacagagaaatgtctacctttctgctttatctctgagttctcagaatctgagagcgcaagcccaacaccaattttctcggcaactgagagttccagcagatttgacagactttcaagaaaatcatccgtcaaggctattgttgtcagcacctcacaaaaactggttgtgaagcatgtcttgcgcaaacaatatctgaaaacatcagataaaagcctttgttgcaactgcaactggaggttcttgacctccccagcattcagcaacacttgattcagacatactcggagcaccaaaatgcatccatccaggccactgtcaactaactgaaaaggtggggaaaataattggaattagaaaacatcgagcagactcagtattcagtaattagaactaagatatgatcgaagccaaagaagaaactcattttatcaagcaagtaggtaaactgctctattttgcgaaactacagtaggtggttcaacgagaatttgaactaaaactgccaatgaaaaagtcaccacgagctctgtgattgaggaaatgaaatagatcagctagtgaagcgaatgagccttaactattcatacagagtttaagcgcggccataagtcccaaaaacccacttgtgttaacctaggtcgctagcgctgaacttgtggcctgcaactctaacaaatctaaactcagaatcgacaatcgtaccgttaaacgctaccatatcc

SEQ ID NO: 88 - DNA, 3918 bp, Zea mays
ttgtttatagtctagcatagagcaaattgtaattaaaattggaatgaatttttttctatacttaattttttgtaataaatatcattgatataactttaatagaataataacaaggaatcttaaaacatggatcgaaataaaagcagaattgcataaatatagctctcaactccggaaaattactgatctaaaaaatatacatgttgcactttaaacatttctaaagttacctcattcttcatatctacaaactctagtgccagcattggaacatccaatatcttgggccccaaactcatgctataggttgtcttgcaattgggttgatgatgaagcaattgaaacaacatgtttcatagctcacgcctatattaaattgaagatctgaaaaaatctacatgttgtgcttcaatcgcttttagagtcacatcatccttcatatgaacaaatctagtgctaacatgcgacaatctagggttgcatactcatgttatggttgtcttgaacatgggttaatgatggtatatgtgaaacaacacattgggtccgtccgtaaaaactgtctgtctaaacaatacaacatctagggcttcaaaatgcatcaaagttggcgcacatcagaaatcgatatatcatgcagcaaacttgtacgaatataatacccattagacccatactcatgttttgatcggtcttaaacttgggttgaagtgttcacaactaaggaacgttgcaaatagcacaatatatgttacatggtaacatgcctaaacaagtatgtcttttagaaaagagtaatgaaagtggaaatataaatttttccattaatagatgtcgtaactttgcaaaatagtttatcttgaaaaatctgcatattgcaattcaaatacttttaaagttacctcattctttaaaacattgaactttaatcgacatgtggccatctaattatgtgggtcccatactcaagttattgattgtgttgaattttagttgatggtggagcatgtgaaacatgttagatcattctataaatctaccacataatttagggctttgaaaagcttcaaagtttttgcatggttcatgccacaatcttttcgagaaaacatgcacgaaatcatgaccctttactcacaaatcattgtattgcgaaaacttttatgacaaaccttgttgggtcctttttgtgaaaactaccattctaaacattacatcatttagggctttgaaccgcttcaaacttacattaatgtccataaccatgaaacatttaaaaattttccacatatcttatgagataacatgcccaaacaagtgatgtttacagtttggcaataagcaaattgtaatgtaattttccttggttaaattgttttgtgataaatgtcatgagtcacataattgttttttgagtggcctcaaaacatgcattgttgtccataaccaagaatcatttcaaatagcactacatatggtttaagatagcatgcctaaactattgttgtttatagtctagcatagagaaaattgtaattaaaattggaatgaaaaattttctatattaattctttcgttataaatatcattgatataactttaatagaataataacaaagaatcgtaaaacatggatcaaaataaaagcataattgcataaatatagctctcaactccggaaaattaccgatctaaaaaatatacatgttgcactttaaacatttctaaagttacctcattcttcatatctacaaactatagtggcagcattcgaacatccaatatcttgggccccaaactcatgctataggttgtcctgcacttaggttgatgatgaagcatgtgaaacaacatgttgcatagctcatgcctgtagtaaattgatgatttgaaaaaaaatctacatgttgtgcttcaagcgcttttagagtcacctcatcctttatatgaccaaatctactgctagcatgcgacaatctagggtcgcatactcatgttatggttgtcttgaacatcggttaatgatggtgcatgcaaaacaacacgttgggtccatctataaaaactgtctgtttaaacaatacaacatttagggcttcaaaatgcttcgaagttgacgcacatcagaaatcgatatatcatgcaacaaacttgtacaaatataatacccatttgtcccatacatatgttttgatcggccttaaacttgggttgatgtattcacaactgaggaacattgcaaatagcactatatatgttttaaggtaacatgcttaaacaagtatgtcttatagtacgacatttagaaaagagtaatgaaagtataaatataaattttcttccattaactatttttccattaatagacatcgtaactctacaaaatagtttatcttgaaaaatctgcatattgcaattcaaatacttctaaagttacctcatcctttaaaacactaaactttaatcggcatgcgaccatctaattatgtgggtcccatactgaagttattgagtgtgttgaattttagttgttggtggagcgtgtgagacaacatgttggatcattctgtaaatctaccaaataatttagggcttcgaaaagctacaaagtttttgcagggttcacgccacaatcttttcgaaaaaacatgcacaaaatcatgacactttactcccaatcagtgtattgcgaaaacattgatgacaaatcttgttgggtcatttttgtaaaaactactgttccaaacattacgtcattaagggctttgaaccgctatgaacttacattaatgtccataacaatgaaacatttaaatctttccacatatcttatgagataacatgcctaaacaagtgatgtttacagtttggcaataaaaaaattgtaatgtaattttccttggttaaattgtattgtgataaatatcatgagtcccatacttgttttttgagtggcctcaaaacatgcactgttgttcataaccaagaatcattcaaaatagcactacaaatggtttaaaacagcatgccgaaactaatgttatttatagtctcgcataaagcaaattgtaattaaaattggaatgaaatttttttctatatttaattcttttgtaataaatatcattgacataattgtaatagaataataacaaagtatcttaaaacatggatcgaaataaaagaaaaattgcataaatatagctgtcaactatggaaaattaccggtcttaaaaatatacatgttgcactttaaacatttctgaagttacctcattcttcatatcaaacaaactctagtgccagcattcgaacatccaatatcttgggccccaaactcatgctataggttgtcttgcacttgggttgatgatgaagcatgtgaaacaacatgttggatagctcacgtctatattaaagtgatgatctgaataaaatctacaagttatgcttcaagcgcttctagagttacctcatccttcatatgaccaaatctagtgcaagcatgctgcaatctagggtcgcatactcatgttatggttgtcttgaacattggttaatgatggtgcatgaaaaacaataagttgggtccatccataaaaactatctatctaaacaatacaacatttagggcttcaaaatacatcgaagttgacgcacaccagaaatcaatatatcatgcagtaaacttatatgaaattaataatcattagtcccatactcatgttttgattgctcttaaacttgggttgatgtgttcacaactgaggaacattgccaataacactatatatgtttttaaggtaacatgcctaaagaagtatgtcttacagtacgacatttagaaaagagtaatgaaagtgcaaatataaattttcttccattaactatttttccattaatagaggtcataactct

SEQ ID NO: 89 - DNA, 3920 bp, Zea mays
tattatcatggccgattctaaaaaacatgcaagctacacacataaaggaatcataagaaacaacactgaaaaagtttcttgaacctatatatcatggtgatcgatgacaaaatttattaatggataatctgaacacacaaaagtgaataattattgattccactactcggctacaaatagcccaacatatcaaaaactcatctgtcacgacactgagaagattttgacatgttaacgccatccatttggtctttcagggcatccatccttttgcccaaagtgtttagttgtttgtggatgacataaacatctaccttggaaggagacatgtcatgccatggcgacgctggcggggacagcgatggtgtccttgatggcgcacgtgttgggggcatcggtggtggctggaatggcgcatgtcgtggcggtgtcgcttcatcttgttagtgaaacaatctctcaagtacatccaaattcttaggtggttcatttatcatatgcttgaaatcattgccacatttctaaaaatgaaacaaacgtataattagaatatatataatctggattcaatcaaagagagacagagaatacccttgtttttttaatatgcatcttgcggcttttcgtctcccccatgtttgaagagtggatacgatgcagaacatggtcatcatacaactgtttcatacggttccatctgtttatgagtgttttatttgaaattgttattgttgtcaccttataaagttttcccggcaaatattccagagctgtatcattcaaggtggattgcctctgctttatgatgccgatgtcaagcaagtcgacgcagcccctgcagaacacagtgtctatatccggataccagcggaacctaccctcatcttgggtcatattttccatctacaagaaaaaatgaaagaaatcacaaaaaaacatatacatataagctagcacatttactggtaagagagaggtacgtacgtaagaaaactcacataaaactgcgggtcacgactgaggtgtgactatctggaagcaaacttaagcgcaatgataataagctataacagcagggattctttttagatctatcgcgctgaaggccatgggaagtatattaatagaagcccctggtggcaatatgcatggcacacatacgccactccgcttcctctccctaatttgttccattcttatccaagcgaacaataatgatcgatcgagtcttgagatcgctcgcgcgggggaagcgcgcctcgctggcgactggcgagtgcgtcgactgcatgcatgctccatctgtgtgcatgcaagggaagtatattaatagaagccgccagtggcaatatgcatggcacacgtacgccactctgctttctgtccctaatttgttcagttcttatccaagcaaacaacaacgatccatcaagtcttgagatcgctcgcgggggaagtgcatgtcggtggcgactgtcgactgcgtcgactgcatgcatgctccatctgtgtgcatgcagccgctggttgtttttatttacgtgagtttgtttagcgccgatgctgcaaggaggtcgtctagctagtgcgtgtgtgcacgtcgtgtgcgtggccaggtcataatccggcgcgccaagtctcctgcttgcatgcgcgctgcagcacaatgtcggcggctctgttggtcgcatcgctcgtaccgccatgatgacaggtccgacgcatctgttgcacgccgctcgggcaccgcaccgagggtcttgtcattgcgactgatgtatttcgggctagcggacggggctggcccctcctctctctctctctcgatgccattgtgcgttgcgcatatgccgacctgggcctgacgcagtgagaatacacatgctgcatttcccttattcaaactaactgcgggaatagtccaagatgtagcaacataaacattctgctaattcaaaaacagacagagttgtgtattctttcttctttgtaaattgtagcaaggataattagatagagtttgtggaattgtggctgttgtatattaagttaggatctctatttgtatggagtttgtggagtatgtagtctaatttttttgttgatgcttatgagagttatgacctctattaatggaaaaatagttaatggaagaaaatttatatttgcactttcattactcttttctaaatgtcgtactgtaagacatacttctttaggcatgttaccttaaaaacatatatagtgttattggcaatgttcctcagttgtgaacacatcaacccaagtttaagaacaatcaaaacatgagtatgagactaatgattattaatttcatataagttgactacatgatatattgatttctggtgtgcgtcaacttcgatgtattttgaagccctaaatgttgtattgtttagatagatagtttttatggatggacccaacttattgtattgtttcgcatgcaccatcattaaccaatgttcaagacaaccataacatgagtatgcgaccctagattgcagcatgcttgcactagatttggtcatatgaaggatgaggtaactctagaagcgcttgaagcataacatgtagattttattcagatcatcactttactatagacgtgagctatccaacatgttgtttcacatgcttcatcatcaacccaagtgcaagacaacctatagcatgagtttgggcccaagatattggatgttcgaatgctggcactagagtttgtttgatatgaagaatgaggtaacttcagaaatgtttaaagtgcaacatgtatatttttaagatcggtaattttccagagttgagagctatatttatgcaatttttcttttatttcgatccatgttttaagatactttgttattattctattacaattatatcaatgatatttataacaaaagaattaaatatagaaaaaaatttcattccaattttaattacaatttgctttatgccagactataaataacattagtttaggcatgctgttttaaaccatttgtagtgctattttgaatgattcttggttatgaacaatagtgcatgttttgaggccactcaaaaaacaaatatgggactcatgatatttatcaaaatacaatttaaccaaggaaaattacattacaattttttattgccaaactgtaaacataacttgtttaggcatgttatctcataagatatgtggaaagatttaaatgtttcattgttatggacattaatgtaagttcgtagcagttcaaagcccttaatgacgtaatgtttggaacggtagtatttacaaaaatgacccaacaagatttgtcatcaatgttttcgcaatacactgattgggagtaaagtgtcatgattttgtgcatgttttttcgaaaagattgtggcatgaaccctacgaaaactttgtagctttttgaagccctaaattatttggtagatttacagaatgatccaacatgttgtcttacacgctccaccaacaactaaaattcaacacactcaataacttcagtatgggacccacataattagatggtcgcatgccgattaaggtttagtgttttaaaggatgaggtaactttagaagtatttgaattgcaatatgcagatttttcaagataaactattttgtagagttacggtgtctattaatggaaaaatagttaatggaagaaaatttatatttatactttcattactcttttctaaatgtcgtactataagacatacttgtttaagcatgttaccttaaaaacatatatagtgctatttgcaatgttcctcagttgtgaacacatcaacccaagtttaaggccgatcaaaacatgtgtatgggacaaatgggtattatattcgtacaagtttgctgcatgatatatcgatttctgatgtgtgtc

SEQ ID NO: 90 - DNA, 3867 bp, Zea mays
gtgctttaagtatagtagagaattatagatattgcataatatttgcgttgctacgattactttatattacataagtagactttgtttaaactcgtagttgtttaaacgtgttagaggtcttaggtctctatccaacatatcaattgtccataaaaataacaacaatgatactaccttcattcttttttatttgacgtcgaacagttcaaacttgcactaacaaacatcaaatataaaaaatcggagtactgtatagtaacagatgaacctaccttctctgaaatagtgagtgggtgatatgtgacatcaacagttttatcaagtccaataagtgcacgtttagtggcaccaaaacctttttagccattttctgcagaattaataagcccgtcttccaaaacttgataattttagtttagattttccaaagtacaattagcacagcttgctatggcacacgcacagggagctccacccacgaaaagtgtccacgagccactaaaatacacgctctagtcttcccagccacaatatacagttgcaaccgaactacatcaaatgacatggtctcaagagaagctgagttgcatttcgagccattcttgtttgaaatcaaataacaatcagtggtaaagtggtaattacaaatctaaaacgttaaaccccggtaagaaacaacaggggtcatcattgccaaccatcaaatcttgctgacatctcaaggcccatgcttattgtcttacttatcattagacattgcgtcatcaggggctgcacaaacaaaactgtcacggatgtgtaataaaaactttggaagaggcaaaaagatactttggtatataattgaccactcctccatgcactacatgaatcagtgagcaataaaaggattttacagtgcaatggctaccttgtttgctcccattacaacagcatgcaaagaattcctctaacggacgtttaggaacaggaataagcttcccccacgaatgctagcggccagcttcaaagcaataagagagtgatcaggcgcaatagagggaaagaaacatgtcatgattctaccaagagctactctatttcatcagcattcagcaagcatatggaaatctgacctgaaaaaagcaagacctgtcgataccaaccacaactgccaacttagccttagcccttactgttgaggcaaacttgccaaggaaatcaacgataagagcctaaacatatacagaaacaaaagaacatgagaacaaaaactggtatggctatgatgccaataaacagatggttccctaaaatgcccttgaatatattcagctcatctagttcacgcaaatcgaatttgttgaacacctaagacaaaaatacacgtcaggccattactgtatttgttgtataaagctctagagtcacattagacaaaaaaaggcacaaacttcttttctaagcaaaagctaaagcataggacctggcagagaacaaatgtgttgaatatgaaggtattttcactttatctggatgtgttggatcatcatttttcagctgtaggaggcttattcccttgaagttgagagtgagaactgaaacttgaaacaaagcctgaacaaagaacaagtgtttagtaggaagatctataatatgaaatatagaataaagcagcagcatatatatcataccatgataatcaagtttctccacatgatatttgtaatcaatggctccctgaaaaggtgatgagaaaacaattagcactgctaacacatatatttttgacacttcaataacagtatacagaggtaagcactaacataaatttgatgcgggaatggtctagcaactaaaattaccaagaatcttatatttacaatctaatgcaaaatacttcatctgatcacaaaaatgtaggtccatttaagtttgtcgtaattcaatatcaccaataattaaaatttcaaatagattggcaacataagactgatgctagcagattcgttataaaaaatattttcgttttctatttggaatttataagtattgctgattattgtattagagaccatgcatgtcaatgtccaattgatttgtgtaagagaaagtagtgtgcccgtgcgtcattactttcttcccttatcacatgcttgaaattattgagttcagcaaagtcatcaccgtacaccatcttgatgttatccacacaagcactaagaatacatgcagatatgtaaaccaggaaagatagcagacctggcaagcttcccggtctgtgtggcacgcaaagaagtcatcaaatacctttggttccaccctgcagaaggaaggtcggtctaccatcgatcactatacatcggctagaacacgcctgaaatttgcgtcgcacaaagtttatcgacatcattattgagccgttaataagcagcattatccaccacctctacacgcccaatgccatcagtgagtacctatacaagcaaaaggggggaggtgctgaaccgtagccccagttttagccactcgccgcagacgcaagagagagacgaagccttagaacttcaagcaccaaagaaacctgagaaatcacaaaatacacaatcatgtttcaacaggtctacagaccccggccccacgaaccatataggattggatcacttgacagggaattatcacaaaatacacaagcatgtttcaacaggtgtacaccctaaacaatatcacaataattacacattcatataacaagaaacaatagtaacaagaaaaaacctgccaatccaaaagtatgcacacaacaggtatatatgttgtgcgaaagccagggagcagaagtggcgggggacaacagtgtatttagaaggaggtggagtggggactgtgaactgctcctgaatgctgtaattgctcctgaaggagttagttatgacgtacgaccgttgaaagacgcacacgcgtatgtataggccatcagtatggttgttctcaatatatgccacagcgtcggtgctcgcccgtgtctcggctgcgttcaatgccccagaaactttggggtccatatcgatggtaaatccctctttcctcatggattcataagacgggtcggcggcttagtgtctcacattcagtcgcgacgggattttccagggcacttggtcgtggaagggcttcttattgcagtcatcgtgtttcagctctccaggaagagctacagaaaccactcactgaaaaggtcaggttgttcttctcgttcgtaactactagaaccagacaattcttaatactggaaagtattgttctcgatcgtcgcctgttcatgaagcatatgtgtcactgaatgccagcattttgtctctgcaggagattgatgagctatgtgatgagtgggagccagagccgctattatatgccctccagtaaaggagggggctcgaagtgatactacattggtattggaaatttagcagcctaaggaagtaaattcacaattaaatagggtacgctgtggttgttgttgcatgagtaaccctactacatatcatttcatatctatatatggattaactaataagtgatctcactcttgaagttgtgggagcgttggtccagttctagcttatactagtttcacttaacttaatagtgccatgtgtgggacctattatattgttttggaacgtttacttgctagattatatgacatttaaaccatgtatttatgaataagcagcaagggacacattgaaccacaaagaatttcattttcccttgctacccaaatgtctacatagctacatgtgagagaggattgattggtacagtaaaacctaaccctagctacagtacaggtaacatagagacccctaatgggccaggcccatg

SEQ ID NO: 91 - DNA, 3851 bp, Zea mays
ttatcccttaaatccgggtgtgacagaaccgaaagtctggctgtctcgtccagtatctcgactcctagtctgccatcctttatggactactagtccacaatcctctatgggcattgtaacagagtgaggttggtgaatgacaaatgtttgccttgtggagaaatcatacttaagaatttcgactctacgacatcacagatatagttaatgagtgggacatgttaagagaaaagaatttgatgtaatcgatattacgacatcacagatatagttaacgggcgagacatgtccttttgaggattttcaaaggtttctttactagtggacgtactcaagctagaacattgctcctcggcaccaccaacaatcttaatttcctctaagggtacttcttcaatattagggaactgggaataataagaatggagcatgtggtgaatttcctcccttcttcctaatcgttcatcttccatatccatgtcaactaaatcctgcaaaatcacaaggcaacaataaatgccatacgagaagagagatactcactctcatgacaaactctagccatcaattattattctatgctctagtaaacctagtcacatctccacattatcgttttggaaaggaacatttcacattatattaaggaactaatattacctgtgttggaatagtcttgaataacagaagactccttttatagtaaaggtgaaatgaaagagtacagatgataagaggtatggtcaagcatacagccactcgcgattctttaatttcaaatacaccagcacagatgatctgggtgagcacgagagagaatatgattgtgttgtgtgcaattggccaatacaatcctcctgtatcagaccttgttcgataaacattgagaaactgaaaaagaacacatggtacattagcatgaatggacaaatttcagggtaagtaagaaaataaaatatagtatctaggttctcacttgattgcggtatacaacacgaccaaggtaaaagtatactagcaggaaaggtaaaatcataggagccaccacagagcatgtgaagcccaatagtccaaacaatagaacttttggcacttcctgctgataggggaatgtgggaacagattctgtatcttctctatattctccctttctcaaaatatatttccttataaagctcattatcagattatagaactgcaaaagttcggatgataaactagcccatcccgaggtcataacataggtgatgaagaaggtagcctgcaataaaaaataaaatcacagaaaagaaacagaaatggtagatgaaaattaaatacacaaaaccaatatattatctttccataaagaaaagggaaggtgtgttaaacctgtctagttaaagctctagcaagcttgacaggaatgtcctttgggcttaataacaaattcaattgactcatgaatgtaccggatagtacattaacaaagaatatgttccaaactatgaagcacaacagtttaaagcaagcactcctcttccttgcactgtgagatgtggcaccttccaatttagaaactttcatcatcaatgtcccaacaatatatagaataatttgttggatcacactaggaaggtatcccgttattaggttagtcatgtagtttttcctgcaaataggccgagtaatatatattcaataggtgcaatatggagacaggtcaaatggatagtatatatatttgtagcgatataagatcacacatctatcgagatagcccaactgaagtttcagtacttacttctccaacctttcttttaaggaagcaggcatcaactgttgcagctgctctgggtcagatagtgattgtatacacaccatcggcatcaaaagtaagaatgcaaaaataatacagcctggaactagtgttgatttacgacacctgttggattgccaaagattggaccaatacacgtcttctggttctggagccagactagtaacccatttcagtgggttagatgtctgcaccatatttgaggcagtaactgcatcatagcgagttttgaaaaatacaaaagcagttgcgcattcctgctgcatgtaattccacatagaaattactatccatattattactgctaaattaagcaattaacaaatgcatgcatgcaagaattttaacctcgtgatctaagtttatggtggattcttcattgtcagggttccccttgttttgctcgccttcagagttaaacttggaagaatttggagagggtggtcccatgaaacaactgttggtggttgtcgtcctaaatccctgactgccgatttcagctatgaaatgtttgaacttcttatgtgccgtcttagtgccagtctgtcagataaattaaagacaccaaaaccaagaggttaaatacaaacacgcataaggaaagaaaaaccattcaacactggaggaactagacatttgttcacttgttcatgtcaaaaagacaaaaacaattatgagaaaacctagctaatcatgagatgaagtattaattatacttcacttagaatatataatagtaaatgttcttcactagtaaaagagaaatgcatgcattgagtacaagctagataccattatcttatggacatgcccaactttgtagacaatttgatggaagagataactagacgagtgatactttgtgaagaaatttccaacagcatcactgtatgattctttagctgtctttggtatttcacgaacaaggagtgcaaattggcttggatttagcgttgaccttttgagataaagggacctcaacgtggcaatgtgcttcccctcctgcattgaagggaaaaaacagatcagtagaaaacgttccaactacaaggagatggagcctttcaacaattcaaatgcgaaacaaacttacaatgtacagaagtaagcatgttactccagaaattatgtatagcaccgcacaatggatcaagaggctgcatgcaaggaatcatcaaaacatgcactttgttattttctacactgcacattcttccttaagttctaaagaagtgaatgaagaagcatggtggatgaattaatcaaggtagaaaacacttgtaagatgtcggtaactatcacaatatatatatataattcgaaaacacaacatttcaacagttgataataaattaaaagagagagagaaactttgctcggcttaccattttgatccatgtttcacattcgatactgtaaatgcatccattcgttctgaaggaattgaaacatgttgtgtattctgtccaaaataataattgactggaagaattcccaagagacccagaagtgtagcaacggagaagatgcgtatgctgttgaatacgtaaattaatatatgtgtttcagtctctgccaatttggttgctggggatggacatatgaactagtatgaatgcttgatgacaaaggggacaaggaggtgaaaagaaagttttgcatactgtacctgaatactataattctatcaaaaacaactgcatccaacctagcagcatctaagagctcttcctcggtacactgcagggctttcactacccagccagtcgatggaacaaacctttcaaagttacaaccccctcggagccgactgtattgctcagcaattctgcgtccgaagtaaatcttgacaatggcccgttgatttctcaaaacagagtagaacattaggaagaggacacagatgccaatgttgatgcccacagatgtcacaagcccgctgaactccatcttgtcagcagtggcggagctagcccgcaataggagcctaggcaccattataaaatttctaaaattaatttacgcaaagatt

SEQ ID NO: 92 - DNA, 3825 bp, Zea mays
taaattttttttgcataatgttgatgagttgcaattgggtgccaaatgaaggatgatgaaattgttagactacaaatagtggcgacaaatgccaaaaagaggatgttgtttcttgaggatgagctgcaaaaattgttgtctttggtcaaggataaagatcttgaaactttataaaaataaaatcaaccagagactaaaatgcaagatttagttgctgtctagattaactaatccaaacgaggcctaactatatgaataggtggttagcaggttactaggttcttattgggtgagaaacttttgatgccggtggattttgctatgtgagtaaaccctgaatcatgtcacatccactcttctcaagactaaacacaagagttaggtgcagattagtttaactgtggcctatataaaataatgtgtactaacttgttctctatagaaaattttttagtgatctcgtggaccaaaagttagacgaaaagttacctacttctccacaagaaagttgcaattaataacatgcatgttggtcaaactgaccactcagacccaattgcagcaagatttggcacacggacgaactgcaaacataaatgaacagtcaggactcacaaaatcaataggcttgtgctattgctctctctctctcactcaccgagaagacatgtacacaactctctatcttgtgagtattaggagcatcgtcttgctagctttctcctaccagagcaccacactttctcatagcactagatggcacatcattgatggatccctacatacaacgctagcacccattaaataaatagaagtagacgacgacatgcctagaaactacacctctcgtctcgtctgggccacatgatgcacgcgtcttaccatgagaagtggtcactactgcaggccaaccgtacatgtctctccaaacataggctgcactagagcgcgttcttcaactagtggacgcaagactcgcactaaatggaggcatggtctgcatgcacaaggcgctagcccgcacgcctcctccattgctccatgatatggggcgcgtcctttggctctgcaatccacctgaaccgctccactttttcatgtactcatcgttaaactccagcaggtttcatataaactcatgcatagtactagtatatggcatggcactccggtcgaaatccaggactgatggtctgatgtgctgcacgcatgttaggtaggcttcacacatcagtcgtgcttgcttgttcgtggagctagcttgctagcctttccctttctggtgttcttgcacctagctacagcagatcacgagagctttcaagcccgttgtatgtgctagaggccagaggctcttcgtagctccatctgaaaaaggctgcagcaggaaatgacttttgatcgagccgctactgctggtgcttcatctcttaggctctctattgatccatatcaatgtttggcactagtacggcgcggtcgtcagcaccacacacaacacagttcgatcctagtgtaatgtaacacccctggtgtttatattctgctcgacaacgagtatgaatttaagcacgtaatatcagtggataaaacggatgccaaattttaattattttcgtttatcgcgattttaatatcgcatctgtttcgtttgtcgcgagtgagatatcgtttttatttttatctatccgggctcttcctaaatttttgtgatgttcggaacatagtcatttcgaaaatcggagcgtcccatggttatttaaaattcatcgctcgcgcgaatacgaattcggaagcccgccccactttgatgattttattccgagcaaattagtttgaactggacaactaaaatgttcggggtaaaataattcgaatcgcgtgaaatcttgcacgaggttatgacccaatttttcctccagcacgttgttttggcgagcgtaagagtaataattgggcctcttttttctagtgtgttgtcttcggcagagtaatcgagtgcttgattagtggatgagattattaggttagacgagttaagccccgactaaatactgacgccaaaatctgtctaattcggtctatttgcatcctgtccgaagcaaaccaaaccactataattagtactgacagcaagtaattggtaaatgatttagtttgctaaaacattagaatgagatatgtagcccgtatcatcgaccctttaatcatcgctaaaaaaattacgtgttcatctcccttcattccttatcttgagtccgtgcttttctccggaaatatcccacagccctctattcctatgatctaattatctttatgtattcatttaagaaaatgggggataatccccttttcttctcaaccccacgtcatcccctcccaaggcttttagccttaccttctgttgatattatcttcagccggtacaagttcacaggtcacgtacatctcctagacgctagaaactttcctacgacatcctcttccttatccgcgtgcatgtttcctgctcatctccctatcatgtccaggctgtaggagcccccagcaagccacgtgctcccctcgcctaggtgcctggccgcgtgcccttcccatcgttctcctagccgccgctgggtatctccctcacacgctgatcttatcctcagctgtactcgacctccctaccgccgttcgtcgagcccctgttccgagctcgccgggcctcaccactacctcgccgtcacgctactggccagcaacactcgatcctggccgccatcgccgcactgcgcgtcgtgcacttgggctggccacctctgcgtgtggcctcgccggacaacaccgtcgtctgcaagctcaaaactgacatcgatccagtcgtcgtagctccgctgtcatggccgatctcggtttcatccgtgacaccgactgtcgacctcgtcgttgcctcacagcactcggacaccgctgtcgtcactcagccccgtgttcactcgtcaccacgccatcttcagcatcacagttctgcaggactccacgcactcgtcgacacccggctgccaatctccaccacgcagcgccactccggaccttcggccgtgttctcctctgctccaactcacgtccatgcccagaacgagctcgcgcacgtcgtcggagtcgctcaactcacccatcgcgcctaggccggtcgccattctgttcttcataagtcgtgctttggacgtcgtcgttgtttcttgttctcgcctcgacagaaccacgtccatgactcagccgttccaataatttcaccgcgccgcccttcaagttcgttgtcctcatccgcagaatcgtcgttgacctcgcggattcgggtcgagtttagttatggtgagttgattcgttattcccgtcaactagatagatggttcgattaaatagatgtatcgattgcgatgattctcttgtctattacttgatgcggaggttaaagttgaattttaggtttatgtgataagtatattggtaaatatatatgtggtgtgatgattgtctacttgatagattaagtatagtgtgatgttttattagtttggatattataaaggttaattcaaaagagtggtttaaatagttagttaagttgcttctgtccatagttctagtttggtgtcccaaaataatgagcctaagtctcgttcactttttggtgtgttctatagctaaggttgatataatacttgtgcttagtttattatcgcttgctgcttgaattggattcggttaagttaaaataacgtggacgttgtacttagtaatatcttgacatctagtttttttttcttttaagtgttatta

SEQ ID NO: 93 - DNA, 3814 bp, Zea mays
ttacacactgcccaccctactaattattacaatttattactttacatgacctactaattattacaatttattactttacatggcatgctaaatcatgaatatattttatttgggatgaatagatggaacaggaccaacgaacaacactaaagtcgtgtacactaaatcaagagaggcgaactttgtagccaattttgctaacaatataataatgatgattggttacaaaccgaatgttacacacatcacactaaaaaaatgttttttcatagaatacatatctaaactttaattatcgtgttataatttttttgcaatagcaacgcacatgtacgatcgtaataagctaaaaaaatgctaaaaagagtctgctacaccatattcgatctcgtgcaataagcaacccccggaagttcccaacaatgcagccctacgtgtctctcaccaggtcaggtgtcccatatcatgacgacggcgatgacagccacgccgaacacgacggcgagccacctaccgaccggcgtgtcgacggcgacgggcctctggggccggtaccctttggagaggaggtggttgatggagacgtagacgaagatgcccgtggcgaggcccatggagacggcgaagatccagtcggccacccggccctgcgtggtggcgtcgataatgatgccgatgccgacgccgacggggctggagatggcgaacgcgaaggcgtaggcgaagcaggagaggaggggccggttgggcagcatccggagcagcgcgatgcccatggcgatggccgcgaagatcttgtgcaggcttatggtccacagcgccttccatgcgtcggccttggtctctgcaggttcgataattagtagtagttaggtaataaggccagacagagtctcagagagctgctagcgcttagcgatgctctgcagctgttaacctcgaccaagaattggagacgctatgtttacgagaaactcagcctctccgtttaaattgattaattaaaatgggttccgaaatgctaacgaatagcacttgaaatgccttcagaattcaagtgaaatggtaatcttgacattcggaacaagtaaaaaagtatgcattcgaagagaacttgaaggccatatatcaggaagagaaagaacttcagagcgtccggatagacatttaaacctaagatcagaacaagtagaaaagtatgcatggcaacgactggactgaaccgttgcgcggaaaaaaaatatcaggaaaggtcagcaaagaagggttggaatgatgaatgatcagcctattattctggctgtgctgagtctgtaggctcctttcgctctgaccgaacagcgagacactagtgcagctttgacaaaaagagcaggttcagattccacttggtcttagtcacgaccacgacatctgtcactggaatcgagctaagaactaacgtaaccggtgttcagttgagacttcagacttgcaggtatatatgtcatacctacatgccataacatctcatttatacctaaagctgggcatctaatcctctactccgtactcagacgaagctaagttcgtcagtttagcccgtgacatgatggcgacatctgctgataagagtagacccggaatgcacataaaggaatttctacgcgtcatctgcaagttggaagggaacaaaacaacgcatccatatatccctatctctatctggcttagccttaccggcgatcccgatggcgatgccctcgaagacggagtggaagcaaagggctactatgagcagcacgctgtcaccgatcgtgctcgcgttgcgcagaatggatgcggccgagtgatcagatccgtgtgcatcctgcacgccaaagcacaagtaatggtgacaaataagattctgtacactgaccggccggccgtaagatactgctagtgctgttctttttaactgtcttttattgggagtggactgtactatatggttgttgcaagagcaggtattgccatgatcaaataatgaattcagaagctgaagcaggttgtagtaacttacagctggtgtgggctcagacctcgtgccatttgcggttctcatcttgccctcctccagccctattgaaagtgtcaaaaggagaaaatgaatcgtacaagtataataggcttcctaaagctttaatacagagaaaatatgacaatggaaatacagtgctgtagagagggacagacagacttcccctgatgactgactattcagagttgagcatatagactgattacacgcagaactgccagtttgtcacaaataaaactctaactaaatgatccattaagactgattccacgtaaagtttttttttttggtttcgatccactactctaactaaatgatccattaatcaatctcgctacatgttgattggctgaaggaaaataaaactctcaagaacaggattactgcaaactgcaatgaacccgaactttcagtcgccttgtacgtgataatgcaacgtgcaaccagaccaaaagcattggcaacagttggtttaccttaggcagtggtgtactactacagcaatataggattagtagttcgcgacgaaaagagtaaatctatcccaagaggcaagaacacactaacacagacctccaccaatctgaatttgcagcccgtgctagttgcacccacccggcgacaggaaaaagtggtgtgcgcattcaacccaaccccggatcccccagtcgttgtggcggcattcacagtaatcagtacaccgcccagcccaactgcccaaccccaactgttacaagccagaacagaacgaacgggagtcggtactgacacgtgactcttgttactgacctgcatcagaaccgccggtagcggcggtgccggtgctgcgcccctgtgaccgtgagacgacgtaggagatggcgacgtcggcgagcatggtgacgacgtaaccggcgcaggcgagcatgaacgcccaggggtacccgctgtcggggagcaggtccccaaacgtctcgtttgcgtcgctgaggaagtgcatgagcgccgtgccgaggaagacgccgcccgcgaactgcgtgcccagcgcgaggaacgcctcgttccagcgcatgaagtagggggacaccccgcccagcagcgtgccgacgaacaccaccgccaggcaccacagcttggcctccaccaggctccgcgcgcgcaggtccggcctggcggcggcgcccccatccgcgtcggcgtcggcgtcggcgtcggagtccccgcctccgccgtgcgcccacgcggcggccgcgagggagaggcagaggaggaggcggaggcggtggtggtgctgggcgttggtggcgcgggccatggcgcgggaccgcgagcgaggaggccgtggactcgtgacccgggaaatggtaggcggacgccggacgcggggcggatttgggtttattctcggtacgatgcgaggcgaggcggggggccggagggcttggagatggctggcgtgtggggccggagggctttgtagtttgtagtactacagcaggagccgggacggatcctcggagttggggttttttttttactcgatcgtttgcatcgttggacactgacaaggtagggtaggctgttgtgggcagctacagaagcaacgacgcggtacaggaagcaggtgaacgtgcgatagctggtagtacaattgtaccagccagacaaggccgcgccagtttcgttgtgtcgtgcagatagtgacaggatttggaaagtcccattgcacctcccttccctcttctttgtttctagaggtagaaatacacgagg

SEQ ID NO: 94 - DNA, 3812 bp, Zea mays
ccgaaagtctggttgtctcatccagtatcacgactcctagtctgccatcctttatggactactagtccacaatcctctatgggcattgtaatagagtgaggttggtgaatgacaaatgtttgccatgtggagaaatcatacttaagaatttcgactctacgacatcacagatatagttaatggatgggacatgttgagaggaaagaatttgatgtaatcgacattacgacatcacagatatagttaacgggcgagacatgtccttttgaggatttttagaggttttttactagtggacgtactcaagctagaacattgctcctcgccaccaccaacaatcttaatttcctctaagggtacttcttcaatattagggaactaggaataataagaatggagtatgtggtgaatttcctcccttcttcctaatcattcatctaccatatccatgtcaactaaatcctgcaaaatcacaaggcaacaataaatgccataagagaagagagctactcactctcatgataaactctagccatcaattattattctatgctctagtaaacctagtcacatctccacatgatcgttttggaaaggaacatttcacattatattaaggaattaatattacctgtgttggaatagtcttgaataatagaagactctttttatagtaaaggtgaaatgaaagagtagagatgataagaggtatggtcaagcatacagccacccgcgattcattaatgtcaaatacaccagcacatatgatctgggtgagcacgagagagaatatgattgtgttgtgtgcaattggccaatataatcctcctgtgtcagaccttgttcgataaacattgagaaactgaaaaagaacacatggtacattagcatgaatggacaaatttcatggtaagtaagaaaataaaatatagtatctaggttctcacttgattgcagtatacaacacgaccaaggtaaaagtataccagcaggaaaggtaaaatcacaggagccaccacagagcatctgaagcccaatagtccaaacaatagaacttttggcacttcatgctgataggggaatgtgggaacatattttgtatcttctctatattctccctttctcaaaatatatttccttataaagatcattatcagattatagaactacaaaagttcgaatgataaactagccaatcccgaggtcataacataggtgatgaagaaggtagcctgcaataaaaaataaaatcacagaaaagaaacagaaatgttagatgaaaattaaatacacaaaatcaatatattatctttacataaagaaaagggaaggtgtgttaaacctgtctagttaaagctctagcaagcttgacagaaatgtcctttgggcttaataacaaattcaattcactcatgaatgtaccgcatagtacattaacaaataatatgttccaaactatgaagcacaacagtttaaagcaagcactcctcttccttgcactatgagatgtggcaccttccaatatagaaactttcatcatcaatgtcccaacaatatacagaataatttgttggatcacactaggaaggtatcccgttactaggttagtcatgtagtttttcctgcaaatatgccgagtaatatatattcaataggtgcaatatggagacaggtcaaatggatagtatatatatttgtagcgacataagatcccacatctatcgagatagcccaactgaagtttcagtacttacttctccaacctttcttttaaggaaacaggaatcaactgttgcagctgctctgggtcagatagtgattgtatacacaccattggcatcaaaagtaataatgcaaaaataatacagcctagaactagtgttgatttacgacgcttgttggattgccaaagattggaccaatacacgtcttctggttctggagccagactagtaacccatttcagtgggttagatgtctgcaccatatttgaggcagtaactgcgtcatagcgagttttgaaaaatacaaaagcagttgcgcattcctgctgcatataattccacatagaaattactatccatattattactgctaaattaagcaattaacaaatgcatgaatgcaagaattttaacctcgtgatctaagttcatggtggattcttcattgttaggattccccttgttttgctcgccttcatagttaaacttggaagaatttggagagggtggtcccgtgaaacaactattggtggttgtcttcctaaatccctgactgtcgatttcagcaatgaaatgtttgaaattcttatgtgccgtcttagtgccagtctgtcagataaattaaagacgccaaaaccaagaggttaaatacaaacacgcataaggaaaggaaaaaacattcaacactgaaggaactggacatttgttcacttgttcatgtcaaaaagacaaaaaattatgagaaaacctagctactcatgagatgaagaagtcttaattatacttcccttagaatatataatagtaaatgttcttcattcgtaaaagagaaatgcatgcattgagtacaagctagattccattatcttatggacatgcccaactttgtagacaatttgatggaagagataactagacgagtgatactttgtgaagaaatttccaatagcatcactgtatgattctttagctgtctttggtatttcacgaacaaggagttcaaattggcttggatttagcgtttaccttttgagataaagggacctcaacgtggcaatgtgcttcccctcctacattgaagggaaaaacagatcagcagaaaacgttccaactacaaggagatggagcctttcaacaattcaaatgtgaaacaaacttacaatgtacaaaagtaagcatgttactccagaaattatgtatagcaccacacaatggatcaagaggctgcatgcaaggaatcatcaaaacatgcactttgttatattctacactactcattcttcctcaagttctaaagaagtgaatgaagaagcatggtggatgaattaatcaaggtagaaaacacttgtaagatgtcggtaactatcacaacatatatatatatataattcaaaaacacaacatttcaacagttgataataaattaaaagagagagacaaactttgctcggcttacaattttgatccatgtttcacattcgatactgtaaatgcatccattcgttctgaaggaattgaaatatgttgtgtattctgtccaaaataataattgactggaagaattcccaaaagacccagaagtttagcaacagagaagaggcgtatgctgttgaatatgtaaattaatatatgtgttttagtctctgccaatttggttgctggggatggacatatgaaccagtatgaatgcttgatgacaaaggggacaaggaggtgaaaagaaagttttgcatatagtacctgaatactataattctatcaaaaacaactgcatccaacctagcagcatctaagagctcttcctcggtacactacagggctttcactacccagccagacgatggaacaaacctttcaaagttacaaccctctcggagctgactgtattactcagcaattctgcgtccgaaataaatcttgacattggcccgttgatttctcaaaacagagtagagcatcaggaagaggacatagatgccaatgttgatgcccacagaggtcacaagcccgctgaactccatcttgtcagcagtggtagagctagcccgcaataggagcctaggcaccattataaaatttctaaaatta

SEQ ID NO: 95 - DNA, 3780 bp, Zea mays
  misc_feature (641)..(642): n is a, c, g, or t
  misc_feature (2046)..(2048): n is a, c, g, or t
ccttctaaaaaccgggtgtgacacttcagtagcccactttacctgtaagttctttctcttaatggtcccaccgtaaccttctatcattgtcttaagttgtttccacacaaaattcttttttgtttgttatgctgaaatttcattgtgcttatataaccttaggatcttgtaagctttatttagtttcttaatctcttccgtaatatcttctccttttttgggatccgaattttcaataataatctatgaaataaagtttagtctcgacaattcggatcaccaaaaaagtgaggaagatattaggtaagagataacgaaactaaaggaagcttccaagatcatgagattagataaggacaatgaaaattcggcataactagcggaaaagaattttgtgtggaaccagcttaagacagtggaagaaggttacagtgggaccattaagaggaagaacatagatgtaaagcaggctactgaaagccgctaaaaagcttttgcataatgtttatgagctgtaattgggtgccaaaaagaaggatgatcaaaattttaaactagaaatagtggcgacaaattccaaagagaggatgtcatttcttgaagatgagctgcaaaaattgtcgtctttggtcaaggataannatcttgaaacttataaaaataaaatcaaccagagactaaaatgcaagatatagttgtagtccagattaacaatccaaatgaggcctaactatatgaataggtggttagcaggttactaggttcttattgggtgagaaacttctgatattggtggattttgctatgtgggtaaacctaaatcatgtcacatccacccttctagagactaaacacaagagttaggtgcagtttagtttaactagtccaattgaggtccaactatatgaactttgtgacatatggttagcaggttactggggtgttattggttgagaaacttctgaggctggtcgattttttatgtgtgtaaaacctcaatcatatcacatccactcgtaagaagactcggttgtattcctattaatagaaatgggtgtctctaagaaatgtggactaacttgatatttatagacaagtttggtggtctcgtgggcaatttactctagcaggccccaaaagtgaaacaacaagttacctacttctccacaagaaagtagcaatcaataacatgcatgtttgtcaaactgaccactgcgacccgattgcagcaagagcgcacgacagttcctaatgcacgagacccaatttgcacgatacaccataagggtgaaaattaagtcagatgtatgatcgcatgtaaaagcgagattaatttccaggcctgctctgacggtataaacaagtgacactatattttttagacctgctaaccacctgtcataaaggtgatatagttaggcctcatttgaatcagctaaactcgactgtagctaactcttgtgttttagtgtctttgttgatcttaatttttattagtttcaagatctttatgcttaacaaaagagaacaattttcgcagtgcatccacaacaaatggcatactatctttggcatttgtcgccactacttgtagtctaacaatttcatcatcctttatttgggctcccacttgcagctcatcagcattatgcaaaagtttttgagctgcttcagtaccccgttttacctgtaagttcttcctcttaatggtcccaccataacattcttccattgtcttaagttgtttccacacataatttttttcgtttgttatgctggaattttattgtgcttctctaatcttaggatatggtaagctttctttagtttcttaatctcttccctaataactattctaattttctggggatccaaattgtcaatactaatatatgaaataaagtttagtcccaacaattcggatcaccaaaaaagtgaggaagatattaggtaagagataataaaactaaagaaagcttccaatatcatgagatcagaggacagtgaaaattcagcataatagacaaaaaagaattttgtgtggannnagcttaagacaatggaagaagattacactgggaccattaagaggaagaaaatagaggtaaagcaggctactgaagccactaaatagtttttgcataatgttgatgagttgcaattaggtgcccaaaagaaggatgatgaaattgttagactacaaataatggcggcaaatgacaaagagaggatgtcctttcctctttaggatgagctgcaaaaattgtcgtctttggtcaaggataaagatcttgaaactttataaaaataaaatcatccagggactaaaatgcaagatttagttgtagtccaaattaactaatccaaatgaggcctaactataagaataggtggttagcaggttactaggttcttattgggtgagaaacttctgatgctgatggattttgctatgtgggttaaacctgaatcatgtcacatccactcttctagagactaagcacttgagttaggtgcagtttagtttaactgcggcctatatataaaaaatgtggactaacttggtctctatagacaagtttttagtgatcttgtgggccaaaagttagacgaaaagttaccttcttctccatgagaaattagtaatcaataacatgcatgttggtcaaactatccactgagacccgattgcatcaagatctggcacacggacgaacttcagacagaaatgcaccatcaggactcacaaaatcaataggcctgctctcttgctctctctctctctcacccgagaagacacgtgcacaactctctatcctgtgactattaggagcatcgtcttgctagctttctcctaccagggcaccacactttcacagagcactagatggaacatcattgatggatccctacatacaacgctagcacccattaaataaacacaagtagacgatgacaggcccagaaactgcacctctcgtctcgttcgagccacatgatgtacacgtcttgccatgagaagcggtcacaactgcaggacaaccgtacgcgtctcaccatgcatagaccacactagagcatgttatcctactggtggacacaagactcgcattagctgtaggcttggtccaacgtttgcatgcacaaggcactggcccgcacccctccttcattgctccttgcatatggagcgcgtcatttggctccgcgatccacctgaaccgcttcgctttttcacgtactcatcattaaactccagtaggtttcatttatactcttgtataatactagtatatggcatggaactcagaccgaaatccagaaatgatggtctggtgtgctgcacgcatgttaggcaggcaggcataggtggggcttcacacattagtcatgcttgcttgttcatggagctagctagctagctagtctttcctgttctggagtacttccacctagctatagcagatcatgagagctttcaagaccgttgtacgtgccagaggctagaggctctccctaggttcctttgaaaatggttgcaacgggaaacgactttcaatcgagacgctactactggtgcttcatctcttaggctctttatggatccatatccatgtttggtactagtatggcacggtcgtcagcaccacacacaacactttgtttggtcctagtgcaatgatggcaccttgaccgttgttcgaacttgctaatccgaggacagcaaaatccaatagaaaggaaagaaaacagtttgattctactaaacacaaggcgtta

SEQ ID NO: 96 - DNA, 3755 bp, Zea mays
ggggtacacagtaagctggacgcgcgaccgacgtgtatgtacttgctcctatgtaaagctaaggctgcccccgcgcgcgcgcacaggcacagtgcgcaagctagctagcacgtactatagtagagttcttcgtgcgaactctacgcttgacatgagatcccggcctctcactcgcgggcgccgcacgtggcggcatgcattgcatgggcacagtctcggctatagctagctagcccctatgaatggacgcacgagatctgtgtggtacgtgctctacgtatagctaggaagcaggtcaggacgactgagtgaggagtagctcctcgtagctggcggctggcgcctactccggccaggggtattccccggccccgtggtacgtagtggtaccgcggcattatcgcgctgtctctcgcggggcaggcaggacgccccccgcccgtgtcacgtccgcgtcgacggacgcagccgagagcggctggttggttggcctcgtgggcgcgcgcgccgacggcggcgtcgtttcggccgctgattggctccggcctccggtccgccggggacggacggacgctccatcgatcgctgcagctcgctctgctgctcagagttggtgcacccgtacgtacgtgcgcaggctgaggggtgcgtggaggcgtccgtgtctcgtcagccaggcacgcagcaccagcgacccatcacatgcgctgatgcattgcacacacactactacagcggtgcgctcccaagtaccctctccctgtacgtgcgacatgacattcctgttaccgccttcggcagctgcaagctctgctagctacacattcctgttacaaccatcttctgctacatgttacggatcgacgcaagaagaggatggggccccgcccagccttgttggttccatgccgacacgggagcaacttcttccatcgggtattgttagaccacacgtacgctagcttgctgagaacggccaggccacagtcgtctgatggatggtacttgaatttcttgagaaagagaaggtaccgtacacgtgcaaataaatgtcaaacatgaaaactgtaaatattaacacggcatcaggctacatgaacactcttttttctctcccatgcagacaacatgatcctggcaaaccatcatctacgcgttgtgtcagagaggcagaaagaggagcctcaacattaccacacgtttgtcgggatgcaaatgaccttcggtgagtgcacaataaaaccgaaacaggttaatctctctcagggccatatgttggtccatttctgcaagcgaatgatttttcatcctcttgccatatatatgaatcatggtccagcatatgcacaatcattttactgtttgcaagtcatatggcaaaactcacacaggtcacgacaagggaggttttacccgctacatgtatgtgcatgcacagtcaagttttcattctggctcttccggggccacaaagtgaacaatggacttggattcagatcacaagctgctgccagccttcatgtgcgtttcgattatgacatcaatgtgtctagccgaaaacagaccagaacaccaaaccaaattatttagcaaccccacaagagagccttccattttttttttttgggtgggtgggtgggggcaaggtttcatggatgataaggagaaaaacaggaaccctattgacgaggcatcatcctttgaatcttgttatcacaaaccccagagagagaggatcggatgcatgttaagataagccactttaacccccactccaagagaagaattcctcccttagtccattctaccttgttggacctctccactccacttgcacatcttttctccccacactgccgccaggatttctgcccagcctgtatcaatatagaaaggctttagaaatgtttacaatttacaagaacggcataaagtaggaacacaaaagttccgctgggggtggggtgggggtaggacagcaatggtgaatgcagaataaaaaggcagaaactgcagggtaatgtgggtacacacgacaactaaatcaatttgcaaatatattgcagaataaaagaactccttgaaaaggcaacgtgacaacagaatatgttccaatggtgaatgcatctgccgggactaatgtagcaagtttgcttggtgtgggcatatgtgtgtcatgctcctcactgttgtgccccactaccagctggacatggtgctcctaaaatctggctatgtgtgaccaccgttcacctagttgatcagatagctggcatcttgtgatgggcacacaggggctcacctcctttccattctatcagtcaaggctacatgcttttatcaatgatatgtgaagaaaatgcaatcaactacagttggcttagaagccataagatttgcttccttcctagatcttctttacctgaaataaaatttctaaagtcttcctgtcaatatcttgcatcaacagcaaagagatgatgtgcaggtcaaaaacttcttttttatgcagagatagtttcagcagtttgttctatcaatttagattgtgatgagcttgtaaggtaccagtattgtatgattattcctaaaagatgaacatagtagaaacgacacaatggtatttgcttgataaaattttgagaacatttaattcactgtggcatggcattgaaagcaatcaggtgtgttcagaaccttatactggctcctaatgcaggaatttattccagataatgatgggtgtgcatttaaaaggaaaatgccaaaaattaaagtcctcgaaaaagaagaggtatctgtctctatctgccatgatgatcagcatttgccatatccacatctcggctgtcagccacttgagcaattcatccaaacatcaacagcaggaacaatcatcagcacaccacaccaaactgaaccctggagaatacatttggaactgtgattgctattatgccgtatgatgaaatcaagtatgaccttgaagtatacaaagtgcaattcaacattaacaagtacagacgactacaagtttatgctgaagtgcaagtcaaagccttacaagaaatataccttcgagaaacatcctctctgtctaccccaatctccttttgatgacatctaaggggttttctcagacattaataatgggctgaagcaaatgcatccaaagactggaactatatgcaagttgaatataaatgatcaataacaatgtttgataaaaaaaattacatggaaggccccacaaacaactcagcaagaacaaagcatcaattatcagttcgcttttcatgacaagcataaaaggtaattacagttacagggaactctttatgccaagtacgacaaaggacacagcaaaagtacctagctaactaggcacgcaaaggacatgtagcagagatgaaccgaagtgttaccaattgactaaacatttaaattatttacaccaaatagcagctccgcaacagcagcatgcaaatggtgagcagtagcatatgatctttcagcagtttgatcccatcctagcaatgtaggagttggtgaccctaataattgccggttaccaccaagcacaatgaaaagctgcaaacctgctgctccagaaaaggctggcaaaatcactaggttcatataattgatcacagtacacctcactgaggcagaacactaggccatttctctatcagtcaaactaacaatctgctactctgttccaaattatagttcactttatcttttcgaagtta

SEQ ID NO: 97 - DNA, 3747 bp, Zea mays
tgtcatgatggtaactcaaatttgtcgcctagctgaactgctgaagcatcatctttgcagttaggtagtattcttttgcgtggcatgcttcatttcgaggatggccagtccaaatctcgctctgaatgtgctggacttttaccctgtattctgtataacacttttgacacaacaccattctgaagtctgataggcattgtggcaggtcttgccattcccatccccctttctctactatgtaaacatttcaatctattttggttttgttttgcttcattgcatcttttgtatctcaataaaaaatgtggtgcttctttggttttttggaaagacattatagcattccgttactgatcaactgatgcatatacgattagagtcactcttcctaggttagatcctatgtgcattttccatttactacattatttgcttcagtttgataaaaatgggcaaacattgtcaggtggctagtcgtatgcacaagtttgatggccatggaaatggaaatcccaacagaaatcaccaagcccatcatagaaatgggcccaggcgacgttttcctgctgctaatggtgcaccaccttaccctccaccaatgcattatccccaacatccagggcaacccattttttaccccgtggttcccagtccaatgatactacaagaatattcttaccagccatttcctatcccagtcccgaatcatgaccggcatgttggaaagtctggttttgagaattccgtgcctccttttgttccagtagatcaagttggtgcccatgaaagtaacaggccaacgcctccacatccaagaggaggtcctcatctttggcggcctcctgttggcactcatggcactaggccccatccttctcctgaaggccatggccattatggacaggcttggcaaaatcctcagatgtttggtactagagaaaacacaaatctaccacaaggtcttgggccaagagcttttgtaagaccaatggtgcctcttggatacatcaatggaccaccatatcctggtaatgctatgctcaccatttatgacatgtttgcagttcagatttctttttagttttcaaatattgataaatgctttaaactcagggcctatccctcccatgtattattacatgcccactgtgcctatggattcgatgagaagtccatcacactacattcaaaatcaaccagctcctaatcctgttttatccccagaagctgctgagttaagatctaatatactaactcaagtggagtactacttcaggtaaattcttattatcttcctttggagtcataacaaagcgtgatgatacctataaacatagatgcgtggatttgtaacaatatgttgatagattctcatttatttttattgggtgctgggtagtggtgccaaatagtttattttaattggatttttgtctattgtcagaaacatgatgttaaaaagttcagtttgatgttgtatcacacttcaaggttgtaatgtcatggtgcaacatgcacacaaataccaatacagcctacaatctgataaaatctcatatgtttcgataacatcaggagcgattaaatgttcttttagcaagtgtggcatgcaatcctttgttcatgcaatcatgtttttcagtgatgcaaatctggagcgtgatgatttcctgaaatctttaatggatgagcatggttgggttccagtttcaaaacttgcagatttcaatagagtatgttttctttccagattgcttaatattaaatttctattattttgcccttgtgctaggaaacaactcatttttttatttgcagcttaagaaaatgaccgcagatatacacctgatattggatgcactgacaagctcaagtcttctagaagttcaggttgcaatgttatttcaatagtcattgttcaaattccatgttctgtttaggtatttggttttaccttatcctctgctggtctactgacaggatgacaagattagaaggcgttatgattggtcaaagtgggtctcgctttctggtacatcagttgcgagcccatcatctgccagtgtgaatagcagtgtgggtgagaagaacattggtggtttttcaaataaggatgcttattctgaagatcaaaagacgcattgtcaatccaaagatattagatgtaatacagatattggtatgggggaaaaagttatcgatgaacaagtgcaagattcacatggttgttcattgaataacgacttttctgtcatcagtattgatgaaaagactaagaacctttctgcacatccttcacgcaaatatggatcttcttttagatttggtgaagttcagaaaacaaggtcgaagatagtacctaatgctcagagtgaaagaggtttctctattggtttcccaagtgccttctctagctttggtggtggtggtgaccagagcactttcttgcttgatgaggagttggaactggaacatgtcgaccattcacgtgatgacctccattcacataaaaggtaattatagctggtatactctctattttccatgtctttattatttttttctaggtgtgtatgcatgtggtcaggggcggagcttagtgtagattaacatgggccatgaaccctcctatatgattctccactaatcttgtttctcgcgagcttattggacttgaaagtaatcatgaatttcattcataatccagtgtcacttgatgcatgcccccccttcattttagcccaagctctgccagactgccattgcatgtggtttggtgcaaattttctcaaactgcccaagccaaatcttgtctacttttgaccaatcttagccgccattttggttgagtgcttaagtttggtttgatgcctttctccaccttaatttattttgatggccaaagttggtcaaatcctggaccatttgccagccaaaatttggcttggctaagaacctaagaggtgacagtagcaaaccaaacataccttaagctttgtcaactttgcttcctttagccattgctcatatgggctagctacatagcttttttcttcgttgacaaagcagggtgtgcgttgtgaagaaacatgcccttagcctactgatgattgtttgatatttgctgcctatttttcaccatagttatgtgtgatagatgttcacaaacgtttccttatccatgtaagctgcacacttgtattttcttctatgttgccctgatacggggatactgatacgcgatacgccgataccccgatacagtatttctcaaaaaacaccgatacgccgctacgtaaatattctaaataaaattaaatgctgaaatagttgaccacacaatttcacaaatagtacatagacaataaagtttaggccaccaaggcatcaaacctaaaaacttcagtgttcagccttcaatttctaacagtaacagactactatcacataataaataaagaaaactgcttccatcagctgtgatacttgcagcaacggtatcactgctgctgcagccttcactcagagcagtgcacaaaagtagcaggcagcggctgttgctgtgcagcaaaactagatttcattcttcatttggttctgcatctttggctaaatccaatgccccaagatcttcaaacaatttttcttcaagttctggctcatcgagagacagatcagcttgctcaagaaaaccagcaccaccctcaaaatcagcttcaaaagtgtcagctccaacatcccacattg

SEQ ID NO: 98 - DNA, 3742 bp, Zea mays
ctagtacaaaacatggatatggatctatagagaggctaagagatgaagcaccagtagtggcgtcttgatcgaaagtcatttccggctgcaacctttttcaaagggagctagggagagcctctggcctctggcacgtacaacggtcttgaaagctctcatgatctgctatagctaggtggaagtacgctggaacaggaaagactagctagctagcttcatgaacaagcaagcatgactgatgtgtgaagccccgcctctgcctgcctgcctaacatgcatgcagcacaccagaccatcatttctggattttggccggagtgccatgccatatactagtactatacacgagtataaataaaacctactagagtttaatgatgagtacgtgaaatagcaaagcggttcaggtggatcgcggagccaaatgacgcgctccatatgcaaggagtaatgaaggaggggcgcgggccggcgccttatgcatgcaaacgttggaccaagcctacaactagtgtgagtcttgcgtccactagttggataacatgctccagtgtggtctatgcatggtgagacacgtacggttgccctgaaattgtgaccgcttctcatggcgagacgcgtacatcatgtggctcgaacgagacgattggtgcagtttctaggcctgtcatcctctacttgtgtttattatttaatgggtgctagcgttgtatgtagggatccatcgatgatgttccatctagtactctgtgaaagtgtggtgctctggtaggagaaatctagcaagacgatgctcctgatagtcacaagatagagagctgtgcacgtgtcttctcaggtgcagagagagagagagagcaagcctattgattttgtgagtcctgacggtgcatttctgtctgcagttcatccgtgtgccagatattgctgcaatcgggtctcagtggatagtttgaccaacatgcatgttattgattactaatttctcatggagaagaaggtaacttttcgtctaacttttggcccacaagatcactaaaaacttgtctataaagaccaagttagtccacattttttatatataggccgtagttaaactaaactgcacctaactcaagtatttagtctctagaagagtggatgtgacatgattcaggttttacccgcatagcaaaatccaccggcataagaagtttctcacccaataagaacctagtaacctgctaaccacctattcatatagttaggactcatttggattagttaatctatactgcaattaaatcttgcattttagtctctggttgatttaatttttataaagtttcatgatctttatccttaaccaaagatgacaattttggcagctcatcctcaagaaacgacatcctctctttggcatttgccgccactatttgtagtctaacaatttcatcatccttcttttgggcacccaattgcaactcatcaacattatgcaaaaaaaatttagcggcttcagtagcatgctttacctctattttcttcctcttaatggtcccagtgtaatcttcttccattgtcttaagctggttccacacaaaattcttttttgcatgttatgctgaattttcactgtcctctgatctcatgatcttggaagctttctttagttttcttatctctgacctaatatcttcctcacttttttggtgatccgaattgttgggactaaactttatttcatatattagttttgacaatttggatccctagaaaattagaaaagatattagggaagagattaagaaactaaagaaatcttactagatcctaagattagagaagcataatgaaatttcagcataacaaatgaaaaaaattatgtgtggaaacaacttaagacaatggaagaatgttacggtgggaccattaagaggaagaacttacaggtaaaacggggtactgaagcagctcaaaagcttttgcataatgctgatgagctgcaagtgggagcccaaataaaggatgatgaaattgttagactacaagtagtggcgagaaatgccaaagatagtatgccatttgttgtggatacgctgcaaaaattgttctcttttgttaagcataaagatcttgaaactaataaaaatgaagatcaacaagacactaaaacacaagagttagctgtagtcgagtttagcttatccaaatgaggtctaactatatcaactttatgacatgtggttagcaggtctaaaaaatatagtgtcgcttgtttacaccgtccgagcaggcctggaaattaatctcgcatttacatgcgatcatacatctgacttaattttcacccttatggtgtatcgtgcaaattgggtctcgtgggtcaagaactgtcgtgcgctcttgctgcaaacgggtctcagtggtcagtttgataaacatgcatgttattgattgccactttcttgtggagaagtaacttgttgtttgacttttggggcctgctagagtaaattgcccacaagaccactaaacttgtctataaatatcaagttagtccacattttttgagaggaaacacccatttctattaatagtaatacaaccgagtcttcttacgagtggatgtgctatgattgaggttttacacacataaaaaatcgaccagcctcagaagtttctcaaccaataacaccctagtaacctgctaacctcaattggattagttaaactaaactgcacctaactcttgtgtttagtctctagaagagtagatgtgacatgatttacgtttacccacatagaaaaatccaccaacatcagaagtttctcacccaaaaagaacccagtaacctgctaaccacctgttcatatagttaggcctcatttggattgttaatctggactacaactatatcttgcattttagtctctagttgattttatttttataagtttcaagatctttatccttgaccaaagacgacaatttttgcagctcatcttcaagaaatgacatcctctcattggaatttgtcgccactatttgtagtctaaaaatttgatcatccttcttttgggcacccaatggcagctcataaacattatgcaaaagctttttagcagctttagtagcctgctttacctatatgttcttcctcttaatggtcccaatgtaatcttcttccactgtcttaagctggttccacacaaaattcttttccgctagttatgctaaattttcattgtccttatatgatctcatgatcttggaagcgttctttagtttccttatctgttacctaatatcttcctcacttttttggcgatccgaattgtcgggactaaactttatttcatagattagaattgacaatttggatccccaaaaaaatggagaagatattatagaagagattaagaaactaaataaagcttacaagatcctaagattatataagcataatgaaatttcagcataacaaacgaaaaagaattttgtgtggaaacaacttaagacaatgatagaatgttacggtgggacaattaagaggaagaacttacaggtaaagcgggctactgaagtagctcaaaaccttttgcataatgttgatgagctgcaagtggacgcccaaatgaaggatgatgaaattgttagactacaagtagtggcgacaaatgtcaaagatagtatgccattgttgtggatgcactgcaaaaattgttctcatttattaagcataaaaatcttgaaactaat

SEQ ID NO: 99 - DNA, 3780 bp, Zea mays
ttagtgaaacactttacccatataactctgaacctccgaaggtacgccaatcatatttatgggccgacttcgacttattgtttcaacacaaatatttactgctttcatgcaaccatccaaccatttcgatttcctttatttagtatgatagcctcaccggtattaggaaacactacagtgataatgggctgaagccacgggtgaacactgttctgtggtagcttactgatgaggttggcttgtggcagttggcagggtcaatagtgttagacactttgctagcttgatgttctttcttggtcgtagtctcaactttttccatggcttatgtgcaacatagactaatgtatgctgtatgacggcttgtaactgaatcatatttgcttatcctgatacaatgatcgacaattctcatgcgtgtttgccaaaaaaaaaacttctaaaaatctaaataacaaggcaagataaacatctagttacaacaatgttgatttcaatgctgttttcatggattgctgtgttgttggcttgttgccttgctagtcaagacgtaggagttgacttccatttgtgcttgaacctgatcatttgtcaaaatatttctgatatttgatgtgcgggatcatgtggcatgtgtgcaaaattgactacatatcttgtcctgatcttatctaacatctgtaatgctttcctcaggcttctgacaccccctggaaccccccgtgttcctgcattagatgctgccgagaaagctccatcctcaactgtgactaaacatactattaccagatcatcctcgacaactagagcatctagggtcggtaaaaattgttattattgaatgctgtatatttttacatccaacatgtttcttgattctttgtgtatgcagtgtcacgattttttgtgaagactatatatgttttatggcttattatcagtggcatatgaattcattcaggtcatattggtgatttacgtacataaggaataacaaaatgctgcattcaagttgcatgcatcaaattaacctgtggctcatctattggtctatatatatatttgtcacatacttgcaagttgcaatgattatttatccatgctttatggtatctacaactgcaaagatatgaatttcaagcaccgatttcataggttatggtaaattcaagagtaatttgtgcctcgcttcaagaagttgctagaatcattttaatcttttggactagtggaatcgatttgaaaatctattattgtgtagttttgagatagcaaacttgataatgatacctctttcagtctaactgtgggatcatacccatctaacttgctcttcgctactcatctcgtggtggatcatgattatattaacataagctgtatgatatgtttgttgcagttttccacttctgagacagagaatgggtattcgacgtttcccactaggcctgcacggagtatatctgtctcccgccgggcagttcaatctacaccagtgtctagcaacagcaggtcatcagtcctcaatgcaaacatttcctctgttagttcaagacctacaaccccaagcaagcggactgccactcttactgcatcgaagtcatctgttccattgtcacgtccagtgccaacacgctcatctacacccgtcaaagcccgtctgtctacaacaactaatacttgtccatatactccagtgaaaaatcgtcctcctgtgtctaactctacggccaactctgttgttcccaagatcacgtcagcacaaagctcaagatcatcaactccaacctctcggtctcgaaccttgtccagtccgtcttcaagcagtacaagcacagtgagccgtcccagctcatcctctggtaaagttcctacaattagtcgtaccagttcttcatcaagtacagttccttctgtgagccgttctagctctaggtcatccacacccactcgtcagcctgcaatgcgttcatcaacaccatctgctgggcggatttctggcaaaagtaacatgacatctagtggcagacccttagccagcagtggtcggagttcagcaccttcatcagcgccatcatctcgtccaagttccccaaacacacgaacacgagctccagttcgcccattagatattccagattttccaagtgaaactccaccaaacttgaggactaaactgccagaacgaccactctctgctcgtagagtacggccaggtattacttcgggtgtcaggtcaaccccaaatgctgaaccagttctctcagctcctgtaaaaaagatgtctgtgcctgctatcactcgaagtaagttctcagatatacaatcaaagacatctggtcaccaaagtaggctgagcgaaagatctctcttggaaggtcaaacaactagaacctcacggtctgtcacagctgcagacaatggattcggtaggacgatatcgaggaagtcacttgacatggctatcaggcacatggtatgttcacccctcacatttacattgaattgaacaaggtcttatgtttttcttagggttctacctatgtgatagggccatcacatactgatagttttctttcaagaaagagtttctactatttttgtctgaaaaaagagagttggtttcacctgtatgcatgaaagattacaacaactgtcatgtttttgtatgaaagtaattttatagccgcaaatttaaaatactccctccctccttttgtatttgatgttggttagatgggggagggagtagtaaacttgaatattttaaataatcaggtataaatatgctatgggaaggacaaaacaaaggaattttaggaagaacaaagtaaccaaacagcgaacgtataatctgtgcagataatgcaatatgaacatcatatattacatgttaagatactattgtcaccctaaatgcctagaccgctatgtaagacaggcatcatctatactagtgtgaattaatctaaccaaaccaccatcacaacaagataaatgaacatagcactttaaaggtatgagagaattaacaaatagaaataatcacattctggcttgcatctagaggatccaatatctaccatggaccacatatgaacacatatatgaactatattctacaaacatacgacttattcattcatacttaggatatggatggaagtagttcaacttgtatttccaaacaacattttttagaatactcgaatcatgcaaatactaaacagaataccacaattttgagctaacaggtagaacatcaatttccgctactcaagcaaaattagtgtatcactgtcggtaccgagggaacctacttaaccactctatcacagtcctaatacaatcacatatacattcatcaacacaattgaatcgtcctcgcaaccctgccaacatctcttcgatggaagctcgacgaactaaatttatcacactatacacaattcacctttccacttaagttttacccaacaaagatgatgcaccggctacacttatgagcataaccacatactacatatgaggcgacattttaacaaatatttaatataaccacaacacatatgtgccactagaaaggaattcaacgtaaccaatatactaactcaatctacttcacgagtcggctagcgggagtagcgaaatagctcactacaccaaactcaactcggatccgtgaaacgatgatgaatcctagctcaggcatttaatcaaacaacatacaagcaaccttaagtctatttttagattgggaatgcaactaagacatctatt

SEQ ID NO: 100 - DNA, 3735 bp, Zea mays
ctagtacaaaacatggatatggatccatagagaggctaagagatgaagcaccagtagtagcgtctcgatcgaaagtcatttccggctgcagcctttttcaaagggagctagggagagcctctggcctctggcacgtacaacggtcttgaaagctctcatgatctgctatagctaggtggaagtacgccggaacaggaaagactggctagctagcttcatgaacaagcaagcatgactgatgtgtgaagccccgcctctgcctgcctgcctaacatgcatgcagcacaccagaccatcatttctggattttggccggagtgccatgccatatactagtactatacacgagtataaataaaacctactagagtttaatgatgagtacgtgaaatagcaaagcggttcaggtggatcgtggagccaaatgacgcgctccatatgcaaggagcaatgaaggaggggcgcgggccggcgccttatgcatgcaaacgttggaccaagcctacaactagtgcgagtcttgcgtccactagttggataacatgctccagtgtggtctatgcatggcgagacacgtacggttgccctgaagttgtgaccgcttcttatggcgagacgcgtacatcatgtggctcgaacgagacgagaggtgcagtttctaggcctgtcatcctctacttgtgttcattatttaatgggtgctagcgttgtatgtagggatccatcgatgatgttccatctagtactctgtgaaagtgtggtgctctggtaggagaaatctagcaagacgatgctcctgatagtcacaagatagagagttgtgcacgtgtcttctcaggtgagagagagagagcaagcctattgattttgtgagtcctgacggtgcatttctgtctgcagttcgtccgtgtgccagatattgctgcaatcgggtctcagtggatagtttgaccaacatgcatgttattgattactaatttctcatggagaagaaggtaacttttcgtctaacttttggcccacaagatcactaaaaacttgtctataaagaccaagttagtccacattttttatatataggccgtagttaaactaaactgcacctaactcaagtatttagtctctagaagagtggatgtgacatgattcaggttttacccgcatagcaaaatctaccggcatcagaagtttctcacccaataagaacatagtaacctgctaaccacctattcatatagttaggactcatttggattagttaatctgtactgcaattgaatcttgcattttagtctctggtcgatttaatttttataaagtttcatgatctttatccttaaccaaagatgacaattttggcagctcatcctcaagaaacgacatcctctctttggcatttgccgccactatttgtagtctaacaatttcatcatccttcttttgggcacccaattgcaactcatcaacattatgcaaaaaaaaaattagcggcttcagtagcatgctttacctctattttcttcctcttaatggtcccagtgtaatcttcttccattgtcttaagctggttccacacaaaattcttttttgcatgttatgctgaattttcactgtcctctgatctcatgatcttggaagctttctttagttttcttatctcttacctaatatcttcctcacttttttggtgatccgaattgttgggactaaactttatttcatatattagttttgacaatttggatccccagaaaattagaaaagatattagggaagagattaagaaactaaagaaagcttactagatcctaagattagagaagcataatgaaatttcagcataacaaatgaaaaaaattatgtgtggaaacaacttaagacaatggaagaatgttacggtgggaccattaagaggaagaacttacaggtaaaacggggtactgaagcaactcaaaagcttttgcatactgatgagctgcaagtgggagcccaaataaaggatgatgaaattgttagactacaagtagtggcgagaaatgccaaagatagtatgccatttgttgtggatacgctgcaaaaagtgttctcttttgttaagcataaagatcttgaaactaataaaaatgaagatcaacaagacactaaaacacaagagttagctgtagtcgagtttagcttatccaaatgaggtctaactatatcaactttatgacatgtggttagcaggtctaaaaaatatagtgtcgcttgtttacaccgtccgagcaggcctggaaattaatctcgcatttacatgcgatcatacatctgacttaattttcacccttatggtgtatcgtgaaaattgggtctcgtgggtcaagaactgtcgtgcactcttgctgcaatcgggtctcagtggtcagtttgataaacatgcatgttattggttgccactttcttgtggagaagtaacttgttgtttgacttttggggcctgctagagtaaattgcccacaagaccactaaacttgtctataaatatcaagttagtccacattttttgagaggaaacacccatttctattaataggaatacaaccgaatcttcttacgagtggatgtgctatgattgaggttttacacacataaaaaatcgaccagcctcagaagtttctcaaccaataacaccccagtaacctgctaacctcgattggattagttaaactaaactgcacctaactcttgtgtttagtctctagaagagtagatgtgacatgatttacgtttacccacatagaaaaatccaccaacatcagaagtttctcgcagaaaaagaacccagtaacctgctaaccacctgttcatatagttaggcctcatttggattgttaatctggactacaactatatcttgcattttagtctctagttgattttatttttataagtttcaagatctttatccttgaccaaagacgacaatttttgcagctcatcttcaagaaatgacatcctctcattggaatttgtcgccactatttgtagtctaaaaatttgatcatccttcttttgggcacccaatggcagctcataaacattatgcaaaagctttttagcagctttagtagcgtgctttacctatatgttcttcctcttaatggtcccaatgtaatcttcttccactgtcttaagctggttccacacaaaattcttttccgctagttatgctgaattttcattgtccttatctgatctcatgatcttggaagcgttctttagtttccttatctgttacctaatatcttcctcacttttttggcgatccgaattgtcgggactaaactttatttcatagattagtattgacaatttggatccccaaaaaaatggagaagatattacagaagagattaagaaactaaataaagcttacaagatcctaagattatataagcataatgaaatttcagcataacaaacgaaaaagaattttgtgtggaaacaacttaagacaatgatagaatgttacggtgggacaattaagaggaagaacttacaggtaaagcgggctactgaagtagctcaaaaccttttgcataatgttgatgagctgcaagtggacgcccaaatgaaggatgatgaaattgttagactacaagtagtggcgacaaatgtcaaagatagtatgccattgttgtggatgcactgcaaaaattgttctcatttattaagcataaaaatcttgaaactaat

SEQ ID NO: 101 - DNA, 3730 bp, Zea mays
gcatcagcagctgcacaacttttgcttttctaggcacttggtcttccatggcaggtgtaaccaatattctcggataaaggagtggcgtacaactaagacactgctttggcagtccttcattatgcatcaatcttttctttagaggggttattattattatgcattctccgttgcggatggttttttttttgggagttatctgttcagaagtaagcaatcagataatagcgtgacagatgaccacaaacacatctggcagcccaccgatgatactagggcttgcacgtactgtacatttttagggttttgtcctatttgtggcacgtctagcctaccctcgaacatacagaaaactttatgttctgtaccttggtctagtccctgccatccagtgtaccctctactccttcccagcctttagctttcttgtttgctaccttgagacttgagtcgtgagagatacgccaagcgaaaggacgagaccttgccggtctcaacagtgttgcgctcgtctgtgttgctgcccctgcccctaccgttggtcaaaaaggtaatccgtcgtcgtcgtctagtcgattcgcatccgcgttgctcgaatgccgcttaagtttccggaagatctcgtcgagtgattccgtagcggattcgttcgtcccggccctaggagacaggcccaataggaggaacttcctggagccgcccatggtcgctctgaggttctggaaacccgtcttcattgaggcccaccttgaggccgtctcagctggtgaatctgccgccgcactcacacaaggcggctcattggatttggaggtcgatgagatccccttctgaacctccactggtttcggactgctgcactgttccctcgccggagaatatctctgactctgagcgacatcgccaccgtgtttcggctgggcggcggttcgttccggctccgtctccactgtaccgtcaccctgtgcaaaaaacaagttaaagattagctgagagtggaacctccaaatggactagaagaaggactatgacgcagccagactaattcgcacctgtggtatgtttccagattcgacgtcttcgcctaaacagctgaagtttcttgctagtggagctgcatgctcactgactttgcgtccttgttccatggagcttctctctgcagaagaaagcaaataacatcagacagacgatacacagatagagcaagccggcgctggagcaaaatgacttctataaccaagctaagcagggtttctaataaaaccaccagcaacaagcttcacgttaccgaaaccactagcagggtttgattatttttttctctcaaaaccaagcagggtttggaatggtctgtgtaagcatgataagttgataggaaatgctgcgacggagattcagacacaaggtactgctcgtaacgaaattcttacctttctgaagaatgaatactccagacggatccaacccatccatatctccttcttggtcagtccagcacttgaaccttttcaagctcccaaaaaagtctatcagatgctcgaaaaaatttacagcgaccaatagggtataaacaaccataatgagtgggtagattttgttgaaggttctcccgaagaaaggcacgacgtcatcaatgtttcccattctctacatattagtataagaggtgatcagtcaagcagtcaacaactgggacatatcttgtaattgttaagattaaaaatgaaagaaaataacattctgcacttgcaatgaaaaaacgtgtcctctaaacattctttttagagaacttctatcttctgttggtatctttacggttgacctactgacttggagtaagggctgtattttaagtatttccttatacacaattaaggagatgaacttaattattttagagcactgattatatgaaagagcataaattttaataggggcctgtatttggcatgaaaactgtaaacttgcaatcaattagtgttttcctacttctctttcctggtgtgcacaaagatcatggtatttttttcctaaatatcaaaaaaaaatcatcattttccccctgagcaacccaacatcgattatgaaagtttgagatcaagaatgactactcaaatatcacatattgattttattcattgccaataatgtagtgaaaaaagtacaagcaaggaacatgcaaagaataccttttcaaaagtagttttagcattaccaccaaggtgaatgagattcaggaagttgtaagaaataggtggtgcatatcttgcaaccattctgcagtgaaacgtttgatgtaaaaattggattagaatgcaggaaggtgcctttaacgattaatgccattcaaagtatcaaaagatggaattctggatcgcttacgagcagatcataagcaagctgactgaactagtttgtcctggggtcaacgaatataacagcatcatccctatcctaatcagtgaatagtatgtgcagatgcacatatacatcaagggaacaaacgcagcaacctgttaataggcaagtctaatcagcaaaaggaataaggttaaacttattgttttggaaaaaattctttaatgaaattataccaagcagaaagaacaacagtatttataaaataaaaagaatggcaaggaaccacaatgtttgatcctctaccaaaaaaaacagattttgatgacccaccaggattttttttcacatgtgaaagcacaacagttgtgtatatcacgattgacgaataaaattgagaaacaaaggattaacaaaatctcatgcaaaagttatgtttatagaaacgtgtgtgggtgaaagtgagttccatgtgtatattttactccaaactaaaagccaatgataacaaggaaagctgcagcaactgagtggcaaatttcttacctggactaaaacttcttgctttcctgcatttataagattggagaaaagtgacagatcaacatcacttggcagcaaagtggcctcagccaacagtatggaagccgagacacatccaaggataacagcaagtactctcataaattgctttctcagtaaacagcgccaaatgaactctgaaaatgtcaatgtgcctttgaatcagtaccatgaattattgaaaattcagggtggtttgctcagaaccctatatgcattggatatgatacatgagtgttgtgtataacgtatcttcagcataaggtttactgtaaaattaggagtcatgaactaatctgaaattattgactatcagtacaacttgtagattcttgcaagacaccttcagctgttacgttatattgatagacacataagtttttattggagaaaattacctatagagtcaagaaaagaacccagtgtgcctgatcgactttccctgaaacttgacagatatttcctgtaaaagttaataatgaaatatccatgagatgcttgaaacagacctctcagaatatttcttctgacgataataagttgttaaccagcttgcaagacttggtgactgagacagttcggacaaaacataatgcacatatgctctcaccacaacagcagacatgccctttatcttttttcgaaagaatgtttaagaaacataaaaattggttatgctactaatgctagtttatactttgtattcatcaattatctgtcgattaaattaaacctaaaatcattatttcttctaacaacaaaaatgacaaataaacccccccccccc

SEQ ID NO: 102 - DNA, 3713 bp, Zea mays
gcgtcagatgtgtataagagacagccataagagagtgcattatcactgagtttattatcagaagaatattgcagcacttacaaatttctgctttatctttttttttcttcctttgcttcctttgtcttcaagctccttctgctttatcttcttttttcctttgcttcgtttgtcttcaagctccttcacaatcgcttgcctaagattgtgttgtaggtctgcactccaaacttgattcttaatttgtcatattttttatttcgatcatcaaacttgaggcattcaacgaaggcattcataattactttcgtggcagtgccaccttcctcgaagcactttacaagatcaccacatgtcatggtggccccatccacattgaacagcaaagtatcatccatgctgtgccaacaaaaaaaatatgatatgaatatcagtcagtttattcaaacaactctcaacaaattataatcatccataaacttaccagtgatgtttgacacgttggtacaactcagcactctcttttgtactcatggatgaaagttttgtaaactcatctctgggtatggttgaactaatcttccttttgctctttaaaagtggaacattgccagggctcttacctgtactgatatcgtcccattcctcctccaaaacctggttcatctcagtactctctgttgtactcatggatgcaagtttttcaaaccttttgctctctataaatggcacattgcttgtgtccacttccttcttctcgaaaacctgaattgagggttcttcttggctggagtcaactgagagttcttcttggctggagtagttgctagcatcgttcttggctgagaaaacatcttcttcctctagtacaactgcttcgtatgtgagttctttaactgaagttaactgaccatcaggctggtcctcatgcaaggaatgggccctcttctttgaaagactgggctagagcttatcaatatatgttcaatcgcaaaacattgtctgtcacctgtgagtttcgcaaaaaaaaggagctgatactgtcccctttctcctccaaaacttgaatgcttatgctagcatccttcttggttgagtcagggcgttttctattcatatcacgagtgaggaggaacttagtaagctcctttcggagcatcaacacttgttcctgcaattttgaggcataaatcaattgttttagaattcgaatacaacagaacttgaaaaccacaaagctgaatgtttacctcattgatgttatatatctccatctcattgaaccctcgtatatacaacaatacatgaaaaccccagtaatagctgcaagaattcgcagaaagagagatcaaagatggtggaaacaggaagcagcaaggttgaaaataggagatagcatggtaaacgctaaagaaaaacctagcagtagttcagtcaattttttttcttataaagcaagatgacaagacggaggaggctacaagactaaggtggtgtacgttcaattacgtgttattttgctgctgaaccatcagtgtttctgtatcataaccagatatgtccatgtgattacgttgcaaaaacgtctgcagtttttcaagcaacgtaattggcacctctttatatatgcctcgacaagagtcggacatatatctttctttgcacagtagaaacaacaactagcgaccaatgatgattataaactataggaacaaaaatctggggaaaaaacaattagacatacagagcattgagaaatacagagctttcccagtaacattgaaatacaaagagcacaaacctgattcacatacctcactttatttggagtaagctccctgttcagacttttagcagttattatgtctttattcaacaaatcattctggaataacaatcaaagatacaacaaccatagttaaagaataacaataactaagtttgagatgacaatcataggtaaaagtacttaccacagcaccttcactaagaataattttatcatgccaccccactgaccatagttcgcataccaaatgaaatacaagggaatgcatatgaccacatggttgcaaacaattaataaaagtagattcccgtacttcacaggaaggaaagtctaaaacaattctgttgtgggatctttctaaaatatgcttcttgtatatgctatctgcatcatttatgtcaagatgctaaaaaagttgaaacagaggttaggtaaatttgcaatagaggttaaaaaattaacaattattctagttttacctcttacaagaagacttctcatgcagcactgcaaattgtctgaagcagctatcttcccagctaatcaactaaaaaggacatcaagggggtgcagtcagtttctttggactacacttccgcatcacctcatagaacaataatagaatagtacttacatcaacatcctccagcaacatcactttcttctgtgcctctgctgccctttccttttcctccgcagccagctgaaagggacataaagaaataagaagttgcattgcaacaatcagatgcagtcaaaatgtcttaaaggttccttttcgtaccctttttgtcctcttactgattttcttaattggttttgcactcaaaaggttatcgaccattgcctccgtatacaggttaattctgcaacattgtgtccaagctgttcctttgaatacagtccatgaaaacaacctgtgaaccaacgattcttcacttagtcactttcctacccaacatgagaaaaacaattactttaaggaattatggatatgctctgcattatcctggtacttactagaaacataaggacacatccattcatatgccccggattcttcttaaagtcagtgcaagagctttctttaatgaatgaaatatcacatatgaccagtcaacctttttcaacttttctaggtcatatacagcttgaagttcaggtgaggttacataaaaatagacttttgtggcagtagcaggttatttaagaccacactgaaaaaatgtctgacgagcatatctgtgtccatgtgcatggagatctcctcgttatccgaatgttgagccaactttacaatgttagtcacggtgaaataggttctcttaacactagcaggtacttcatcgttccgttgaccagcaccaccttcattggtctgttgtccagcaggtacttcattggtctgttgaccagcaccaccttcattggtctgttgactagcaccacctttatttttctgtctcagaggaaacttttcagatactattttcagcacttcgtacattttgacatattgttcatctgctgaagcttttgaagatggacttgggagaaccttctcagagcaggccaagaacttgttggattttcagttgtgggctgcaccgggtttgcagctccttgtcatgctcggcatatttggaaacagagtgcctgcagatgttgctaaaaagaaaattaatcaaaatttcagaaatctacagcttctttgatatgattttgatatttagctttaactgttttatcacaaagaagactatcaactaatgtaattgaaacaaccgcaaaagttgtctaagtggccttgtcggactttgctgcggctgaggcagcctgttcgctgagacgaccagtcctcctgagacttgaaaacggagccggcttccttacgctgggcgcgtatgacgcgacccatctggtc

SEQ ID NO: 103 - DNA, 3702 bp, Zea mays
tgccaattatatcagcgctgattcaagacataaagcaggggttccataggcgaggttcaatcagcatatccaagatcggcagggatcaaaataagatagctcattgtgtccttttgtttaggtaaacatgcatgactgggttagaatctagagtggtaaaatatagacttttagtaaaatcgtaggttgtagccaggtaaatcataggtccagggttggtaaaatccggagtggtaaaatctgggctctgtgtcgaaacggactagctcctcaccagtcaaaatggaccaactctgtgtcagtcaaaacggaccagttttgtgccagccaaaacggaccagcactgctctccaacgctgccatgttgaaggttggtaaaatcttaggttatagatggtaatatcgtatgttcttgatggtaaaatcttatgttccactacgaggtaaaatcgttggttcgggatggtaaaatctcagggttggtataatacagaggggtaaaaatattttacataaaaccgcaaaatattttacataaaaccgcaggttgtacacttgtacctcaacatcctgccagtaaggtattttgatagggtttgcatgattcatggcctcaaaaagcttaaactatcctatgtgtattgatacgaaggtatagtgtgcctctgtactggcacaacaccatgaatccttgtcttaaaaacatatacggttcctagttccctttatagttagtgatgtggggatccagcaacccgatatatgtaaacacgtatatgcatcttagggcccgacatgattgaaagatatatacgactcctggaccccgatctactttaaacacatatacgcaatctggtacccgatacattctggacatatattaggttccagataaccggtgcattgctgtgtggcccaggattaataggtatcttgcatgcctatatgtatgagaaaaatacataaatcatatctgcaagttaattgaagaactcttttttttttatgtttctcaatgtgttgcaagtccacagttgcaaaccagaaaatacaattagatttgactatccatctaaagacaaatgtcaaattttaagacgcgcaggcaatgaggataatggactaaccacagtagctaatggacagtcacatagcagcataaagccccaacatcacgttaatccagtcatgcatgtttacctaaacaaaaggacacaatagcatttcatccattcagtaatgcacgtacttgcagacacgtagaatcacagctgcaaccactataacacaattcataactacggtaacaacttcagaggttctgcttatgctccccagtacagtaacatgttacagatagtaacattgtatcgaattcaatctgtccagctcaacgtctatttttttttgtttttttactaccgaagatgtcacttggcagttcagcagtatttttgggatggcaaagaaggtacaccaggtttaaatccttgtaatttagaccaaagcactgcaaattgaaataaaaaggagataatgcaggttatgttatgcacaatagtacgaagttggaaacatgaatttaaagggaatatagactaacctttttgttaaacctgtcggttccattgtactgctcaaggaaaaacatgcattgaccttgggctcggcatcgaattcaacacgtgccaaccgtatctgcttggtggtagaaattggatactcgtaatcgcaatcctttagaacctcttcaaattgctccaaaaatgttatagtgtagtttttaacctgatcctttattttggttttgttggaatgtatgatcgatacctggcttattgtatgaacatcaacaaaaattataaaccattcttcattggtatatatagaacaaactacttgcaaaagttgagtgcattatcactgagtttattaccataagagagtgcattatcactgagtttattatcagaagaatattgcagcacttacaaatttctgctttatctttttttttcttcctttgcttcctttgtcttcaagctccttctgctttatcttcttttttcctttgcttcgtttgtcttcaagctccttcacaatcgcttgcctaagattgtgttgtaggtctgcactccaaacttgattcttaatttgtcatattttttatttcgatcatcaaacttgaggcattcaacgaaggcattcataattactttcgtggcagtgccaccttcctcgaagcactttacaagatcaccacatgtcatggtggccccatccacattgaacagcaaagtatcatccatgctgtgccaacaaaaaaaatatgatatgaatatcagtcagtttattcaaacaactctcaacaaattataatcatccataaacttaccagtgatgtttgacacgttggtacaactcagcactctcttttgtactcatggatgaaagttttgtaaactcatctctgggtatggttgaactaatcttccttttgctctttaaaagtggaacattgccagggctcttacctgtactgatatcgtcccattcctcctccaaaacctggttcatctcagtactctctgttgtactcatggatgcaagtttttcaaaccttttgctctctataaatggcacattgcttgtgtccacttccttcttctcgaaaacctgaattgagggttcttcttggctggagtcaactgagagttcttcttggctggagtagttgctagcatcgttcttggctgagaaaacatcttcttcctctagtacaactgcttcgtatgtgagttctttaactgaagttaactgaccatcaggctggtcctcatgcaaggaatgggccctcttctttgaaagactgggctagagcttatcaatatatgttcaatcgcaaaacattgtctgtcacctgtgagtttcgcaaaaaaaaggagctgatactgtcccctttctcctccaaaacttgaatgcttatgctagcatccttcttggttgagtcagggcgttttctattcatatcacgagtgaggaggaacttagtaagctcctttcggagcatcaacacttgttcctgcaattttgaggcataaatcaattgttttagaattcgaatacaacagaacttgaaaaccacaaagctgaatgtttacctcattgatgttatatatctccatctcattgaaccctcgtatatacaacaatacatgaaaaccccagtaatagctgcaagaattcgcagaaagagagatcaaagatggtggaaacaggaagcagcaaggttgcaaataggagatagcatggtaaacactaaagaaaaacctagcagtagttcagtcaattttttttcttataaagcaagatgacaagacggaggaggctacaagactaaggtggtgtacgttcacttacgtgttattttgctgctgaaccatcagtgtttctgtatcataaccagatatgtccatgtgattacgttgcaaaaacgtctgcagtttttcaagcaacgtaattggcacctctttatgtatgcctcgacaagagtcgggcatatttctttctttgcacagtagaaacaacaactagcgaccaatgacgaactgtctgtagcagctactgcaaattgcagtttgtcactaaatgatgcatcatgctgggaatttaaaaacaaataattataaaatatttgtc

SEQ ID NO: 104 - DNA, 3691 bp, Zea mays
aattgtctgcattctatagtagcacattctgcagcacatgcacatagggtgctggacagggtaaattcactcatctgtgtcccttcttggtgcatctttgaaaaaagcttcagagcctgtaaaccatctccattgcaggtatacccagcaatcatggtattccatgagactatgcttctgaaagacattgagtcaaaaacatggcgagcgcaatcattcctaccacattttgtatacaagttgatgagaatattgcatgtgacagtatcagttaccaaacccaaatggatggctaaaccatggcagcctttcccaaccaagagggacctcttctgtgtacactgttgcaaaagttcatgtagcgtaaacatgtcaatcaaattcctgtcaaacctaataaggcttctatcctttagggcaattccattgtttagcttgttacaaaaagaacgagcaccaaaatgaattccggagagtacagcaataagagaacaggcacactgttttatagattgatggttaaaccaaatgcccatccaagcaaggcagctgccccaaactctctcagttttacttttaggcaaacttcacaaagtgggatttgtacttacaaaaaggaagtggaatttgcttgacgctaagagcagaaaaaattctctgcagactgaactgtgaatgtttcagcatgtttgtccaccttcagaaaatcagaaacttttgcattgcatcgctgaaagaaatagcaagttaatacaagtagcaaccttgtgatactcattcacatatcttctgctatcaaatttacatcccgtcataaaaggaatgcaagtttaaaataaatcaaaatgagaaaatacaccggatttcactaaaatctgtacaaatggttgaaaatgaaaaaaaacatttgaaaaaataaatcaggagctaaactaatggagctgcaggtttaacacctttgcgagctgaatttagcatagcacttatattgtgacactgaacactagtactccagtcataatagcctcatttttcatgtccattttcagtcttgcagaatttgtttactgaatagaattgttagataaccataaaatcagaggggctagggcacgaccatttggaatgacagaacaacagtaccgaaggattaaacaattcagtgctttgctaacagtaatattcttattttccagatgagctcaccctgaatcaggatggcgttaaacagcgttccacaaaacacaagttagggcctgtttggttcctttagtcactagactaaactttagtcgctaaagtaccccgtttggtttcagtgactaaatcggactaaagagcattaatcgctgtgaataatgactgtattacccttaataattagtggatgtttgttgcaagaaaaaagtgaagagagtaaataagttaaaaatcctaatttagtcccttttagtcaccctcttggtgactaaagatctaaagtttaggtgactaaagatctaaagtttagtcaccatgtttgcttctttagggactaaaagtgactaaactttagttactccaaaccaaacggggccttacttagagtttacctcaaccaggcttctacaaaaagaaaaaaaaacggacccaactcccataacgaaaataaaccacagggactctggtcatatgatgcagaaattcagaggcaataagattgcaaaaggggaatggcagagacacggagcacacaaaactgtactctacatgcagcagcagggcatattttcagtccagtccagccctacgtagcactgacactactatagcacatcaaatcatcaatttcgataatggggaaaaaagtacagtcagagaagaaccgctggctacctctctcattatgcgtcattccgtcgaacaccctcggcgcaggagcagatgtcgccgcacccgccgagccagcacccgcagcggcgctcgaaggacgccgagatagccaggaagcggttgatcggaaccaggctgcaacacgaacacggcacacggggccaaaatctccgctgcgactgcgagtgaccaggcgctagagcctagcggcgagcgacgagaggaaattgcgaaagcaaatatcgagcccgcgggctggtgtgggaactccggagtccggactggggcatacggcccgaaacagagcgaggattagcagctcaatagcatggagactcttccttaaagcccgagcactcatggcacgtttcggcccattgtctgcacgtgtgttttgtattctgcggattgtcgtctcccaaaaggaggaaaatctcaaaaacaaggaataattagatatataccattaaaatattataactttagatataaatcatagactctacatgtcattgacacatgtgaatcccacatataagtaagatagtaatggtatatatctaaagttataatattttagtagtaaactagtaacagatccatatttccccaaaaacaatctccaatttgattaaatatatacagaaactattaatatatatgatcttcagaaaaaataatacattagtcgtcaaatgttttttatgacaaacatagtggaagatattatcttatgcaatcctatgaagatttagaatgttttgactccttgggaaacgagacttccattctttcctggatggagaaaatatttgggtgtgggttatcagatcacctaaaattttagatccagtaatttagtttttttcaaaaaaataggtccttaaattgatagctacagtttgtcttaaaaataaacaatgaaaaaaatacagtatatatatttcaaaactaccgagttctaccaatattcaattgaaaataaacataaatgccaggtgccataaagtacaagtatacattatatatattaacggttaatatatacatttagagtttattggtggtgagaaattgtttcattaacaaaccaaactctaccataatattttctgtaagttattactttgtatacaccttggcataccaaaattggaacccaactgtgagaactccattttttataaaacagtgccgttatacatatgattcttggatagaagataattcaacattttaagtgttgcggtgtagattgaaactattgtcatgtcactgtaatatcaatgaatataatgtatggtacggtctagaatctattttaacaaaatatagttgacatttttaatagaatatataataagaagcaaagtctaaatttaatgtgtggatgaaaaatatgacattcacttagaattagaaattgagattcactaaatatagatttgtaatgtctcaaaaagatgtagcaagggttgatataactccggataaggttttagcaaagtacatattaaaaatcactgaatgtatgacgaaatcatataaagtatataaaaattgttgtgttagatagaacaatcaattttgagtagctatgaggtataaatttatccacatagtgttcagatggtgcaatgcatgtaatagtgtaagcacatgattgctacccacttcactataaattgttgacccatcaatggtggtttttaatttagaaatataaaaatgacgtaaggttctaaaaaatcaacggtgaggactcaggccacgaatatccccagcggagtcgccaaatagtgttgtggtgccgatctgg

SEQ ID NO: 105 - DNA, 3668 bp, Zea mays
cgcgacaacttgtccactctttgctaatatttagtacaagttcatgtgtgaggtgtaaaattaaagtaggacataattaaaggtggctttaattatcccactcctgttcttggcaatcacatgtaagatatattccctactgtgttctacaagtctgcaatctcgtaaaagtacaacatggttccaaaatggaagtttgaattatagcactatctctaactgaattttgtgctcctctcagaacacgtcatgatctgcccacaaaaaaaagacttgcattatattctgctatagactatatatagatatataacataaacacaaaagctgacaaactcaaaacatttctggtgacccagcaagaacactattatatatgcaaataaccacaagctctcttcaagttgagtgccacacaccttgcaatatgtcatttaagtgaacctgttttgtattgtggattttaatatttctataaaagttattaaagttagagaaatacgacttaatacaaagctattatgacttataaattggaatccagggagcaacttgcaatgtatagtctatatgcttgctttagggccatctggatagaaaggtactaatgaaaaaaatattaacaggtaccttcttgtattggatgacgtctggaatagggatattgacaagtggagaaagctgaaggcatgtcttatacaaggtatcggttgcgccgtattagtgacgacacgtgaaaaacaaatagcccagttgatgggtactgtagttgacaactcatggacaaataattaccatgaagtgacaattttgggcaaggagtacatacaagaaattattgaaacaagggcattcagtttgccgaagagcaagtcagattatttagttaagttggctggtttgattgctgagagatgtgtggggtctccattggcagcaaaagcaatagggtctgtactgcgtaacaagaccactaatgaagaatgggaggatgtgttacaacgaagcaccatatgcgacgatgagactggaattttgcctatactcaagcttagttataatgacttgccaattgacatgaagcaatgttttgccttttgtgctctgtatccaaaggattatgagattggtatggacaaccttatccaactatggatggccaatggttttatctcagatagaaaaaaggtacccgctgaaaccgtaggtagatggattgtcaatgagatggtctcaaggtcatttttccagtatgaggagcaaagtaggattgggtacatttctacaagatttttgaagattcatgacctcatgcatgatgttgcactgtctgtttctgaaaaggactgtttctgtataacagatgaattcatcacaaatagggagttgcttccaagtgctgcccgccacatactttttccaacatcgatagaggaagaggtacatggttatttatttgcttctatgaggaaaatgtctcgacctattcaaacattgatgtttgatgggccttgtgaagatgtcgttgtacaacatttatcaagatataattctttgcgagtactttctgtggcacagtcatggggtcatttgccagtaaaaccaaggcatcagtaccaccttaggttccttgatatcacagacagtaccatcaaagaacttccagatgacattagcatcctttataatcttcaaacacttaatctttctggatgcagcagtctcattagacttcctgagcaaatgaagcacatgagtgcccttcggcatctgtacacagatgggtgcacgaggttggagtgcatgcctccagagcttggacaaatcacctcgcttcgaacaattacatggttcgtagtgggaagtggcttgagttgtagtagtcttgcagagctaaaggatttaaatattggaggttcgttaatactaaagaagctcgaaaatgtgccagggagaagaaatgcaaaagcagccagccttgagaataagaaggaattgagacagctgtcactagaatggacaagtggtaaggaggaggaacaacagtgtcatgaggtgctagagagccttgaaactcatgatggattgctggccctagaaatatattactacaaaggcaccagttttccgtcttggttgggtatgttgaaaaacatggtcgagcttcggttgtccaattgtaggaaagcagagcagcttccaccactgtgtcagctagcagaactgcaactccttcatttgaaaagattgggaaatttgcggttcttgtgtagcagctgtacatcgtctacatttggaaagcttaaggatcttaagctagttggtcttgacgtttttgaaggaatttgtgaggcagtggatggaggtgcagtagcatttcctcggcttgagaaattgaacattaagggttgtggaaatctagtagctctaccagatgcatcggtgctgggagaagcatattgcagtggagattatacagtggcccgctcagcatttccagaactgaagaggctcatattggaagatttgtgtatctttgagagatgggaggctgcccctgaaattgaaggacatgcactatttcctgtggttgaggttgttgttatcaggaaatgcccaaagttaacaactctaccttgggcaccgaagctcaaagaactggtcttgcgtgaatcaaatgaacaaatctctcttggagggatcaaatgtgtgacttcattgtccactttgtttttggagggtgtcaagctggaggatggtaaggagagatgggaccagcctccgtctgtggtaagtatgcaactatggagctgcattttgttcttccaaccacgtgcactagcactgtggtgggtttgctttgggcagctgcaagatctggaaattaccggatgtgatgatcttgtctactggccggagaaagcattccaaagtttgatttctttgcggaggctacggattgccgggtgcaataacctaattggatacgcaacggcgaatggtcctgaccaggcaacttcaggaaggagccagcttttgccccatctagagtctctgctgattgaggggtgtcaatgtctagcagaggtattcaattcctcccctgttctcaagaggatggatgtgataggatgtcctaagcttgagtccctatacggaaagcaacagttgaatgaagaggccagtagtagcgatgccgtgatggcatccgcacctgttgaggagaagctgtcaccatcggataagctccttccatcatctctagcaatatgggactgtcacgggttgttgtcatctctagaatctctaaggatatgggactgtcacgggttgtcagaggttgtcaatcttccctcgtccctcaggaaaatagatattcgaaattgctccaaactacgattcatgtcagggcagctggatgcactgaataacttactaattgtcgactgcccggagttgcgatcactagaaacatgcatcgtagatctcccatcactggaaagcctcgatctgcgtggttgcgaaagcctggcatccttgccctgcgcgcgggcaggaccacaggaatactcatctcttcgtcaccttacagttgggaagtgcccaagtagaaaatcgctgccttcagttctgcacactgtttttaaggcgtcgcctaggcgacgcct

SEQ ID NO: 106 - DNA, 3667 bp, Zea mays
acaagcttgtctactagtttgtgaataggttttaacttgtctatgttatcaactgcaaataacttacacttttaattgtttttacgttgtacttcataattaattgtagaacataatgatgcaaaggctatggagaaggctgctaaaagtagatccgtcaccaagccatgttcaaatgctatttatcatgtttaaagtgtgtgatgcactttgagcctttgtggcatgaatcttcactgatgcactgatggtatttctcatgtttaaagtgcatttacttcagttatgagtttagtcaatgtgttgctgttatgtgtaatgaatctgacacactgtgtattgtgtgcttcactgattattgttgaagccctggaggaagttgtttcttttgcaaatgacttgttatttattgtattgtgcgtgctcatgtgttgtttactgtggccggctgctgcttagcctgcttgtttgctgctgctgtttactgtgctcatgtctggctattgtttaatgtgcagtggccgactggccggctgcggcttgctggtgtgctgtgatgaatctgataggctgctgctggtttataatggccgttgctagcttgcttcaattgttcagtactggtggcatgtagagcagcagctacaatacagtttgtttttttgggtaaaatcgaaagccaaaccgagtttaacggttaaccgaaggacagattttcgattttccaaaccacatttagattgttgttgttttagaatccgaacttttaaaaaataaaactgaaaaactgaatggaacaaattcaattcactgattgcccaatcctactgccccgttcgagccgaatccactagaaaccgtttttatgggtattatagtattcactttaattcacatgtattgaaatatattgagatataaataaaactaaatcacactccaatcaatctcaatacacatggaattgggtgaatactagagtatccaaataaagttttatgattaatttagtgattagagatttcaaaaggatctatgatcaccaaatcagtccttatggagaaatttgataggggctataaaaccggagcggattagagttggtttggtgacaaaaaaatagagaggattcatggtaacaaaatcctattcaaatttgagaaaaatagtaacaagatttctcccattaattcccaccattttccaatttacaaaatcagcccttgctcgccccgccccgccccagctcgctcgcaagtcgcaacgcatgccctctcccgagtcctgcccctaccgacggtaccgtccgcgtccgcccgctccgcctcccaaacattccccccaccccctacgcgcgcgagcctaaaaccctagctccgtgccccgatcctccttcccgcccatggcctccgccgacgccgccaagcccgcgtccccgcccgccgcggatccgcccgccggcgacgccatggatgccgaccccgcgccccccgccggggaggaggccacgccgcagaagcagcagccggagaagaagcggcccggccggaggaagaagggcgaggcggcggccgcggcagacaagaagacgccgccgtccaagaagtcggcgggccccgcgctcgagcgcccgtccagggagaggaagacggtcgagaggtactcggagctcgcgccgcgcgccacgcccgccaagaagtcccccgctattctccaggtcagccagccgttagcgactcctccctctcccgctcgggcatgtcgcgcctgcccctgatctgttgttttcacgcggcttgcgtcccgcctgctgtcccactagcagcttgctaaaagtcgctactttcaaggatgtcctgactcttggaacacgcccttttccatgctagtattgccgtttgtgtttctgactgggaggtttgttcaatttttgtcctttgagctcatcttttcgcccccgcttttgtgctgcagggctccggaacgaagctcaaggacatacccaatggtaagctcgacctcctgaactatgccccactattttcgtatcactagcatgttctccctcttcgctggcatttcattgtgtgataatccctctacgctagtggcagaccattgtgtggtaatcgactgatagttctgtaaaaaaaccgtcttgtggattgtgtagggttactctcccgataaccctgcttttgatgtgtatcatatgatctttcacaccgtagagttttgtagagtgaagctggttctgcctggtaatccgatgtagagttgtgtagtttgacgatggactccctaaatgtgacatccttgtcctacatgttcaccttataaacagaccttctaatcagtggcatccaatttgagcacggcttttaagactttatacctttcttataggtgtctggctcttgtttggagtttggacttatcatttgtgtgtatttaggaatttaaactggtgcatgtggtgttgatacaatgcaaaagaatgaatcaataacttgagatacatttcacaagcttagtcccataggttgtaacggataatgtgctgctgtccagcctgataggttcctaagggcactaattgtgctgagttgacgtatgagagaaaatgacatccatgtcaggttccaaattagtcaattcttgcactgaacttatctatgcgggactggtacccatgtgcaaaaacaaaaaatgtctctgcatgcccacagccgtttcttcccatcgccaaataaaaaacagtccatacttgcttttgcccatctgttttcctcacaagcagaaaccagtggttctccttcccttattttaattgtcacgatttgactcttgaaatgagtcgattcattgtctttttctagtggagttactactccttagctcgtatgtatggtggacagggggctggtgacgatagtttcggcgtcatatggtggtgactggagagaggagggctgggagccaagggagctcgacaacatattgttgccttgcttgcctttctttattctttgcagctacttagagccattgtagcaccattaaatctctactaatataaagtaggagattttctgtgtgtcaccctcccgtgtacctctctgtgcgttacccctccttgctcccctacggcctttaaattgtaaaatgatagaagtaagctaaaattatgcacgagtgtgggcttgaaccatggttgttggctccaagcacacattcacacccacctagccaacagaacacacatgttttgtgttttatacaatatatgcaagcataatatagatatttttatgaaaaaataataccaggccatgctgcgcctagcccactgtgctgcacctaagccctaggcatgacatggtgatcgggttgggctgggtcgtgctcggttaacaacgggctgggtcgtgctcgtggggctaaaccgtgccaggccacacgaggaggacctcatcgccaccatcctcgcaagacgctcaggacttttggctgtttactttagtggcggcaaggcggagaggggcagcgacggctagagtttggtgctgcaagagccacctcacgtgagagggagacaacccagggattggaattgcggtttctcactcggcatatgaaatgcatttatgtacgttacatggtagac

SEQ ID NO: 107 - DNA, 3637 bp, Zea mays
gaccagatgggtcgcgtcatacgcgcccagcgtaaggaagccggctccgttttcaagtctcaggaggactggtcgtctcagcgaacaggctgcctcagccgcagcaaagtccgacaaggccacttagacaacttttgcggttgtttcaattacattagttgatagtcttctttgtgataaaacagttaaagctaaatatcaaaatcatatcaaagaagctgtagatttctgaaattttgattaattttctttttagcaacatctgcaggcactctgtttccaaatatgccgagcatgacaaggagctgcaaacccggtgcagcccacaactgaaaatccaacaagttcttggcctgctctgagaaggttctcccaagtccatcttcaaaagcttcagcagatgaacaatatgtcaaaatgtacgaagtgctgaaaatagtatctgaaaagtttcctctgagacagaaaaataaaggtggtgctagtcaacagaccaatgaaggtggtgctggtcaacagaccaatgaagtacctgctggacaacagaccaatgaaggtggtgctggtcaacggaacgatgaagtacctgctagtgttaagagaacctatttcaccgtgactaacattgtaaagttggctcaacattcggataacgaggagatctccatgcacatggacacagatatgctcgtcagacattttttcagtgtggtcttaaataacctgctactgccacaaaagtctatttttatgtaacctcacctgaacttcaagctgtatatgacctagaaaagttgaaaaaggttgactggtcatatgtgatatttcattcattaaagaaagctcttgcactgactttaagaagaatccggggcatatgaatggatgtgtccttatgtttctagtaagtaccaggataatgcagagcatatccataattccttaaagtaattgtttttctcatgttgggtaggaaagtgactaagtgaagaatcgttggttcacaggttgttttcatggactgtattcaaaggaacagcttggacacaatgttgcagaattaacctgtatacggaggcaatggtcgataaccttttgagtgcaaaaccaattaagaaaatcagtaagaggacaaaaagggtacgaaaaggaacctttaagacattttgactgcatctgattgttgcaatgcaacttcttatttctttatgtccctttcagctggctgcggaggaaaaggaaagggcagcagaggcacagaagaaagtgatgttgctggaggatgttgatgtaagtactattctattattgttctatgaggtgatgcggaagtgtagtccaaagaaactgactgcacccccttgatgtcctttttagttgattagctgggaagatagctgcttcagacaatttgcagtgctgcatgagaagtcttcttgtaagaggtaaaactagaataattgttaattttttaacctctattgcaaatttacctaacctctgtttcaacttttttagcatcttgacataaatgatgcagatagcatatacaagaagcatattttagaaagatcccacaacagaattgttttagactttccttcctgtgaagtacgggaatctacttttattaattgtttgcaaccatgtggtcatatgcattcccttgtatttcatttggtatgcgaactatggtcagtggggtggcatgataaaattattcttagtgaaggtgctgtggtaagtacttttacctatgattgtcatctcaaacttagttattgttattctttaactatggttgttgtatctttgattgttattccagaatgatttgttgaataaagacataataactgctaaaagtctgaacagggagcttactccaaataaagtgaggtatgtgaatcaggtttgtgctctttgtatttcaatgttactgggaaagctctgtatttctcaatgctctgtatgtctaattgttttttccccagatttttgttcctatagtttataatcatcattggtcgctagttgttgtttctactgtgcaaagaaagatatatgtccgactcttgtcgaggcatatataaagaggtgccaattacgttgcttgaaaaactgcagacgtttttgcaacgtaatcacatggacatatctggttatgatacagaaacactgatggttcagcagcaaaataacacgtaattgaacgtacaccaccttagtcttgtagcctcctccgtcttgtcatcttgctttataagaaaaaaaattgactgaactactgctaggtttttctttagcgtttaccatgctatctcctattttcaaccttgctgcttcctgtttccaccatctttgatctctctttctgcgaattcttgcagctattactggggttttcatgtattgttgtatatacgagggttcaatgagatggagatatataacatcaatgaggtaaacattcagctttgtggttttcaagttctgttgtattcgaattctaaaacaattgatttatgcctcaaaattgcaggaacaagtgttgatgctccgaaaggagcttactaagttcctcctcactcatgatatgaatagaaaatgccctgactcaaccaagaaggatgctagcatcagcattcaagttttggaggaggagaaaggggacagtatcggctcctttgttttgtgaaactcacaggtgacatacaatgttttgtgattgaacaatgaatgtcagtgtgatccagaggcacaactcacaggcaaaaaccgtgccacaagaccagatgaggtgcaggcaggaggggctgcagggcaggtgcatattgataagctctcgcccagtctttcaaagaagagggcccattccttgcatgaggaccagcctgacggtcagttaactccagttaaagaactcacatatgaagcagttgtactagaggaagaagatgttttctcagccaagaacgatgctagcaactccagccaagaagaactctcagttgactccagccaagaagaaccctcaattcaggttttcgagaagaattgaaggaagtggacacaagcaatgtgccatttatagagagcaaaaggtttgaaaaacttgcatccatgagtacaacagagagtactgagatgaaccaggttttggaggaggaatgggacgatatcagtacaggtaagagccctggcaatgttccacttttaaagagcaaaaggaagattagttcaaccatacccagagatgagtttacaaaactttcatccatgagtacaaaagagagtgctgagttgtaccaacgtgtcaaacatcactggtaagtttatggatgattataatttgttgagagttgtttgaataaactgactgatattcatatcatattttttttgttggcacagcatggatgatactttgctgttcaatgtggatggggccaccatgacatgtggtgatcttgtaaagtgcttcgaggaaggtggcactgccacgaaagtaattatgaatgccttcgttgaatgcctcaagtttgatgatcgaaataaaaaatatgacaaattaagaatcaagtttggagtgcagacctacaacacaatcttaggcaagcgattgtgaaggagcttg

SEQ ID NO: 108 - DNA, 3636 bp, Zea mays
tgtggaaagatatcaaatgtttcatggttatgaacattaatgtaagtttgaagcggttcaaagccctaaatgacgtaatgtttagaacggtagtttttacaaaaatgacccaacaagatttgtcatccatgttttcgcaatacactgatttgggagtaaagtgtcatgatttcgtgcatgttttttcgaaaagattgtggcatgaaccatttgaaaactctgaagcttttcgaagccctaaattatttggtagatttacagaatgatccaacatgttgtttgacatgctccaccaacaactaaaattcaacacaatcaataacttgagtataggacccacataattagcgggtcgcataccgattaaagttcagtgttttaaagaattaaaagtatttgaattgcaatatgcaaatttttcaagataaactattttgcagagttacaacctctattaatggaaaaatagttaatgaaagaaaatttatatttccactttcattacactttcctaaatgtcgtcttgtaagacatacatgtttaggcatgttaccttaaaaacatatatagtgctatttgcaatgttcctcagttgtgaacacatcaacccaagtttaaggcagatcaaaacatgagtaatggactaatgggtattatattagcacaagtttgctacatgatatatcgatttttgatgtgcgtcaacttcaaagcattttgaagccctaaatgttgtattgtttagacagacagtttttatagatggcccaacatgttgtttcgcatggaccatcgttaactcatgttcgagacaaccataacatgagcatgcgaccctagattgtcgcattctagcagtagatttggtcatataaaggatgaggtgactctaagagcgcttgaagaacaacatgtagatttttttcagatcatcaatttactataggcgtgagctatgcaacatgttgtttcacttgcttcatcatcaacctaagtgcaagacaacctatagcttgagtttggggcccatgatattgtatgtttgaatgctgccactatagtttgtagatatgaagaatgaggtaactttagaaatgtttaaagtgcaacatgtatattttttagatcggtaattttccggagttgagagctatatttatgcaattatgcttttatttcgatccatgttttaagattctttgatattattctattaaagttatatcaatgatatctataacaaaagaattaaatatagaaaaattctcattccaattttaattacaatttgctctatgctagactataaacaataatattttaggcatgctatcttaaactatatgtactgctattttagatgattcttggttatggacaacaatgcatgtgttgaggccactaaaaaaaattatgtgactcatgatatttttcacaaaacaatttaaccaaggaaaattacattacaatttgcttattgccaaaatgtaaacatcacttgtttgggcatgttatctcataaggtatgtggaaaacttttaaatgtttcatggttatggacattaatgtaagtttgaagcggttcaaagccctaaatgatgtaatgtttagaactgttgtttttacaaaaggacccaacatggtttgttatgaatgttttcgcaatacactgatttgtgagtaaagcgtcgtgattttttgcatgttttcaagaaaagattgtggcatgaaccatgcgaaaactttgaagcttttcaaagccctaaattatggggtcgatttacaaaatgatccaacatgtttcacacactccaccatcaactaaaattcaacacaatcaataacttgagtatgggacccacaaattagatggtcgcatgctgattaaagttcagtgttttaaagaatgaggtaactttagaagtatttgaatttcaatatgcatatttttcaagataaactattttgcagagttacgacctctattaatggaaaattagttaatagaagaaaatttatatttccactttcatttgtcttttctaaaagacatacttgtttaggcatgttaccttaaaacatatattgtgctatttgcaatgtttcttagttgtgaacacatcaacccatgtttaaggccgatcaaaacatgagtacgggactaatggatattatattcgtacaagtttactgcatgatatatcgatttctaatgtgcgccaacttcaatgctttttgaagccctaaatgttgtattgtttagacagacattttttatggatggacccaatgtgttgtttcgcatgcaccatcattgacccatgttcaagaaaaccatatcatgagtatgcgaccctagattgtcacatgctagcactagatttggtcatatgaaggatgaggtgactctaaaagcgcttgaagcacaacatgtagattttttcagatcatcaatttactataggcgtgagctatgcaacatgttgtttcacatgcttcatcatcaacccaactgcaacacaacctatagcatgagtttggggcccaagatattggatgatggaatgctggcactatagtttgtagatatgaagaatgaggtaactttagaaatgtttaaagtgcaacatatataatttttagatcggtaaattttcggagttgagagctatatttatgcaattctgcttttatttcaatccatattttaagatcccttgttattattctattacagttatatcaatgatatttataacaaaagaattaaatatagaaaaaaaatttattccaattttagttacaatttgctctatgctagactataaataataatagtttaggcatgctatcttaaaccatatgtagcgctatttttaatgattcttggttatggacaacaatgcatattttggggccactcaaaaaacaagtatgggacttatgatatttatcacaaaacaatttaaccaaggaaaattacattacaatttttcattgccaaatcataaacatcacttgtttgggcatgttatctcataagatatgtgaaaaaatttcaaatgtttcatggtgatggacattaatgtaagtttgaagcggttcaaagccctaaatgatgtaatgtttagaatggtagtttttacaaaaatgactcaacaagttttgtgagtaaagggtcattatttcgtgcatgttttctcgaaaagattgtggcatgaaccatgcgaaaactttgaagcttttcgaaaccctaaattatgtggtagatttaaagaatgatccaacatgttgtttcacacgctccaccatcaactaaaattcaacacaatcaataacttgagtttgggacccacatatttagatggtcacatgccgattcaattttattgtttttaagaatgaggtaagtttaaagtatttgaattgcaatatgtagatttttcaagataaactattttgcagcgttacggcctctattaatggaaaaatagataatggaagaaaatttatatttccactttcattactctttttctaaatgtcgtcgtaacaccccattttcccaaatataatggatgtcaccaaaaacacttcccacaaattattatgtattaaaagatgaagacggaaagg

SEQ ID NO: 109 - DNA, 3603 bp, Zea mays
tttatacacaccctcaactgatttgatgaccgcaaattaggagggatccataaaaaggaatccgttgttattaaaatttgatgaatagcaaaaccagtaataaaatgtagcgactaccggccctcactttgcacacttccaatctcttcccatctgccgcgagttgctacgctctcacaagaactcgctcgacccccaaacccctcttgccctagcgctccccgcccctgcccctcgccgccggcgagatgatccccgtcagtgccgatgtcgctgcggagctgcgcctcctgtttgaatgcgctacggactccaacttcgactccattcggcgcgagatctgccaggtacccatctgtactgctggaccctcccgcttcctgccagcgttacgcccccctccctctcttcgattcttagcttcccagtctggatccgcgggttctagtgcgttctcgccaatgctgcgtcgcctgcattcttgtgagcgcgttcaattcctccctagcttaggatatggtagcgtttaacggtacgattgtcgattctgagtttagatttgttagagttgcaggccacaagttcagcgctagcgacctaggttaacacaagtgggtttttgggacttatggccgcgcttaaactctgtatgaatagttaaggctcattcgcttcactagctgatctatttcatttcctcaatcacagagctcgtggtgactttttcattggcagttttagttcaaattctcgttgaaccacctagtgggtttttggacttatgaccgcgcttaaactctgtatgaatagctaaaactcattccattcactagctgatctatttcatttcctcaatcacagagctcgtggtgacttttcattggcagttttagttcaaattctcgttgaaccacctactgtagtttcgcaaaatagagcagtttacctacttgcttgataaaatgagtttcttctttggcttcgatcatatcttagttctaattactgaatactgagtctgctcgatgttttctaattccaattattttccccaccttttcagttagttgacagtggcctggatggatgcattttggtgctccgagtatgtctgaatcaagtgttgctgaatgctggggaggtcaagaacctccagttgcagttgcaacaaaggcttttatctgatgttttcagatattgtttgcgcaagacatgcttcacaaccagtttttgtgaggtgctgacaacaatagccttgacggatgattttcttgaaagtctgtcaaatctgctggaactctcagttgccgagaaaattggtgttgggcttgcgctctcagattctgagaactcagagataaagcagaaaggtagacatttctctgtgagtctagtgatatcatatccgcttctcttattttcagatgatcattgacattgcctcttgttccagggcaatggttttcaattgctcaaattgaagagctgtgcatgaatcctatccaatctgtatcaaatgatcaaattcatgaaattgtcgtgtttctgcatcagtatgatggcctgttgaagcatctggacactttaaataatgttgtatctctactaaaagtcacagagaggccgttttttgcacctgtcactaatggagattttgatagacaaccaaatctttcaaggtattcagtttctgactaatcaaattctgaatatgtgtacttcttcattcctatttattcacaaatgctccccctctttttttgtgccatgtagacatttggatatgtacttgggtagcacaaatgatgattttgagtcacttctgtctgaaatcgggaaagaaataagcatggctgacattgtagctgagttgggttatggatgtactgttgacaacactcgctgtaaggaaatactttccattgttgagcctcttgatgatgtcgccatatctaagttgcttggggctgttgttggcactcatagtggtcttggagatgcccataacagatatgcaacatttgtatctgctattcttaatagccacacgaacgactcatctcagctgactaaatggaacgcagatgttcttgtggattcaatcaatgaactcgtaagctattgacttcttgcttttttattggatgttcttttttttatcttgcacccttacgctctatctctctttaacacgcaggccccaagtacaaactgggtgcgtgtaatggaatatcttgatcacgagggtttcaatatacctgatgaaacaggcttttacctattgatgtctatatacacgcgtgcttgcaaggtatgtatatataaacatttctattcttggaaaatcaactagctgcttaataaattaattggattatacaggatccatttccacttcatgctgtttgtgggtcattgtggaaaaacagagaaggccagatatcgttcttgaagcatgcagtttctgcttcacctgataaatttacatttgctcattcgtccaggcacttggtaattctgacaacatctggcatcttgataaaattctatccaattcacacctaacagttgtcatatactgtaggaatttcaggatttggcaggtcctagtcaaggcaatcatgcttggtcctgccttgaccttttagaagttttatgccaactagctgaagttgggtacgctacatctgtacgatcaatgcttgagtatccactgggacattgccctgaactcttacttgttggtgttagccatgtcactgtatgtatttctattcccacctaatgggtttgcctctagtttcatgactttaatagtgttaagttccccttatctctttctttttggtgttagctgcatcgacgtatgcatttctggtcccacataatgagtcgcatctatttttatttgtttttagcagtgctataaattccccttgtctctttgcagaccgtgtataatctccttcagtatgaagtactgtcctgcatatttcctgctctactgaaggatccaacaaagcacaatgttatgaattatctctggcatacaaacccatacttcacccttcgaggttttgttgatgctcatagtgatccagattgtttgctaagaactgttgatgtttgtcatgacttgaaggtttgtataagaggaatgcactttattttctgaaattgtatcgtatcaaaacttatccacatgaaagtaactttttttttcatctgtttgttattgggaccatgctacaatattacttcaatgctgtaacactattttctcacaaatttgtttcactcaacttttatttctactttaaacagattctgtcttctgtccttgattctactccatttgcattttctataaaattggctgctgctgccttgaggaaagactatagtcatcttgagaaatggctgactgaaaagttatctttatatggaaaaggtttcgttgaggtaatatgcataatctattcttgtaagctgctacatttcagctgacctgtggacaagttgtcgcggccgcttctatagtgtcacctaaatactagtgactccagcgtaactggactggccacagttaggccgcaaatgtaa

SEQ ID NO: 110 - DNA, 3587 bp, Zea mays
acatatatgtagttcttttctcaacgtgtaaagaaaattactggatgattgataattatagtacaaaccttataaacttaatgagtgattgagaaagtgttgaacaaatactgcaaaattactgcatatttattgttcttttcttagtgtgttaatgaaattactgggtgactgaggaagtgttgaacaaatgctgcaaaattaatcagtgattactgtaaaattactatgtaactactcaatctgggtgattgaaattacggaataaatggtccaaaattactgagtggagactgtaaacttatttactaactgacttgcctataataaataaaggaagagtccgcaaagctgagctttcgattcgctccccaggccctcaaccctgtttgcctcctttctcttgcttgatggaatagttcaatgcccgagctccagctttgcttgcgttcttcaccggcgctcgccggatgtatcactaattcggaaatcatgattgctaatcagaagattaaagctgatgttgctaaaaagaggaaagcctctaagagggggagacaccccttctcatattgaagaataggcatggaatgcattcccgagctctatagtataaaccattgctgaaagtcttatatattaaacgataaaccagaagtaggaccaaaccgagagtgactagcatagacaaggatagatttgtgaatgagacatagtacttgccaatattcagatccagaattgggtgaattccaaattgatccaatgggctttggttgttgagattaggtagccaggtaggttaccaaaataccctcttccttgttgggcaatcaagtcgtcccagttgccctaggcagacattcgggcgtgcagatcttgtattctctgaccaatacaactacgtccctgaggtgtgtgaatctcctcgagtaaggagcgccaaaaagcgtgcataggttgattagtctaaaaagagaggcttccttataaggccattgctgctcgctcggattcattttccaggtcctacatgttctaggactatagatgatccaacatgcctatatttttcattattgtcttatgctttagccttcttttataagcacttactggatgattgataaatatagaacaaacgttataaaattaatgagtgattgagaaagtgttgaataaatactgcatatttactgttcttttcttactgtgttaatgaaattactgggtgactgaggaagtgttgaacaaattctgcaaaattaatcagttattactataaaattactatgtaactactcaatctgggtgattgaaattactgaataaatggtgcaaaattactgagtggagactgtaaaattatttagtaactagataatcactacatatctgttgttattttctcaatgggtaaatgaaattactgtgtggttaaggaattaccgaacaaatgttgtcaaattactgagtgatttatgtaaaattatcgagtgattactgtaaatcaactgagtaactagacaatcattgcatttatgttgttcttttctcaacgtgcaaagaaaattactgaatgattgataattatagtacaaacgttataaaattaacgagtgattgagaaagtgttgaacaaatattgcaaaattacttcatatttattgttctttacttagtgtgtcaatgatattacttggtgactgaggaagtgtcgaacaaatgatgcaaaactaatcagtgattactgtaaaattactatgtaactactcaatctggtgatttaaattactgaataaatggtgcaaaattactaagtggagactataaaattatttagtaactagataatcactacatatctattgttattttctcaatggataaatgaaattattgtgttattaaggaattaccgaacaaatgttgtcaaattactgagtgatttatgtaaaattatcgagtgaatactgtaaattaactgagtaactagacaatcattgcgtatatgttgttcttttatcaacgtgtaaagaaaattactgcatgattgataattatagtacaaacgttattaaattaatgagtgattgagaaagtgttgaacaaatactgcaaaaattactgcatatttactgttcttttcttagtgtgttaatgaaattactgggtgactgaggaactgttgaacaaatgctacaaaattaatcagtgattactgtaaaattactatttaactactcaatctgggtgattgaaattacagaataaatggtgcaaaactactgagtggagactgtaaaattatttagtaactagataatcattacatatctgttgttattttctcaatgggtaaataaaattactgtgtgattaaggaataaccgaacaaatgctatcaaattactgagtgatttatgtaaatttatcgagtgattactataatgtaaattaactgagtaactagacaatcatagcatatatattgttctttactcaacgtgtaaagaaaattactggatgattgataattatagtacaaacgttataaaattaatgagtgatcgaaaaagtattgaacaaatactgcaaaattactgcatatttactgttcttttcttagtgtgttaatgaaattactgggtgactgaggaagtgttgaacaaatgctgcaaaattaatatgtgattactgtaaaattactatgtaattactcaatctaggtgattgaaattactgaataaatgttgcaaaattgctcagtggagattgtaaaattatttagtaactagagaatcactacatatttgttgttattttctcaatgggtaaatgaaattactctgtgattaaggaattaccgaaaaaatgctgtcaaattactgagtgatttatgcaaaattatcgagtgattactgtaaattaactgagtaacaagacaatcattgcatatatgttgttcttttctcaacgtgtaaataaaattactggatgattgataattatagtacaaacgttataaaattaatgagtgattgaggaagtgttgaactaatactgcaaaattactgcatatttattgttcttttcttagtgtgttaataaaattactgggtgactaggaagtgttgaacaaatgctgcaaaattaatcagtgattactgtaaaattactatgtaactactcaatctgggtgattgaaattactagacaaatggtgcaaaattactgagtggagactataaaattatttagtaactagataatcactacatatctgttgttgttttctcaatgggtaaatgaaattactgtgtgattaaggaattaccgaacaaatgctgtcaaattaatgagtgatttatgtaaaattatcgagtgattactgtaaattaactgagtaactagacaatcattgcatatatgttgttcttttctcaacgtgtaatgaaaattactggatgattgataattatagtataaacgttataaaattattgagtaattgagaaagtgttgaacaaatactgcaaattactgcatatttattgttattttattagtgtgttaatgaaattact

SEQ ID NO: 111 - DNA, 3586 bp, Zea mays
tatttagttcttttgttataaattgatataaatgtaatagaataataacaaagaatcttaaaacatggatcaaaataaaagcagaattgcataaatatagctctcaattctagaaaattaccaatctaaaaaatatacatgttgcactttaaacatttctaaatttacctcattattcatacctacaaactctagcgccatgattcgaacatccaatatcttgggccccaaactcatgctataggttgtcttgcacttgggttgatgatgaagcatgtgaaacaacatgttcggtaactcacgcctatagtaaattgatgatccgaaaaaaatctacatgtaatggttcaagcgcttctagagtcccctcgtccttcatatgaccaaatctagtgctagcatgcaacaatctagggtcgcatacttatgttatggttgtcttgaacatgggttaatgatggtgcatgcgaaacaacaagttgggtccatccataaaactgtctgtctaaacaatacaatatttcaggcttcgaaatgcatcgaagttgacgcacatcagaaatcgatatatcatgcagcaaacttgtacgaatataatacccattagtcccatacatatgttttgatcggccttaaacttgggttgttgtgttcacaactgaggaacattgcaaatagcactatatatgtttttaaggtaacatgtcgaaacaagtatgtcttagagtacgacatttagaaaagagtaatgaaagtggaaatattaattttcttccattaactatttttgcattaatagaggtcgtaactgtgcaaaatagattatcttgaaaaatatgcatattgcaattcaaatacttttaaatttacctcattctttaaaacactgaactttaatcgacatgcgaccatctaattatgtgggtcccatactcaagttttgattgtgttgaattttagttgctggtggagcgtgtgaaacaacatgttgaatcattctataaatctaccacataatttagggtttcgaaaaactacaaagttttcgcatggttcatgcctcaatcttttagagaaaacatacacgaaatcatgaccctctactcccaaatcagtgtattacgaaaactttgatgacaaaccttgttgggtcgttttgtaaaaactaccattctaaacattacattatttagggccttgaaccgcttcaaccttacattaatgtccataaccatgaaacatttgaaatctttccacatatcttatgagataacatgcccaaacaagtgatgtttacagtttggcaaagagcaaattgtaatgtaattttccttggttaaattattttgtaataaataccatgagtcccatacttgttttttgagtggcctcaaagcatgcactgttgtccataaccaagaaatatataaaatagcactacatatggtttaagatcgcatagagcaaattgtaattagaattggaatgaaaatttttctatatttagttcttttgttataaattgatataaatgtaatagaataataacaaagaatcttaaaacatggatcaaaataaaagcagaattgcataaatattgctcccaatccagaaaattacaaactctagtgccatcattcgaacatccaatatcttgggcaccaaactcatgcgataggttgtctatgttttaaggtaacatgcctaaacaagtatgtcttacagtacgacatttggaaaagactaatgaaagtggaaatataatttttcttccattaactatttttcctttaatagaggtcgtaactctgcaaaatcgtttatcttgaaaaaactgcatattacaattcaaatacttttaaagttacctcattcttcaaaacactaaactttaatcggcatgcgaccatctaattatgtgggtcccacactcaagttttgattgtgttgaattttagttgctggtggagcgtgtgaaacaacattttggatcattctataaatctaccacattatttagggcttcgaaaagcttcaaagttttcgcatggttcatgccacaatctgttcaagaaaacatgcatgaaatcatgaccatttactcccaaatcattgtattgcaaaaactttgatgacaaaccttgttgggtcgtttttgtaaaaactttcattctaaacattacattatttagggctttgaacgtcttcaaacttacattaatgtccgtaaccatgaaacattttaaatctttccacatatcttatgacataacatgcccaaacaagtaatgtttacaatttggcaaagagcaaattgtaatgtaattttcattggttaaattgttttgtagtaaatatcatgagtcccatacttgttttttgagtggcctcaaaacatgcaccattgtccataaccaagaaatatataaaatagcactacatatggtttaagatagcatgcctaaactagtattgtttatagtctcgcatagagcaaattgtaattaaaattggaatgaaaatttttctatatttaattcttttgttataaatatcattgatataactataatagaataataacaaagtatcttaaaacatggatcaaaataaaagcgaaattgcaaaaatatagctctcaactttggaaaattaccgatctaaaaaatatacatgttgcactttaaacatttctaaaattaactcattcttcatatctataaactctagtgccagcattcgaacatctaatatcttgggcccaaactcatgctataggttgtcttgcagttgggttgatgatgaagtatgtgaaacaacatgttcgatagctcacatctatagtaaagtgatgatctgaaaaaaatctacatgttatgctttaagcgcttctagagtcacctcatccttcatatgaccaaatctagtgcaagcatgctgcaatctagggtcgcatactcatgttatgtttgtcttgaacattggttaatgatggtgcatgcgaaacaataagttgggtccatccgtaaaaactgtatgtctaaacaatacaacatttagggcttcaaaatgcatcgaagttgacgcacaccagaaatcgatatatcatgcagtaaacttatatgaaattaatactcattagtcccatactcatgttttgattggccttaaacttgggttgatgtgttcacaactgaggaacattgcaaatatcattatatatgttttaaggtaacatgcctaaacaagtatgtcttgcagtacgacatttagaaaagagtaatgaaagtggaaatataatttttcttccattaactatttttccattgaaagaggtcgtaactctgcaaaatagtttatcttgaaaaatctgcatatagaaattcaaatacttttaaagttatctcactctttaaaacacttaactttaatcggcttgcgaccatctaattatgttggtcccatactcaagttattcattttgttgaattttagttgatggtggagcgcgtgaaacaacatgttggatcattatgtaaatctaccacataatttagggctttgaaaagcttcaaagttttcgcta

SEQ ID NO: 112 - DNA, 3585 bp, Zea mays
ccccataacttgtttggcgcacatatgagacacacccggctttatccattaaatccgtgtgtgacaattactcagttatgccgttctaatccctctttttgtttctcagttattttgtgttcattactcagttatgtcgttctaatccctcagttattctactccaatacctcagttattctattataatacctcagcctcagttattttgtttctttttctttgtctaatatgctcatatttttgtttgcatttagtctgacccagagagatgccatttctttcgatggcatgatccggttttttctcaatatatcacgaatttgttgggggacttgcgagacagagtggatgaactgacgaaggagattgatgcattacaaaataaggaacaagaacttaaggactctttggaaggtatgatgcagctattgaatttggagtaaaggtgtagtcgtgttcatgcagccttagcggtaagccgttttctgcctatttctcttttgtagccatgtcagttatttatactttgttctttttatgttgagaagggcttggggtgctagtgaccaatgtgctggtggttacctccattgtggcaactacgcacaagtagtagcacggaggaagtaaccatcagcatattgggcacacctccaccatccgccgtgacgctctcctggccaaaaggttggtcattgctgcaaggaggactagtcggctcagatgacaggctgcctcagctgctaccaagtcaggctacttagagtttgtagggtgatgtcatttggacctcgacgagatccaccactcgattatattgtactggatgctcacttatttatgttccaaactcagttattctatgatgaacgctcagttgttttatgtgccactcagttattttattctgaatagttattctaatatgtgcaactcagttattgtaatatgcgcaagttatttatgtgccactcagttattctaatggacgcactcagttagtctggtgtcggaactcagttattccattctaatacctcagttattcttgtgggccgactcatttattttcttctcgtgactcagttattctactccaatccctcagttattccgttataataactcagttattgtaacgtacccactcggttattctctgttcacaagtcagttattccgttccagtaactcagttattctagtgtggcgactcagttattcttgtgtcagtactcagttattctggtgacggaactcaattattacgttctacgacctcagttattctaatgtgcacactcagttattctctactcattactcggttattccattctaataactcagttattctggtgacggaactcagttattacgttctactacctcagttattctaatgtgcacactcagttattctgttcaaataactcagttattctactaattactcagttattccgttctaatacctcagttattctagtgggcgcacttagttattccatgttcatttctcagttattctcggttcagtactcggttattctgtgttcatcactcagttattctggtgacgaaactcagctattctctgctcgtgcctcagttcttgtgggccaacttagttattctactccaatccctcagttattccgttataatacctcagttattctagaccctcagttattatgttataataccacagttattccatgttcctaactcagttattctaatgtcggtactcagttattctaatgcgcgccttgagttattccatgttcatcactcagttatcccgtgtcatacatcagttattgtaatgtgcctactcagttattatatgttcatgactcagttattccgttccaacaactcagttcttctaatggacgcactcagttattctggtgccagaactcagtaattccgttccaatacctcagttattcttgtgggctaactcagtgattatggtgtgcagactcagttattctggtgtcggcactcagttgttcggttctgatccctcagttattctactccaatccctcagttatcctgtatcgtacctcagttattgtaatgtgcccacttagttatgcggtgtttattactcagttattctctattcacagtcagttattgcgttcaagtaactcagttatgctattgttcattactcagttattctgttgtgcacactcagttattccatgttcactactcagttattatctgttcattactcagttattccagtccaacaactcagttcttctaatgcacgcactcagttattatggtgacagaactcagttattccgttccaataccttagttattcttgtgggctaactcagttattctcctccgatgcctcagttattggaatgtgcccactcagttattattgtgtacagactcagttattctggtgtcggcactcagttgttcggttctgatccctcagttattatgttataatacctcagttattgagatgtgccgactcagttattccatgttcgtcactcagttattcttttgtcggaactcagttattctaatgggcgcacacagttattctggtgtgatgactcagttattctcgtgtgcctactcacttattctctgctcattactcagttattctctattcatagttagttattgcgttctattaactcagttattccatgttcgccactcagttattgtgttttcattactcagttatttcattccaacaactcagttattctaatggacgtactcagttattctggactaatacctcagttattgtaatgtgcgcactcagttattacatgttcagtactcagttatttctttcagtagctcagttattctattgtgcggactcagttattctggtgtcagcactccgttctaatacctcagttattctctactcatgactcagttattctagtgggcgcactcagttattccatgttcatgtctcagttattctggagtcgacactcagttattctggagtcggcactcagttattccatgttcatttctcagttattcttggttcagtactcggttattctgtgttcatcactcagttattctagtgacggaactcagttattctctgctcatgcctcagttcttgtgggccaactcagttctactccaatccctcagttattccgttataatacctcagttattccatgttcctaactcagttattctaaaccctcagttattatgttataatactgcagttattccatgttcctaactcagttattctaatgtcgatactcagttattctaatgcgcgccctcagttattctatgttcaacactcagttattctctgtacattactcagttattctctgtacgttactcggttattgtgcgttcattactcagttattctagacgacgcactcagttattcaagtgacagaactcagttattctactccaatccctcagttatcctgtgtcatacctcagttattgtaatgtgcctactcagttattatatgttcatgactcagttattccgttccaacaactcag

SEQ ID NO: 113 - DNA, 3582 bp, Zea mays
ggcgccgcccactctttctttctcttggcccgcccgctccccgtctctgtccttcgccgccggtctgttcctgtctgccgccgtcggtcgggccctgtccgccggccgcccgcctgcccgtccctgtctgcccgtctgtttctgatcgttgatggctttcagataaacaagatttgggccagcttcgaggaaacagcatgggaggagcaacttgtgaaaaagagcagcttcgagtttgcgaccagttttatttgcgtgtcctgtatgaattgaaatgaaagtgtccatttttatttatatataacagcacatttatctcaaaccacactatatcaggagatttagtaggatttaattgcactggttagcttaggaaacagagaaatgaaactacgcattgagacatagtgttttgttcatcctctaatctgatatgacgttcttgaaaatagggatgtgaaaccccatattatattagtttaagatagtgtttggttaagagctagttagaatggacccatagagcggctccattctagaaacgactttgtccaaaagaatttagaaagccaaatggtttactatttaaatataattttctttttttaagtcactctgtactataaaaaattaattcaaacaacaataaattagaaatagacgatttatcacaccgtacttcggaaccaaacagcaactaaaaaaccggccggtaaagtttcacctgtcgaaaaatgtaagaaccatcggccatttaataaagaggccgatcagccatactattcgagaattatttaaacattcggctattcccatattctacaacatttagtgggtgatatcatcagctgttgattatttatttattcccgatgtactgtagtctgtagaccattatttttgccccgatggtctaggttatgtttagtgattgtacatttgtgccactgtttaataggagtagtactgtacatggcaagaagtcaagaactgtgtcgatggaactatgcaatggctcctgcagcagtagcagtagctagtataaatgtgcggcaggtacgcttgtcgtccaccatctcagctgatgaattgatgatgacgatgggggacaagaaagacaacgcacgttgtgaagagttatgaattcctatccagtccaccagacgcagtaagactgtatttgatggatggcataaaatatagatattacaatgttgataacactgtttgtaaagttaaatttaaaatagagataagatataggatgagataatctaaaatgttatagtgatgtcgtaaggattttgtcgttgttcgctaagctataactatgtagtcttacatttattttgaactttgtaaacagcgtaatatataatacgattcattattttacactatgtggacaacctgcttcagttgtgctttctttttctctcaccaaaacacctccatagtctgccattgaattcaataatgttgttgagacgtgttatgagttagaatggtgccactataggctataggcctctatttagaacagtagttctagttataatttacatataactaatcttaaataaatacggtttcaaatttcacttaagcgtggtttcaaattttagagctaaccttcgatatatctaagaatatcttaccacctatttaacctttgatatatctaagaatatcttaccacacattttgtctaagaaaatttagctacactttgtcattttataacatgtacagtctaaaggaattttatttaaatttagtataaccaaacacgtgtaaacttgatcaaatttatatataaaaaaacaaaacatgaccagcaaacaaatacttaaggtctcgctccttggctcaacccgtagagcccgtgaattgaggtcaagaaaagctaaatattttttggtagagctcttccaatttctaattttttttgtctgaaataattttctatggttttctaggataaattatactctttccatcctaatttatttataattcatttgagttttttttaccatttttaatcggttgtcttattcaaatttcttagaaaaatagaaaattcaaagccatacttaaaatatattatatgttgaatgataccaagtaaaaattattgataattacgattttttaataagatgacttagtcaaatttagtgtaaaaactcaaacaaattataaactggacaaagggagtacacaaagagtcatttttttctacgattgtttacaaccaaccacgccagggcatagcttcttactaggtttgtttggtttgctaactcaattgtcacagtttgtcatgtctaaggttagacaattttgactaagttaggtatatgtttgatttatagccataatggtgacaaaaaaaatttgtgctgcgtaaatcgcacttgtcaatgacttgtaaaaatacggtagattcttttagacatgccactattgtggggcagaatttaaacttctaaccttagacaagtgtggtaaaaatacatgacaatttttggtgccttaagtatagggcaaaccgtccctaaaatcctccaatttcaattatattcacgtcttccctgatgacgaggtagattggactggagtagttttggcttttgcgatcatcttgacaaaggctttactgctgtaagtttcagcgccccatgccgtcgtcgatttattagtagatagctcaaactgatgctcaagtagtgaaccaatggtatttcatttctttttcctttttgataaatgatattctcacttagaccatgttatgtattgattgttcttatactatgttgtgggtgtcatggatctcgccattatgtaagactagtacaatacatgtacgtgcgacagcaaacaatcatatttgacactcataaaaaacaaatttaatatcaaagtgagtatatagtccattgataagaacaattgccactcacaaaaagaataaatcatagatccataaacggtacatgttaaatatttaacaaaaggtagatagtccacacttaggtcggatgcaaatacgattccaactcaccccatagaaggcgcccggtgcagggatgcctgggcaacggagtccaaggtgctcaacgaggttatccacacaaacatgctcgtcctctgcgtgttgccctgctcctgctgctgctagccagtaggctctccagctgcatccctctgctcatggctctattggtgttggtggatagggagagcacatgaaacgaaagcaccaccaccagccccaaatctatgggggcatggaacggcgcaacgcgagaccgggaggccaaaagtgccttttatagggttcacggtacacttcgcgtcgtgtgcggagggttctcgcagccgttgggagatccggagatcatgtggcgacaaagcacgatgagtctagagtatactccatgttgtgcgcggagggttcgtgcagccattgggaataaacccgaccgacgaggcaccatggatgccacacggctgagcgaagcatgttgtgtgcctgcgtgctacgagtggatgaaaaagggaatgaaatggaac

SEQ ID NO: 114 - DNA, 3556 bp, Zea mays
ggggaaggttataatccaatatgcgttcactgccctaggatcaaagatcaatggcccgaaatcatccacacaacagatttagcacgggccctccgtttgatgatctacggcccagacctttcctagccgaaagggtatgcgagatctaatctgtgccgttcaccttgccctaggatctaatccgtgtcgttcaccttctactacctcagttattctaatgtgcacactcagttattctctactcattactcagttattccattctaataacttagttattctggtgtcagtactcagttattctggtgacggaactcagttattacgttctactacctcagttattctaatgtgcacactcagttattctgttctaataactaagttattctactaattactcagttattccgttctaatacctcagttattctacttttccgactcagttattctggagtcagcactcagttattctagtgggcgcacttagttattccatgttcatttctcagttattctcggttcagtactcggttattctgtgttcatcactcagttattctggtgacgaaactcagctattctctgctcgtgcctcagttcttgtgggccaactcagttattctactccaatccctcagttattctgttataatacctcagttattctaaaccctcagttattatgttataataccgcagttattccatgttcctaactcagttattctatgtcggtactcagttattctaatgcgcgccttgagttattccatgttcatcactcagttattcgagtgacagaactcagttattctactttgatccctcagttatcccgtgtcatacctcagttattgtaatgtgcctactcagttattatatgttcatgactcagttattccgttccaacaactcagttcttctaatggacgcactcagttattctggtgccagaactcagtaattcctttccaatacctcagttattcttgtgggctaactcagtgattatggtgtgcagactcagttattctggtgtcggcactcagttgttcggttctgatccctcagttattctactccaatccctcagttatcctgtatcatacctcagttattgtaatgtgcccactcagttatgcggtgtttattactccgttattctctattcacattcagttattacgttcaagtaactcagttatgttattgctcattactcagttattctgttgtgcacactcagttattctattgttcactactcagttattatctgttcattagtcagttattccgttccaacaactcagttcttctaatgcacgcactcagttattatggtgacagaactcagttattccgttccaataccttagttattcttgtgggctaactcagttattctcctccgatgcctcagttatcatcatacctcagttattggaatgtgcccacttagttattattgtgcagactcagttattctggtgtcggcactcagttgttcggttctgatccctcagttattatgttataatacctcagttattgagatgtgccgactcagttattccatgttcgtcactcagttattcttttgtcggaactcaattattctaatgggcgcacatagttattctggtgtgataactcagttattctcgtgtgcctactcacttattctctgctcattactcagttattctctttgtaatcactcggtagtggggactccgtattctctattcacagtcagttattgcgttctattaactcagttattccatgttcgccactcagttatttactcagttattgtgttttcattactcagttatttcattccaacaactcagttattctaatggacgtactcagttattctggactaatacctcagttattcttatgggccaactcagtcattctactacgatctcttagttattccgttataatacctcagttattgtaatgtgcgcactcagttattacatgttcagtactcagttatttctttcagtagctcagttattctattgtgcggactcggttattctggtgtcagcactccgtcctaatacctcagttattctctgctcatgactcagttattctagtgggcgcactcagttattccatgttcatgtctcagttattctggagtcagcacgcagttattctagtgggtgcacttagttattccatgttcatttctcagttattctcggttcagtactcggttattctgtgttcatcactcagttattctcggttcagtactcggttattctgtgttcatcactcagttattctagtgacggaactcagttattctctgctcatgcctcaattcttgtgggccaactcagttctactccaatccctcagttattccgttataatacctcagtattccatgttcctaactcagttattctaaacccttagttattatgttataataccgcagttattccatgttcctaactcagttattctaatgcgcgccctcagttattccatgttcaacactcagttattctctgtacgttactcagttattgtgcgttcattactcagttattctagacgacgcactcagttatttgagtgacagaactcaattattctactccaatccctcagttatcctgtgtcatacctcagttattgtaatgtgcctactcagttattatatgttcatgactcagttattccgttccaacaactccgttcttctaatggacgcactcagttattctggtgccagaactcagtaattccgttccaatacctcagttattcttgtgggcggtgtgcagactcagttattctggtgtcggcactcagttgttcggttctgatccctcagttattctactccaatccctcagttatcctgtatcatacctcagttattgtaatgtacgcactcagttatgcggtgtttattactcagttattctctattcacagtcagttattgcgttcaagtaactcagttatgctattgttcattactcagttattctgttgtgcacactcagttattccatgttcactactcagttattatctgttcattactcagttattccgttccaacaactcagttcttctaatggacgcactcagttattatgatgacagaactcagttattccgttccaataccttagttgttcttgtgggctaactcagttattctcctccgatccctcagttatcatcatacctcagttattggaatgtgcccactcagttattattgtgtgcagactcagttattctggtgtcggcactcagttgttcggttctgatcccttagttattatgttataataccttagttattgcgatgtgccgactcagttattccatgttcgtcacttagttattcttttgtcggaactcagttattctaatgggcgcacataattattctggtgtgatgactcagttattctctactcattactcagttattccgtagtcataactgaattattcagttattctctttgtaatcactcggtagtgggga

SEQ ID NO: 115 - DNA, 3543 bp, Zea mays
gggacccccggtctcgaaacgccgacaaaactatacgtgcgttacaaaaagaaaaactggatttcataacatcagcgatgagagtatatctagagccgagggaccaagacttgtggctacatctacacgagttgatgttacctgttcattaaagtcgtggaccacaatccatgcatcgatctcactaactcgcgttttctaggggcctcacctcctgtcaacctcaaaactgtcaaaacgatccccgctccgtgactcgatccgttggagattcgagaacagagaggctagcataggttggttggagattggagagcagtagtccggtgcaggacactacggagcccggcacgagcattggatgttcggtggtccggacccacgggccgcggacgaggtcaggtcagtgatcagtgacttcagtttagttaagggaaagagcagtgtgttcatgggccgatagttcagagacaaggctgaatgcttgtccagtccctctgtctcccagcttaggttttggcccatgtgccttacccttactactggtcgaaactacatccggggaaattctatgcagtgtaagggtcatgttttggcagtggcttgtacatgaaaaaggtatccatccatctacttacagttacaggtgtcgtctgcgtcgaacccagaagttcttgacaaagtttctgcatctgtccttgttcatctgtttcattcgtgatgttcccttcatccatctgcgctttacttctctcacatgtgcgtctgtctttgtttcttgtgcggcaaagcagttgcatcgcgacacctgaatggagtttttttaaaaaaaatgtaatcctccttgttagatgccttattcatcagcccctatagctgttcttgccttcggatttgtcttgtggcggagagaatgcagagcatgtgtggggtggtggttcagagctggtatacctgttcgttgttttgtttccttgttaaaaaaaaaactacaccacttctcacttgatttgattgaactcgcgaatctctatgaagcgcgcgcctaccgaaggaatcggcaaaacgacaagccacaggtcgatataaaaaacctgctctcctgctcacattctacagcaacacgttttggatccccaaaatgctgcaatctgtaattgttccaagacatgttcagcctagatttgctcaaatccagaccttggactgttatgtttctacggtcctgcttcaatgtatatactgcattttcatgtaacaaaacagcaatcggtatggcaagaaagtgctagcattccctgtcaacgtactactagtaaagaaaaacttttgtggtaggagaagcatgtgacatgtggttcgttgcatcatgaagcccatgacaatttatgacaacgaagcccggatcgggtggatggcacttcaatggtttttggtggcattttgctttcatctggctaaacggatgtagcaaacgctctccactaggtttccagtaacccttagctaagatggaacagtacagtactgtcccaagcaactcgatctggtccgtgtctagctatgagctatccatttgtctgtctcttcaaagctcgaaaaagcaaccgctccaccacatgatcttggttctactctggattacaagccataccatacattttcagatgacactgtctaataacgatgaactgtataccggagcatacgccactaaaactgccaagtctgatcttgtcccttctaatcatgtctgtttcttcagcattaaccgcacgctctgcacccagagaagcatttcttgctgggacgacatgacaaaatccttgagccactcaaagcacctagctagactagagaggatctatcagcagcacgccctaggtttgacaaacatcgggccaaatctgctgcgatggttcgagtcaatggctgcttaaacattgcagcaaaaggtgtggcttgcaaacttttttcttctcaagaaagtggagctggcttttcctgtccacacggggggaaaacagaagcttttgctactgtatcatcctatggcctctatagcacatgtactttgtcacccacaaccactttccatgggaccaaaactttgggagccacaacccatgatgtgaccttgaaagagcaatcatgggtccaggtcagagatctggcccttttccacacacatacacacacacctatggaaaatgggtctaatcactggagatgagtggcgtataatcggccacaagatatggaggagataatagtctcatgcccggcggagtgctgacggcaaacagtagacgattcggccatgcatccgtgacccaccgctagctagctgctgcatttttgcgagaactaacgttcattgatttcagcagtgatattggcaatatatagagtggcggcggcgggcggtccatgaacagttcccggccacatgtgctgcctctgagccccagcagctcgatcccatgcaggcatgggcgcatccggcgagaagagaagaacccggccgacggatgagcccgtgttattagctaataagttaagaaatgcatggcaaaatccatgctaaattgttctcgtccttgctgccgaacaatggaaatgcttgtacgaatcacatgtttccactctgtactatctctttacgtaccacgggggcacacggggcaacacagatgaccacacagtaacaaactttgcctctaggctctagcacactctcatcacaggactaacgtacgacatgagggcatataagggcaacaagactcctgtgagatgagatccttgccatgcagatcttttttatacgtgcattgcatcttttcccgtgctccttccgccctttgttccttcacatccacaccagcccgcaaaagcaagcctcagctctcccgtgaggcacaagcgcacagcacagccataagctagctattgccccccattggatcgaggtgcagccaaatctaggaagggctcacatgcatggaggaagaaggtgcagtggaagtctgcaagacagtgggcggcgcgcggacaaagccagcctaggcctagctgaaatggactctttcctaggcgatgaaaagattggtggctggtggctcgttatctggtagagtcaatttatatattaggtttgctagaaaattgctcataaactctagccacaagatatgttaaaatagggcttacatgtttggtgctaaacaatgacgacatcattagggcgatcaagctagatcggctcaacgacgacaagctagacggtggtctttccttcgctaaccgagtatgtagagacagaccaagtcttatcataatttatatataggagaagaggttacgataaacgtcggttcacgtgttagccctctccctgttaatatgggttgtgtgaaatggtccgggccaactataaggttgttgtagccctgatgacgatcatgacacgtgagttgagtctggttcggtcaatcttttgaccgaatcggcatattctctccattgatctcttatttactc

SEQ ID NO: 116 - DNA, 3533 bp, Zea mays
caatcagttagacttcaagcaggacccagacattttttttgctctctgttacattatgcctagcctctcgggtgatttatttcttaccttttttcaatgatcaacattcttggtccttgttagtttagttaaaattgtttggatcatctgacattccattttaccagtctgtcatgatggaaaagagtctaattgagaccaaattaacaagtggtcagagctgcgagagagatactttgacaattgtaggcagcatcaatagtgtcattgaggtatctgtaacctgtttgtagcttctttgtccattagtaatatataaattttatttctaaggttcatatgacattccattttatcggtctgtcatgatggaaaagagtatacttgagaccagattaaccagtggtcagagctgtgaaagagatactttgacaattgtaggcagcatcaatagtgtcattgaggtatctataacctgtttgtagcttctttgtccattagtaatatataaattttatttctaaggttcatatgacttgccattttaccggtctgtcatgatggaaaagagtatacttgagaccagattaactagtggtcagagatgtgagagagatactctaacaattgtaggcagcatcaatagtgtcattgaggtatctgtaacctgtttgtagcttctttgtccattagtaatatataaattttatttctaaggttcatatgacttgttaaacatcttgaaaccacatactgatgtagtgtcaataatttttttcactttacatttcattgatccttgcaaacaaaaatgacatggctcttggtgtgggatactaatcagtaaaacacctaaccaacatgcagcggctgttccagctaaggcgttccaagtacttgggccctatgtaagagatgctcgccgagttatgcagcctgaaaggggactcgcacggcacgaacaagggagctccaagagtagcagcaggccgtaacagtaggtggggcgacgtggaaacgctggtcttcatctggcctctgggggcacctgtccttgagctccatgaattttctggaactcgagaagaggaagaccatgatcttgtccatggttgaagaggtaggctagctgtgcattagtttttggcagagtaggagtctttgtgcttagagtgagcacactgtcacttctgataacattgtaatcctgtttttctacggtctccgattcgttctcccaatttagcgatttgctttttataatttggtgtgaatggttttggcaggtttggcacatgacgtccctgtaccatctcatccacaccgcggcgctgctcggggcgcccatcaccaagcgccccaacgctgtgagtaccagtgctgctggcttcaatattttcgcttcaataagcaaagtctatactactattaagaagctaaagaaggcgtccacagtcttggacgcccccgcctccacgcctgcccccgcctgccatcgccgcaacgcacgctgatggtgctttcctcctctctatctaccctcctctctttcgcctggacggtgcccgcatctacacagagaacaccatctgcaagcacaccgagcacatgacctacctctgcctcgcctcgacacacaagccaagatggtgccatggccgcgctagatcatcatccctgcagcagcgatagaagcacatacgaggtgcagacctacaacgtttcttcatttcttcgattcttatcctgcgttgtcgccgattcaaacagatttagatctgctaatcaattgaatagtccatacggcatttggacgaaaccgatgtgtgacaaagttttcttttgtccttatccgtacacttgaaatttgatggacggcatgaccacaactctcttctcctcgccagcatttgtccttctttgctcgttggactccaacagttcaacttggattcgtctaaattttgtggctaaatgcatcaggttttttgtttgctatactgacggttgaccgtataccttttttgcaggatttatgggtgattcgttgaagagcaacatgtttgcctcattagtatgtatgatcacgaagctcaggaatcttggtctaaaggtaagcagctaaattgttgtttccttacagtgagtagcctaaaatatatttttaaatatttgaatatggaccctgatttttaaaaccctgaaactgtattttgtttatttgcatcaatttggcattatccgtacgatagcttataatatacagttcaacagctcttattgtttctgtgtgatatattattaccctcttattgtttctgttgtgctgccctcttataacgattttatttctggaacttgtattaagagacaactctattagctcgctcatcaacatgtatacaatcttgtttgataaattgctcacgttttacttgatgcatcactccattctcagttatcacctgtacaaattaaagtttttagtgaaattatttgcagattactcaactgtacatatcgtggatttaaaaaaactgataccactaaacatgattttgggagtattagtaaagggtttaataattgattcactgccatatcaccacattttgtccttgaaaagtattgtattctggaaaatcgggtgatatgatccaaaatattgatgaattgcaagtactttttagggatccctactttttaagcaaaaaatctattttttttccagtcaccatgtaaatctatttcatggtttgtaatgcccatggtctattttttgtgacagtttcgaaaacttattattctttgcttgtcctatattcaaacaaaattgatcgcaccacctttttgtgaaacttattgttctaagcttgtcctacatcctacatcagcttgtttgtcttagcaggctgcctttgtgataatttataacccagtgatatttttatccaattacatgatatattgcctaaaagaaaataaatgttcgtagccatttgtgacattaactggtagtcatcatctaatatattagaggttggtcttcttctttgcagcgctacgtggtgcggtgactctcaggaccaaggcactgaaggaggtgcgtaacatcgcagctatgatctcattggagaaggttgcgatggtcagaggcagtgggcatcaccagcacagtgaccacaggcatgaactgatgccgaaaactctctacttcaccatgtacaccatcgattagtaccactctctttaatcaatcatgtgaagggagctgctgctggttggcgtttcagctattctgatcgccttcaggtacgaggagatttagaccctataggtgcacagaaaacttccatatctctatgtcctatgtttccggtgctatttttaaagtttgtcactgtcaatgaagcctctttggatacgaggactaattttccttcaatcaacccgcgattaccaccttcacggctcacaagcccaagatgtcctcctaacgcgtcgtcccatgtgtgcttggaggaattttgcca

SEQ ID NO: 117 - DNA, 3529 bp, Zea mays
atcactcagtaatttgacaacatttgttcggtaattccttaatcacacagtaatttcatttacccattgagaaaataacaacagatatgtagtgattatctagttactaaataattttacagtctccactcagtaattttgcaccatttattcagtaatttcaatcacccagattgagtgaatacatagtaattttacagtaatcactgattatttgtgcagcatttgttcaacactttcttagtcattcagtaatttcattaacacactaagaatgtaacaataaatatgcagtaattttgcagtatttgttcaacactttctcaatcactcattaattttataatttgtactataagtatcaatcatccagtaattttctttacacgttgagaaaagaacacatatatgcaatgattgtctagttactcagttaatttacagtaatcactcgataattttacatacattactcagtaatttgacagcatttgttcggtaattccttaatcacatagtaatttcatttacccattgataaataacaacagatatgtagtgattatctagttactaaataattttacaatctccgctatgaatttttgcaccatttgttcagtaatttcaatcacccagattgagtagttatataataattttacagtaatcactcattaattttgcatcatttgttcaacacttcctcggttacctagtaatttcattaacgcactaagaaaataaaaataaatatgcattaattttgcagtatttgttcaacactttcttagtcactcattaattttattgcgtttgtactataattatcaatcatccagtaatttacgttgagaacagaacaacatatatgcaatgattgtctagttactcagttaatttacagtaatcactcgatattttttcataaatcacttagtagtttggcaacattttttcggtaattccttaataacacagtaatttcatttacccattgagaaaataataacatatatgtagtgattatctagttacaaaataattttacagtctcctctctataattttgcaccatttattcagtaatttcaatcacccagattgagcagttacatagtgattttatagtaatcactgattaattttgcagcatatgttcaacacttcctcagtcacccagtaatttcattaacacactaagaaaataacaataaatatgcagtaattttgcagtatttgttcaacactttctcaatcactcattaattttataacgtttgtactataattatcaatcatccagtaattttctttaaacgttgagaacagaacaacatatatgcaatgattgtcttgttactaagttaatttacagtaatcactcgataagtttacataaatcactcagtagtttgacatcatttgttcgataattccttaagcacacactaatttcatttacccattgataaaataacaacagatatgtagtgattatctagttactaaataattttacattctccactaagtaattttgcaccatttattcagtaatttcaatcacccagattgagtagttacatagtaatttacagtaatcactgattagttttgcagcatttgttcaacacttcctcagttatccagtaattttattaacacactaagataataacaataaatatgcagtaattttgcagtatttgttcaacaatttctcaatcactcattaatttataacgtttgaactataattatcaattatccagtaattttctttacatgttgagaaaagaacacatatatgcaatgattgtctagttactcagttaatttacagtgatcactcgataattctacataaattactcagtaatttgacaacatttgttcggtaattctattaatttgcagcatttgttcaacacttcctcagtcacctagtaataatttcattaacacactaataaaataacaataaatatgcagtaattttgcagtatttgttcaacactttctcaatcactcattaattttataacatttgtactataatcatcaatcttcctgtaattttctttacacgttgagaacagaacaacatatatgcaatgattgtctatttactcagttgatttacagtaatcactcaataattttacataaatcactcagtaatttgacagcttttgttcggtaattccttaatcacaaagtaatttcatttacccattgagaaaataacaacatatatgtagtgattatctagttactaaataatgttactgtctccactcagtaattttgcaccatctgttcagtaatttcaatcacccagattgagtagttacatagtaattttacagtaatcactgattaatttgcagcatttgttcaacacttcctcagttacccagtaattttattaacacactaattaaataacaataaatatacagtaattttgcagtatttgttcaacactttctcaatcactcattaattttataacgtttgtactttaattatcaatcatcctataattttctttacacattgagatcagaacaacatatatgcaatgattgtctagttactaagttaatttacagtaatcactcgataattttacataaatcacttagtaatttgacagcatttattcgaatccttaatcacatagtaatttcatttacccgttgataaataacaacagatgtgtagtgattatctagttactaaataattttacagtctccactctataattttgcaccatttgttcaataatttcaatcacccagattgagtagttatataataattttacagtaatcactgattaatttacagcatttgttcaacacttcctcagtcacccagtaataatttcattaacacactaataaaataacaataaatatgcagtatttgttcaacactttctcaatcactcattaattttataaggtttgtactataatcatccatcttccttacaagttgagaacagaacaacaaatatgcaatgattgtctagttactaagttaattaacagtaatcactcgaaaattttacataaatcactcagcagtttgacatcatttgttaggtaattccttgagcacacagtaatttcatttacccattgagaaaataacaacagatatgtagtgattatctagttactaaataattttacagtcaccacttagtaattttgcaccatttattcagtaatttcaatcatccggattgagtagttacatagtacttttacagtaatcactgattaattttgcagcatttgttcaacactttctcagttacccagtaatttcattaacaaactaagaaactaacaataaatatgcagtaattttgaatttcattaacacactaagaaaataacaataaatatgcagtaattttgcagtatttgttcaacactttctcaatcactcattaattttataacgtttgtacctgtctcttatacacatctgacgctgccgacgagag

SEQ ID NO: 118 - DNA, 3525 bp, Zea mays
gcgtcagatgtgtataagagacagatatcaaagtgtgcaaacaaaaaaatgatgcatttgttgcactactgttttgccctgtttcgattttttattcttttaatataattggaagttcttcttctagtcatttcacacaaaaaagaaaaatacatctggcttacctgatttttcgctataagtcatctaagagcaatgcaacatagaatgaaataatcaaaggtgcaatggcggagtagcacaaaacaactgttgcgatgagcatgtaaattggagccctggtgttatattgtagaacccctagagaccatgttgctttcacttcatcctgcgtcttgcataaatacttttctttaagatagaaaatgatgggataaaacaatcaagagagctcaaagccaacaaagaatctatcaataacaacaatttaatagttagggtgtgaagttgttatcaaatgcaaaaattttaagaataatatttcgacagtaggtaacgataaagtgagacaacataattacttgaacgcaacaaatctggggaagaatgtttgtacttccagacagatatttgacaatcatattcacaatcttaatataatgattgagaatgtctgttaaagatttaaacaatgtgcttacaactgtcgaaaatagaaaacattaaaaatgatgaaatagaaatatttcacttatgtccttctaactgcttggctctgcgaagggatccactattgttttgagagaaacataaaaagtgtattaggcatgagagtaatataatgagtgcaatttgggggaaggtttgagtgtttgaccctaaaccatcttgatttctcgttgctccaccactactttaagaaagggtaccttctccatattttctaaagttgtaacaacagagatatcagcaagaaaaatcatataaaaacaaaaatgagaaacaatgaaaaagataataacataaaccatagattgtctgatttgcttctcatatagtttccttagattagaaggttgaactatattatttgacgtcgtttagtagcttccataattgtctattcatcagacttgagcatgaagattttgagatttatgacatacatcatatctactactgaagaagacaagaagggtactctactgttcagcctctaatttgggcaacaattccttagtataaccactacaatattcaattgtgtcaacctttttatcaataagcataagtaaattagtcctattaatatgctttgtgcccttgtattactttcaaatttcaagtttacatatatgactttaacgcgacaatgcggacaattttctccctatgacattcgatctcttggtatattttatcagcctacaatgcaatgtaatcagaatagaataaactttctatttcattttctgtagggttatttttggacatgtatccctctctataaataaagtgtagaattacctttgtgtggcatatcacaaccattgatctatagaaagtattttagtgaagcaataaaaatttatagtttcatttgaagacggtacaaggatatctctcaccaacattacaaaattatctagtttaatatctgatgtggattttgcagtagcccttaaatttaaaacatgtttgtaagattttgatattatgaaaataagtgacaaagtaaacccaatagactaacaacagaaatgccacaaccttatacttttttcatgggaatgtttgtacatacataaaaagtttagttgtgttgtgaacaattaaatatacatcatttgtgacattggaccactaatgataagcaaaattagagcatgaaaagtatgtatttattattttaaattgcaagtatgacaaaccgttaaacaaataattaagcacttgtaaaaactattataagattacttatagaaacattacccacccctagtctttttatttacgagaagttttaaattaattaattaagtagatgatagttaagacatcaccagttgcagcaacaatgagatgaatcggaagtagtacaatcctacagtatacaaagatcaacaacattggaatatcaagtacacaattttaaaaaacataataatttgttaatagttgaagaaaatcgttaaaaaaatctaccaaaccccaaccaccaaactaaattttaaatgtatttattttggtttggtgcttggtgtttgatattttttgttgaaagtttttcttcaagtgtcaacaaattatgatttttttaaaaaatttgtcattgatgttcttgtgttgtcgatgtaggtgtactctgggattgttttgcttcggttctcctctatttgctataactagtgttgctctagctattatctctaccaataaatctgcctaattgattcatgacttgtcatcaatataaagactagaagtggtcaatgttcgtataagtgtttaataatatatttaagagtttgtcttaattgcaatgaaaaactctaaacacatgcttttcatactctggttatgcctatcattaagtgtttattgtaacgaatgttgtatattcagttatttacagtacaactaaactctgcacgtctttataaactttactagaaaaagtatgagattgtgatcatttcttttgtcagtctatttgattttctttgtcacctattttgtactatagaaatcctacaaatatgtataagtttgggagctactgcaagatcaacaccagatgttaaaatagatgagtttgtagtgttggtgagagatgtccttagaatgtttccatttgactataaaatattttgaagtctcataatttagcgcttaacccaaatactttctatagatcagtggttgtgacaaaccacacaaagatacttctcttgatatatacagtgagggattgttttctttacctttttgttatgttttcctatatgcttacaatacatgtctaaaaaaatactaccacacaaaaagaaatagaaactttttctatcctgatcacattgcacactaataaagtataccaagaaatcgaaggtcataagcacaaaattgtttgtcctgaaatcatatatgcaaactcgaattgaatgtaattttgagggcattaagcttactcataggactcgagtctttagtcttattggtaaaaaggttgatacaattcaataatataatgagtagattaaggaattattactaaaatggaggctgaacagaacactatacttcatgacaaacaacattgtgctaccattgtcctctcgaattggagattcgtcgccacttcttcatctcagacttcgcatgctcaagtatatgataaatgcgcatttatggaagctcaaataatatgatctaacctttaaggaaatcatatgagaagcaaatcaaacaatttgtggtttatgttgttgtctttgtcattgtttttttatatggtacatctcactgctatctctactgttacattttagaaaacctagaggagaagctgctcttgctcaaagt

SEQ ID NO: 119 - DNA, 3507 bp, Zea mays
aacgaagggttacgcctcaacggccaacagatcgccaatcagcggcctaaacgccatccacgactcctcccaaccctgaccattggatcattaatccacggtcaataccccgcgcgcgccaatggccatacgatccaggatctacggctaatcttttctcccctacctcccatacgcccgatgtttcctccaagcagcggcggcgacgctcgcacgacggaggccatggccagaccgcaccacacatcgacctcaagccctaaacttcgatccgatgaatactatacgtagatgagacatagaggaactggcggagggattccttacctgtgcttacgtgacataaatccccgctcacggtgatgttctccggtgaggttgcttgattcgatggacgaggaggcaatgagttgcttatatactctataacggagcccggtttgccatatcccaggattcacgccccgggatcggcggattaagacgaacaaacttgtgtttgttatggatgacatggaagggtgcactaccaagcgggatccgcagaccagtgacctggagagagccctgtgcacgtggcatcagtttgtgggactggcgagcgaggcccacgagcaacaagcgcgagatccgtgtgagagatggtgggcggctgaggcatgggccgtacctggtagtgaatgtgggcgagcatgtgtcttggtgaagctgggtttagtggtaggtgaattgagccgaccagcttccggcccatgctgaggtaagttcttctcttttcttttcctttttattttctgatttcatttcaatttcagttttaaatcccaaatttaaatttgatcttaatctcaagtttccaattatatgcagcacccaaagatccagcatgaaatacataatttaactttatttattttattatctcattttgtccattaatcacatgtttttcaatatgaaacacatatacacaaaatactattctagaaaacaattttcagtatatcatatgaatactttagtgaatatttataaatactaaatcatcttaaataagttaatttgtgtaaggatcatttatttagtctctactaagcgaaggtaacacaaaatctatttaagaacagtttgccaattaaacatttgagggtctttcttatgttatcctatgtttttctcaaattctagtttcaaagtttaattctaccagaattttaatttcactacttatttactttagggaatatactttataaagaaaggaaatctattgttaaaaggtaatttaacttgaatcttttggagaaacttttataaatcccaaaataggattttgggtgttacaaccatgcatatggtgctactgaggaatgatctttagttctggttcctacaacgtgtttaggattgcggatgtctaagccaccatgttttctcttgatgtgcacatggtactatagagaagtgacctttagtactgattgccaaccccctctagtttcgcttttggtaaccaagactctgcaattgagactttagttctggttctcaatcccctttaacatcgattatggtaacccggattatgcaatttgacaaggacatcacttcttttgatgcattacaagatctgcttacaagagtacaagcacgtatggtatgaatataatattagcctcggtggtgctgtaaatcatattctcgtgacttcttagaaatcagaattaagatttcatgatgtagagccacttaggcgattgtcaagttatcatcgtgcctcttcgcaatgttctttggctaggcactggtcaaatgctcgcggtacagtcaggggcaaatgtatcattatgtgtgtttcttattcttatgtgtgcgaatatccttcattggttctatctctctaactacactttgctagtcattagagatgtcagcctcttcttcttcatccttgaggttgatgtcttttctcgaaacaaagatctcctaactatgattatagttgcacgtgacaataagagtgctaggtttagttgtcaagatagatgaggcagtggctctggctttgtatggcaaccaattgatgaaggcaactatgcaagaagaaggagaggtattcccattgagttcgactcttggctaccgtttaatccttccttctattatggaagtaagtgctaggtgttgggtgctttttagtgagaccttttcctcatcatcccttctcaggcacaagagtgaatgcgataagtattgtaatagctttatggtacaatgaagttatattctcaagtccaagaagtagtatgactagacctagaccacaattatctaacggtttagaagccaagtctaaaaacttggtcgtatttgagcatgactcaagcatgttgtgttggttttttattgattcgggttggagttttagttttttttcaaattttttgacaagatcatccaacatgtcctaacaagaagttggaggagctcaaattggcctgatcttaacaaggtgtcaatgcaacatactgaagacgtgcatcgtgcacaccaaggaatgaatgtgaaggttgatcatgcagagaacatgacaaggtccattgagatttcagtcgtcttttgcaaaaagttcctacctggtccaccagctattagtgtgtgacgaccgacaagtccaatatgggattacccatagtagcaattgatgggcttcaacataagttgagattaattgatgatgaatgtgagataacaatttatacatggtcaagacactagggtgtgtaataccctacatcctatgtggcaataatgccttgcattggattatttattatgatatatgaacaagagagtactcatgtctccctttatatagtccacatggtaggcatagtcaagtcctagtcaacaaagacagttctaatcctattacagaaataatctttcctttagtcagactaggttgatagcctcttgctcaccttgttccatatcttcagacaacttcatggatcaacccatcttttttcatgtagtcggtcatatggaaaacccttaatgtagtaatctaaaaatcacggagccaacaatccagcttccaaaacatttttttcccaaaaccttgcttagtgggtagaaatactaagaacgctagatgcactagtgtaaccctatctagatgtgtcagcatgtgcattaaacaacatgagagttgccttttattttattctttgttaacaacatgaggtttagggtttccgttttcgtattttatcaccggaaatgggaccgggtccagaatagtcggaaacgaaaataagagcaggataaacaaatgtacaaaaatgaatgggaacgagaatactaagcggaaactcgtactttagtacaaaacttaatattgatggctaactagtgattgaccggtagggcaataccatgaaacaaatagatacagagggacaacacttcattattattagcttggtgtgatatatatatata

SEQ ID NO: 120 - DNA, 3502 bp, Zea mays
taacgaaagatttttctagtgaattgggcatacagtggttgcattaccgatgactctctcctccttaatttgcgtccacgtaggatttttctatttaattgctgcttacgtggctgcttagagacagcgtattcaatgccgtcggttttcgttttctttagtccaactctttaataaatgttgctcagctctgatcccttgaaattcagaaacagaaaaagaagcgacatattagtttgaacaaccttgctttgtattcatgcgaacatcctggtagaaggataccaggaaatgaactactagctagttgaattggggatcattaagtaccttctgcagttctgcgcacaccatctgaagtctattttatatcagtgtatataacgttgtttcaggacacctgctaatatcgagcagtgagtactgaaatcctccctggcacctaatacctcgattattttttactatgttcatttttgcatggccaccgtcatctcgattcaaactaggccaacaatttgtgtcaggtagttattttgtacttttctggtcagatcttggctctagtttgtatggttaatttgcactgcattctgctgtagccgactagccgtatggtatacagattacagaagaaccctacaacagatggacctgatatatcaagtatattcaaacacacgaatgcctgactgatgtggctaggatggaagaatccacttttatgttagatggtgatttgagcactcgattggcatttctgcaattacagcaacagttttcacctctctttcatgtgtcagttacttgtttatgtactgtaccgtaggcatcacatgttctgaaaataggagatgggtttaggaagtagtgaggaaagtttaaaattgaaaccagagcacaagatgtttggattaaaaactttgtttttcctttctcttattcagttatttgtcttatcattaagattattacaactgttcagccgcttcgaatttaatagtgtataacaacttaaaaagtggcttcagatctgtacaacacatgtactgatttttttgttgctgtagggtgtctgtgtctcttggaagttatctgcctatttctcattttgtattcaaatcatgcttctagttcatttattgaatttactttgttgcagtgagactgccatcatgcaaagccctatcacagtatctggcacctctgcctccacaaaagcagcccctgatacatgtgggattcaagggtgggctgatctccctggaggcccactccagtctattgttgccctcctgggctccttcattgacctccttgccttcgcaagcacctgtcgttcttggcgtgctgccttctcatcatacccatccaaatccaggttctgtgccttgcttccacctctcctcgttaggcccaatgtctccgtgcgtgcacctgatggtcacgagctacgcagatggcaggtcatcgatctagccaatacaaaagcagacctttgctgccagattcctcaagaaatatgcaaggcgatgcatttcgccggctcctcctatggccagctgatatgcggccttcgcaaagattgcatcattgtcgatgtgttcactggggccagagtatgggcaccgccgctcccactcaacgatgacactttcttctactctggcatgctgacagctcctcttgcgctagaaaactcgcacctccttgtctgtgtggtgtccagccagcacagcatcccagcctcccttcttgactggtcagttggaagcaattcttggtcggaaatacagctcggtaactcactgatcgagcagatcgtggagttcaacggtcagttcatcgtgatggacagctactacaggctctacactctgtccttggccccccggcttggtttgcaggagatggcaactgtttggtgggacaacatgcctggatgcccattccgaaggccatggctgttggtatgcagcggcatgcttctaattgttgactactacttgagcttctcatcgtctggagcacgagcgcctgtcaactacaaagcctaccgcctggatacgtccactgaacctgcgacttgggtggacgtggtgaagctggagaatgatgccctctttatcgggggcgatgtgaggagcccgccgttctcttgcatgagtccaggacggtggggcgggagaagcaactgcctgtactacgcgcattacaggcaaccctgggtcctgcatgggctgggtgacgatgcagatgccatttgggatgattccactgatcctggccttgggttcaagagggactggtacatccagcttcagccattctgggtgtacccgagcatgttctactcagatggacagtgatccgtgcccgtcctgtgttgcagaaatttttgccttggagttgtttggttagggaagacttcttatatttgagtagatgatgtcactatggtattgtatttgagatttcatttgtgtgtgtgtgtgtgtaattgttaagttatgtgtctgttttgaggaaaatattgatgtatgcttttgaaatttatatgaagaaaacccacgatgtctacccaaagatcagtttttgaaccgtgctgtctagattaggtttttcttttggaattctgggattttagatttgtggatggagatgtgtgtgtgactaacgtctacaactacaagaaccagtctatattgtcaaagcgaaaaaagaaggaaccaaaagataattcgtaacggttgacaggcagaacaattcggaactggaatttgacgtgaacagatttatattccatcatagtagcaaagcagtaactgttcgatattcaaacgtggatcactgttttttaaaaattttggtaagaaaatgtgtatagcagctcagaacaaataataagggcaagattccgaaattagaggaagatttcgtgaattttggttaatttggtgtgatgtaaggaggcctgcgttttcttgtgccggcttaggacaatggagcgcccttctgttgcatgggctgacatgatgtggatgctgtgtggaatcgagacaacgattgtaaccttgagttcaagagggactggtacacctagctgcaggtcttctgggtgtatccaagcatgttctatcgctgatggcaagtgattgatgaacttccatctgcttgtgctgaaacttcaccttgaattttcttagagaacataagcttgcattcacaatggatagtggccattatggtagatgagagtttgtagacttgcggtttccattcaattatcagctgtgttatcctttgctacttccaatcttctgtaccattaatgacctatgaacttgctagctattctggaaagcctggaaggatggatactgttacttgaattagtagtagagaaacattcgtaatgtgcctgagttcctctgtccacgtaaaatctgaagatgcaattgcttgtatgtatgcaatctgttcgtttgaatgcaaaataaag

SEQ ID NO: 121 - DNA, 3502 bp, Zea mays
aacaaaagaattaaatatagaaaaattttcattccatttttaattacaatttgctctatgcgagactataaacaatactagtttaggcatgctatcttaaaccatatgtagtgctattttatatatatcttggttatggacaatggtgcatgttttgaggccactcaaaaaacaagtatgggactcatgatatttactacaaaacaatttaaccaatgaaaattacattacaatttgctctttgccaaattgtaaacattacttgtttgggcatgttatgtcataagatatgtggaaagatttcaaatgtttcatggttatggacattaatgtaagtttgaagacgttcaaagccctaaataatgtaatgtttagaatgaaagtttttacaaaaacgacccaacaaggtttgtcatcaaagtttttgcaatacaatgatttgggagtaaatggtcatgatttcatgcatgttttcttgaacagattgtggcatgaaccatgcgaaaactttgaagcttttcgaagccctaaataatgtggtagatttatagaatgatccaaaatgttgtttcacacgctccaccagcaactaaaattcaacacaatcaaaacttgagtgtgggacccacataattagatggtcgcatgccgattaaagtttagtgttttgaagaatgaggtaactttaaaagtatttgaattgtaatatgcagttttttcaagataaacgattttgcagagttacgacctctattaaaggaaaaatagttaatggaagaaaaattatatttccactttcattagtcttttccaaatgtcgtactgtaagacatacttgtttaggcatgttaccttaaaacatagacaacctatcgcatgagtttggtgcccaagatattggatgttcgaatgatggcactagagtttgtaattttctggaattgagagcaatatttatgcaattctgcttttattttgatccatgttttaagattctttgttattattctattacatttatatcaatttataataaaagaattaaatatagaaaaaatttcattccaattttaattacaatttgctctatgcgagactataaacaatactagtttaggcatgctatcttaatatgtagtgctattttatatatttcttggttatggacaacagtgcatgttttgaggccactcaaaaaacaagtatgggactcatgatatttattacaaaacaatttaaccaaggaaaataatattacaatttgctctttgccaaactgtaaacatcacttgtttgggcatgttatctcataagatatgtggaaagatttcaaatgtttcatggttatggacattaatgtaagtttgaagcggttcaaagccctaaatgatgtaatgtttagaatggtagtttttacaaaacgacccaacaaggtttctcatcaaagttttcgcaatacactgatttgggagtgaagggtcatgatttcgtgcatgttttctcgaaaagattatgtcatgaaccatgcgaaaactttgaaacttttcgaagccctaaattatgtggtagatttatagaatgatccaacatgttgtttcacatgctccaccagcaactaaaattcaacacaatcaaaagatgagtatgggacccacataattagatggtcgcatgtcgattaaagttcagtgtcttaaagaatgatgtaattttaaaagtatttgaattgcaatatgcaaatttttcaagataaactattttgcagagttacgacctctattaatagaaaatagtcaatggaagaaaaactatatttccactttcattactcttttctaaatgtcgtattgtaatacatacttgtttaggcatgttaccttaaaacatatatagggcacatcaatccaagtttagggcacatcaaaacatgagtatgggactaatgggtattaattttgtgcaagtttaatgcatgatatatcaatttctgatgtgcgtcaacttcgaagcattttgatgccctaaatattgtattgtttagaaagacagtttttgcggatggacccaacttgttgtttcgcatgcaccataattaatccatgctaaagacaaccataacatgagtatgagaccatagattttcgcatgctagcactagatttggtcatatgaaagatgagatcactctagaagcgattgaagcaaaacatgtagattattttcagatcatcaatttattatttgcgtgagctatccaacatgttgtttcacatgcttcatcatcaatccatttgcaagacaacctatagcatgagtttggggcccaagatattagatgttcgaatgctggcactagagtttgtagatatgaagaatgaggtaactttggaaatgtttaaagtgcaacatgtatatttttttggatcggtaattttccggagttcagagctatatttatgcaatcatgcttttattttggtccatgttttaagatactttgttattattctattacagttattccaatgatatttataacaaaagaattaaatatagaaaaaaattcattccaattttaattacaatttgctttatgcgagactataaacaatactagtttaggcatgctatattaaaccatatgtagtgttattttaaatgattcttggttatggacaaaaatgcatgttttgagaccactcaaaaaacaagtatgggactcatgacatttatcacaaaacagtttaagcaagcaaaattacattacaatttgctcgatgccaaactataaacatcacttgtttgggcatgttatctcataagatatgtggaaagatttcaaatgttttatggctacggacattaatgtaagtttgaagacgttcaaagccctaaatgatgtaatgtttagaacggtagtttttacaaaaatgtcccaacaagatttgtcatcaaagttttcgcaatgcactgatttgggagtaaagggtcatgatttcgtgcatgttttctcgaaaagattgtggcatgaaccatgcgaaaactttgaagcttttcaaagccctaaattatgtggtagacttacaaaatgatccaacatgttgtttcacacgctccaccatcaactaatattgaaaataatcaataacgtgattgtgagacccacatagttagatggtcgcatgccgattaaagttcagtgttttaaagaatgagataactttaaaagtatttgaattgctatatgcagatttttcaagattaactattttgcagagttgtgatatctcaattttctgaagaagttaaatttctttttctcttttctttcatgttctgtggcattggggtttggagtttcaggaacattccttagggaaacagtagatcttttggcgttttttccgctggggtcgagagctcagatgggagagcgtgttcgggcctttgatctcgatccgatggatgggagccccccctcccaaccctagctgaaccctcc

SEQ ID NO: 122 - DNA, 3491 bp, Zea mays
taagaatcggaggaggtgtgtgtatttactgggtgctaattgctataaaaaaagtttaaaggccctgtcatcttacttgtcgaaaggcctttaaaattatagagacggtcctataggcgttaatcctaattttgctaatacgtcggaaagttactccacgacgaggttagcgatgggctaaagaatgcatgcagaagctgggcttgatgtaaaagactagtatatggtcgtttcctttcaatttcaacttccaagcgagcgccatccggacggatgtgagctggcctacctaccctaccgagaagccgacacttccctattcccaaaaaacgctgctttcggccactagaaaggttgcaaaatgggcgcaggcagaggtcgtcttggaagtgatgtactcttaacttttaccttgcaccgagcgatagttgtctttctaatcaatacgatcgccaactcgctattaaaacgctgctcttagagcaaacataataagggggttataagctaactaaatgctcaagtggaggagaaaaaataggagagagatatataagagaagcagactataaacttatggcttcgacataataacaaagacgttttgtatgagagacaagtgacgttctgtattaatattgaagagctaactactaaactaaataacaggctacaaagatccttttacggccaacaattaactctattattaaatttgctcttaaatgaagtctatattgcaaattactactcgggttaggtactagagagtggcatgcatgcatccgattgatgggtgacgataggcacgtaagtatttctcgtacgtacgccgctgcgtcagtacgtgtgtagaatgtagataggtatatagtagtgcgtgtatttctcctgcggagtgtgcatgaatatctggtttgcctacagtacagcaaatacagtcagaaagctctaccaagctggctagcaatgcaagatccatcggctgaacctgaccggcagccggctactttcaaatgggagcgcgtctgccgccgggcctccatgccggtcaccaagagtgaacagacaacgagcatgacatggttggagagccacgaacaacgcgcaagtacagatgttcaccctacccatatgcacccatcatatccatgcatgcatgcacggttctcaatcacaggagtcagtcagtacgtcaggagatcctcaaaacataatcaaatgcacaacatcgtctattatatatattggtcatggacttaacaacactgtaagcacgcatgccatcgagcaaccttgacggccccctagttgcatcaagtacaaaattggtagccaccggctaatataccctctcgggggtacccacgatcgaggagagcctgtgtctacctggtcttgcaacaggggctggttgctaccggcagcagctagctttgcgttcctttgcttcccccagccagcttcctccctctcaagtctcgtcaaaacactgcaggggagatgcatggccctagctggaaaaaggccatccatccctctcagggcaaccaaccaaccaaccactaaccagcaccgccaacctctctgtctctctctcactctcactctctacataggattacacttaagcaatgttgctaacaacactgctaactaagggtggtagtaataaacgacataattaacaggcaggacacacacacatatatatatatatagcggcaaggcgacgtgacggcggtggagtccgtccgacatctgtgcatgcaggtccgttacgcgagcggcgccctatggggcgcgcccttccgcctgttgccgagcgagaggacgatctgagggaagaaccctcctccgcccccgccgctcttcttcttcctcgtcgggacgtcgacgtcgcgccgcgcgtggttcctggccgagccgccgttgctggatcctccgctggcgctggcgctgcccccgtgctcgacggggtcttcgaggatggagctgggcgtggcctgcccgtactgcccggggtcgtcgtcgaagcggaggttctcgaagcgcgggaagccgcagcccaggtccggcggcccgcccggcacgtacaggaggatgttggacaggtccccgccctgcatcatcacatggtccacctgcatgcgtgcgtgcgtgcagcccacagctgggtttagcgtacagtaaccacggaaacggggccgtatctaatctaagcgtgcatgggcgtgcgtgtgcatgcaaacgtactactgcgagtgaagcgacgtacggctgattaataacttactaacgtacgtgccaggcgactgattatggcacgcacgcacgcacgcttgaataatccgtcaaccgatcacgctgctagcttagcagctgtcgcgtgcatgtgcatatgtagaagatttttggtggcacgcgtgtagtcttgtatgggtggtggtggtggtatacagtagtagtagcagcagcagaatagcactgtgtaccttgcaggagaggcagcagaagtggaagggctcctggaggatcctgtcacaggccaagcagacgttgccagagcccttgaagggcctggactgcggccgcggcttgaggaagatcaccttggcactgttgatcgtgtagggctgcatgcgtgcatgagaacgacgatgggtcaggatttttaataattcaaaacgattcggagcacgccgcggcgccgtccgtccgtccggtcaccaccgctgcatgctactatccccctttagctagccgccgccggcagcagaaacagtagctggtacgtgacggtccgcgcatcacctggacgaaggagcagtcgatgagcctctcgaggtcgtcaaggcgcaccacgtcattgtacacgtacctccgcacctggcccaacaagtcgagcacacagtcacacacagacaacactacgatcattagtaacatcgttatacaataaatactacggtacagcccgtcacagtacatatacgctgcgtaaaatgatgggtaaatcgaatttacccgttcttcctgcgtgcatgtgaacgtgctgtgctgtgcgctgcgcaacttataacgtgagcaacgcggtgcgtgcgcggtaataattccagcgggaagggaagtggggggtggggggcgggaaacaggcctgggcgtctgacgagcccgctaggctagtcaccggtaataattgcgacgctttgaccggcggctcgtcgccatcctttccgcgggagaccaagagggcgcctccgtgcactgtggccgcagcgaccgaaacgcccctgtccccggggaaaatccaggcgtcgcctcgagggcacaacggtcaggaagcaccgcaggccggattattttaaccccgcggtaaaaacaaataaacaggcaaggaacggacgggtggtgggctggtgcgagagtggcaatgagcgccggctcgatcgctgggttggtcactcgaagagagagagagaggagggggg

SEQ ID NO: 123 - DNA, 3375 bp, Zea mays
catgtcaactaaatcctgcaaaatcacaaggcaacaataaatgccatacgagaagagagatactcactctcatgacaaactctagccatcaattattattctatgctctagtaaacctagtcacatctccacattatcgttttggaaaggaacatttcacattatattaaggaactaatattacctgtgttggaatagtcttgaataacagaagactccttttatagtaaaggtgaaatgaaagagtacagatgataagaggtatggtcaagcatacagccactcgcgattctttaatttcaaatacaccagcacagatgatctgggtgagcacgagagagaatatgattgtgttgtgtgcaattggccaatacaatcctcctgtatcagaccttgttcgataaacattgagaaactgaaaaagaacacatggtacattagcatgaatggacaaatttcagggtaagtaagaaaataaaatatagtatctaggttctcacttgattgcggtatacaacacgaccaaggtaaaagtatactagcaggaaaggtaaaatcataggagccaccacagagcatgtgaagcccaatagtccaaacaatagaacttttggcacttcctgctgataggggaatgtgggaacagattctgtatcttctctatattctccctttctcaaaatatatttccttataaagctcattatcagattatagaactgcaaaagttcggatgataaactagcccatcccgaggtcataacataggtgatgaagaaggtagcctgcaataaaaaataaaatcacagaaaagaaacagaaatggtagatgaaaattaaatacacaaaaccaatatattatctttccataaagaaaagggaaggtgtgttaaacctgtctagttaaagctctagcaagcttgacaggaatgtcctttgggcttaataacaaattcaattgactcatgaatgtaccggatagtacattaacaaagaatatgttccaaactatgaagcacaacagtttaaagcaagcactcctcttccttgcactgtgagatgtggcaccttccaatttagaaactttcatcatcaatgtcccaacaatatatagaataatttgttggatcacactaggaaggtatcccgttattaggttagtcatgtagtttttcctgcaaataggccgagtaatatatattcaataggtgcaatatggagacaggtcaaatggatagtatatatatttgtagcgatataagatcacacatctatcgagatagcccaactgaagtttcagtacttacttctccaacctttcttttaaggaagcaggcatcaactgttgcagctgctctgggtcagatagtgattgtatacacaccatcggcatcaaaagtaagaatgcaaaaataatacagcctggaactagtgttgatttacgacacctgttggattgccaaagattggaccaatacacgtcttctggttctggagccagactagtaacccatttcagtgggttagatgtctgcaccatatttgaggcagtaactgcatcatagcgagttttgaaaaatacaaaagcagttgcgcattcctgctgcatgtaattccacatagaaattactatccatattattactgctaaattaagcaattaacaaatgcatgcatgcaagaattttaacctcgtgatctaagtttatggtggattcttcattgtcagggttccccttgttttgctcgccttcagagttaaacttggaagaatttggagagggtggtcccatgaaacaactgttggtggttgtcgtcctaaatccctgactgccgatttcagctatgaaatgtttgaacttcttatgtgccgtcttagtgccagtctgtcagataaattaaagacaccaaaaccaagaggttaaatacaaacacgcataaggaaagaaaaaccattcaacactggaggaactagacatttgttcacttgttcatgtcaaaaagacaaaaacaattatgagaaaacctagctaatcatgagatgaagtattaattatacttcacttagaatatataatagtaaatgttcttcactagtaaaagagaaatgcatgcattgagtacaagctagataccattatcttatggacatgcccaactttgtagacaatttgatggaagagataactagacgagtgatactttgtgaagaaatttccaacagcatcactgtatgattctttagctgtctttggtatttcacgaacaaggagtgcaaattggcttggatttagcgttgaccttttgagataaagggacctcaacgtggcaatgtgcttcccctcctgcattgaagggaaaaaacagatcagtagaaaacgttccaactacaaggagatggagcctttcaacaattcaaatgcgaaacaaacttacaatgtacagaagtaagcatgttactccagaaattatgtatagcaccgcacaatggatcaagaggctgcatgcaaggaatcatcaaaacatgcactttgttattttctacactgcacattcttccttaagttctaaagaagtgaatgaagaagcatggtggatgaattaatcaaggtagaaaacacttgtaagatgtcggtaactatcacaatatatatatataattcgaaaacacaacatttcaacagttgataataaattaaaagagagagagaaactttgctcggcttaccattttgatccatgtttcacattcgatactgtaaatgcatccattcgttctgaaggaattgaaacatgttgtgtattctgtccaaaataataattgactggaagaattcccaagagacccagaagtgtagcaacggagaagatgcgtatgctgttgaatacgtaaattaatatatgtgtttcagtctctgccaatttggttgctggggatggacatatgaactagtatgaatgcttgatgacaaaggggacaaggaggtgaaaagaaagttttgcatactgtacctgaatactataattctatcaaaaacaactgcatccaacctagcagcatctaagagctcttcctcggtacactgcagggctttcactacccagccagtcgatggaacaaacctttcaaagttacaaccccctcggagccgactgtattgctcagcaattctgcgtccgaagtaaatcttgacaatggcccgttgatttctcaaaacagagtagaacattaggaagaggacacagatgccaatgttgatgcccacagatgtcacaagcccgctgaactccatcttgtcagcagtggcggagctagcccgcaataggagcctaggcaccattataaaatttctaaaattaatttacgcaaagatt

SEQ ID NO: 124 - DNA, 3475 bp, Zea mays
ctcacacacacatagtctaacaattttgatcaccatgcatctgaaaaatatagaacagaaggcagaagaataaagactagcataaaaatgacagacatagtaaagcagaatgactgacaggttgttctgatgaatcgcccctgccacgagcggcgttagcatcacgatccggcgactgtgctggaggagatgaatcttgcctctgaaaaattatatatcaaaaggcagaacaacaataactgacagcacaccagagtattaagtggctgtgacataacaaagtagattgaatggctgacagtttctatatcacgcacaacatgagctgtgtcagaatcacagcccggtgaccgagcaggagaaggtgaaggtgtatggcgggtatcctccacttgagcagtatctcgcccttcagcaataatcacctttttgcgctttctgttgttttcatgcagcctagagacagttatctggtgcaacaatgacaaaggcattaataaataaatgaatgacaacaaaattaagggaatgaatgaggccagcaaactcacagaagaacaccgttttgcatgttcttcgcatggagaggatgcaggaggttgtgtctcatcattaaatttcataattgcattcacctcatccaacattttcttctgcgccttttgcaaatccagctgccctctctggatttgtctctttgcattctcaatagcgcgctcagcatcagcaaacctacgctgaccctctgaaatctcgcaagacgctctttccacgctgcaatcatattctctcagtgcatccttcacagcatccttctgggtactatcaacaacataagaagcaatagactgcgccaacaacggctccaactgaacgaggccaaattgaatactttcaggtccagcacttttcgacctggcccgtacaacatcagaaggagcgggctgctgcacattttgtcctctagtctgtggctcatcgtcagtccgtatgttggaataaacagttcgatccctgctcaacaactaaaacatggaaacaattttgtgaccaagattaaaaaaaccaaaaaatcgatctcatcataccaaaagggacacaatgactgaatggacactgcactacatttaaccactagcatatagctcgtgttaacgcggggagaagaggggagggatcggtggcggctgcgcgagcaagggggagggatgacccaaataagggatgacagtgagcatggtatataataactgagtgaacaaacatactaagggacagaataaccgagtgaacaaacgtaataacttagcaacaaaacagactataaaaacagaataaccacagaagaaagaaatttattacttacattcaactttccataggacacactgccgtctctcgacgtcaatcggtcagcatccattatttttccaatacgatcattagagtactgtgaccatcgaggtgtaacagtattatgttcaacgcctgggcaatctaagttgtcaagatagtagagctgaaaacagcataataatatatgtgaaaatcaaaatatatattgacaaaacaattaagaaaatatgaaaaagaagtgaacagtaaataaaattcatttcttaccatcaagagagcagtgcagccttggatgactggggtcttgttctttctatgattcttcctccatatggcagacttgtcctttatgtcattaaccacagcttgacaccaatcaaattcacttaaagcgttcaagtccttgcaaatgaggtaatctgaaccaagagggtagtagctgctggttggaaaaagaaagctgctacaaacgatgatgaagaaacactggacagcccaatcatcaaattcttcagcactggtggaagcaaaattctcaagaatccacctaggaacaacgtatctctgtaaacggtcataattatccatcctagccatctcatacatacgtcgcattcccttgtcgtcgcatttgtttttaaggtcgcttcttgcttttatcttttcgtcctcaccaaactttgggattggctttccaccaatcggaaggccaaagatcaggtgcactacttgtggagtgacaggtaaaacctttccagaaaattcgatccggagtgggtcacccttaacattcttcatcaaaaacatccctaaagatctgtctaacagcctgctaataccaaaccgcaaaaaatcaccaaatcccaaacttctcaacctctgcttgtaatgctcagacatagggttgattaaatcatacacaaccttgggagagcacctcatgattgagaagtgtcctttgttcttctacaaaaaaaataaaaagatattgatagacgaataacaactgaaccaaaattggacaacataaccgtaatcaaataacaaaaaacaaaataaccgagactaaggaaagaataaataaggataagaaaagaatatctagacactagaacagaaaaaataacaagaattagaaaaaaatatctaggcactagaacagaataactgaccatacctctggaattggggaaccctgacccttcttccattttggtgagggccttgtgaaatcatcgttgtcgtcatcaccatcttcagaagaggaagaaggctgcattgcagctctgcccttcacatcagcagcagctctgcccttcatattggcaacagctttgcccttcacatgttctgcaacttgtggtacttctaatttatgcaaagaacgggacctctttcttaaacgaatgtgcctgggcgatacatcagcgcattcctctattacggcctctactcggctgttatttgtgtgttgagcatctatgtcttctttctccattgcagcctttaatgggctatcaactgggacttgtgcatctataacttgtgcttcctctactgtaggttttactgtctgtaagggtgcatgttctgcaaattgtggtgcttctatcacaaactctactgtctgtgagggtgtaggttccgaaacttgtggaacttctatggcaacctctaagggtgcaggttctacaacttgtggtacttctattgtagcctctactgcctgtgagggtgcaggttctgcaacttgtgctacttctacatcagcaccttcctctattgcggcctctacttggctgtcatttgtgaattgagcatctacgtccattgtggccttgtcttcctctaatgtgatctctgcttggctgtcaactgtgagttgtgcatctatggggctgcatcgggatggggatagactggatagctggttcttatctgtacctgaaactttttgcataattttgaagctattgatttctttagcaagatattggtcatcacgggcatcaaagcaacgcaaacgtctcttcgcatccatgactaggttagaccatattgaattacttctactaagagtatcttcatgtccaaggatccaaagacagttcctgtggtg

SEQ ID NO: 125 - DNA, 3471 bp, Zea mays
gcatacatttatttagagatataaatattgataccattttgtataagtttaactataacttaaaaagtccagcccgtgtaaaacccagaattatattctttctgaaacaaagaaagtattaagatttaaaatgacaaatacatccttaaatttgtgttcatgtgctacctaggtcctactttttctacaatcccaactcatttcctcatcatcgagtttatcatctggctggcaggtgaagaggtgggctgtcctgacggagacataataagtggagacagatataagaccacacaacctgtcaaccaccttcacaatggccgacagagaataaatgaagacagataagtacgttaactttggatgtatgactttgcttgacatggactgcgtcgcattagttgcttagtcaggtttttgtttctctctctcttgtgtggttgacacagtgtgcacacagtacttgcagcatgttcactgtgctgtgtagcactatacatatacagttctgttcatgaaggaaagaatatatagatacttcaatcttttagatgccttcgttgtgctgcaactgcagtttattcttttgccactatagcagagagtacatttattccaccagcgataagatattaagaaacagatgcactgccttttcttttctttgagtaaagcaaaccaaagatgccctgctgtgctttcctccaaagcgatttacattctcttctatcttctccactccagccccactccacccaacgctccaaagctctgctgagtccttgctccaatggctgaactagcgaccagcctggtggtcgccccagtggtttccctgttgaagaagaaggttgtcagccttctcaccgaccagtacaaggtgatggagggcatggagaagaactatgacaccctcaagctcaggttggaagccatcgaagcggtcatcgttgatgctgagaagcaggggcctcgccgcggtgtgcaggaatggctcgagcaggtcaagacggcagcgtacaaggcacacgaggtctttgatgacttcgagtacgaggtgctccgccgccgggccaaggagaatgggcacatcaccgagcttggcgttatggacagggtaaaactcttacgcacaatcgtgttgcattccgtagtaggatgggctataggcttcgcaggattgttgacaccttcaaggaccttatggaagaaatgaaaacctttgaattcaacaagcttgagcccaaggcgactgcggcatcgttggagttgcgtgagatggatttcctcattgatgatcatgaagatattgttgccaggtctagacatgatgagaggaacaaaatggttaacatattggtcaatgccaatggtcgtgttgtcggtggtgatcttatggtcgttcccattgttggaatgggaggactaggcaagaccaccctcgctcagctcatccacaacgaccctcaggtcaaggagtacttccatctacgaaaatgggtatgtgtgtcagatgattttagtgtccttaatcttgccaacaagatatgtaatgcctcagagagagacctcgaggaagcagtgaagaagcttcaagaacatcttaacggaaagaggtattggctggagcttattagttattagtaactttactttctttgccttgtatgatgtttttatttcattatttactaaacactcattacatcgtgtcatattgtgtgtacctaatggacttctttgctgatatttactacaagtttatgtgcgagctctaaaattaaattagaacataactaaatgtggctttaattaccgcactcatgcttttggcattcacatgtaagatatatttcctactgtgttctacaagtacggaatcacgtaaaagtacaacatggttccaaaatggaagcttgaattatgttgacagagaagtatacaggtcaactcccttccaaacataacattagctctaacttaattctgctgaagtggtctgtagtctgcataactactttcatctcctctcagaccatgccatgatctgcccacagaaaaagatcgtattatattctgctatagactacatatatagcataaacacaaaagctgatgcagtcaaacatttctggtaaccaggcaacaaacactattatatatgcaaatgaccactagctctctttgagttgagtgccacacaccttgcaatatgtcagttgagtaaatctgttaggtattttgtatatgttaatatatattttcataaaagtcattgaagctagagaaatatgatcgacttaatacaaagctagtgtgacttaaattggattggagggagcaatttgtaatgtataggctatatgcttgctttagggccatccagatagaaatgtactaatgaaaaaacattatcaggtaccttcttgtattggatgacgtctgggaaaaggatattaactttgacaagtggagaaagatcaaggcgtttcttacacaagatgtctatggcgccgtattagtgacaacacgtgaaaaacaagtagccgagtttatgggtgctgtagttgacagctcatggacaaatcattaccatgaagtggcaatcttgggcaaggaatacatacaagaaattatagaaacaagagcattcggattgcagaggagcaagccagatgatttagttgagttggttgatcgaatcgttgagagatgtgtggggtctccattggcagcaaaagcaattgggtctgtactgcgtgacaagaccactaaggaagaatgggaggctgtgttacaaccaagcacaatatgcgacgataagactggaattatgcctatactcaagcttagttataatgacctaccaattgacatgcagcaatgttttgccttttgtgctctgtatccaaaggattatcagattgatatggacaagcttatccaactatggatggccaatggttttatctcagatcaaaaaaaggtacctgctgaaaccgtaggtaaaaggattgtcaatgagctggtctcgaggtcatttttccagtatgaggagcgaagttggatggggtacaattctacaacttttttgaagattcatgacctcatgcatgatcttgcactgtctgtttcggaaaaggaatgtgtctgtataacaagggaattgattaaaaatagtgagttgcttccaagtgctgcccgccacatacttattcaaaattggataggtaaagagattcatggttatttatatggttctatgaggaaaatgtctcggcctatccaaacatttatgtttgatgggtctagtgaagctgccggtgtgcaacatttatcaagatatagttctttgcgagtactttctgtgccaggaattgggtttcatttaacaataaaaccaaagcatcagtgccaccttaggtttcttgatatcaaggacagtgtcatcaaagaacttccagatgacat

SEQ ID NO: 126 - DNA, 3458 bp, Zea mays
accggggcttgcctgggataaacactatgttagtgtttgttagacgtcgtccactcggcgatcatcttttgtgctgatacttgtttcgattatccatcttcagattaatccaccagcatcatcttgcgaattagtccacccgttacgtcatcttggggtcgacttaactttggtcttccatatctcgtagtcaattaacgtacctgaatgaaatgcattatgcacatgaatgcataaagacaggaatatcataaaactaaatagtgctacatgatagcgaattaaatacctaacggcgagacatcgacacaatcctacgtaagcattagacacctataactcactaaacacaacaatcacgattttctagttttactagatttaactcaaacatcaaggaacaataaattatacgcacgtctattttccttagctaaggtccaacaccagaagactatcaaacctagatttatttattaggaaaacaatagaccatatgagttccacctttttatttgactaaagcataatacagaaagactaattacttagactcattattttggaacatgaaattcgaagtatggacggaaacaactcaactaactatttaaatcactcttttgaattaatccttaaaatatcctaactaataaaacatcacactatacttaatttatcaagtagagcatcatcacaccactctctagataagaaaatcgtcgatcatatcctactccaacattatcgatcacaaacatagatgatactaactactagcgcaggacatcaacttcatcttacgcgcactgaacacaattaccatcgacagatttatcgacaatcgtataaaatactgaatttaacctacgcgtcaccaaaatactacactctgaactagttcgaatatactcgacaactaaactcctcgaagcacacctcacatcgctggcatctttaacttaaaattaatacacaaactaagcgtcttatttcacgatcataaaatcaatagtaaaaatagtaaatcggctcaccgttccaatagctgactcgaatccgcgagatcggtaatgattctccgatttaggcaatttatcgagtgcttggcagatactatctgaacttcacacaccgcaccagccaacctttggacatcttctcttggggcttcttttgtcagcacgactccaactcggaggcgtcacgtagggaccgacatcgagacggatgaccgaacgacgacggcaagacaaaggatggagacgaccggatatcaacgacaagcactagagttttacgacgggctgttgtaatgggacgtcgatacacgatccatggcaattaggagatcgacgtaggcgaaaccgatagccgaataggaactgcgcagatcgacgacgtgagactcgatctggtgagcacgacgcaagggatcgcagctgctgcttcgacatgaattacttgctgccgagcacgacggaggccagggagcaggaacgctgcacagtgaacccctcggttgcgtgcaggggtaaaatcggctaggcgcggcgattggagcaggcggccacaggggcagcgcccaggcacgcacgacgagaatccgagcagggccagtgcgcagcgaccatggaaaagatccgtgttgggctgaatccgagctggagctcgtggcaacagggagcagggcgagctagagactggaagacgccatggcgagcagtagggagcttcgatggagagaggcgtgacaggaaggtggagcagggagacggacgcgtaggggaggcgcgcgccatgggagatggctatgcgagcgcgtcagggagaaacgccggctgcgcgcagggtgaactcggcacgacaaccatggacaaggtgggcgagcggaggaatgacgcgatggaggagcgcggcttgcgatggagagcagggctgaccggatgccatgggagatcgacttggcaagcaccggcggctggagaaagtcgaggggaggtcgaggagctaagcggctgcatagtggagcaagcagccatggaagagcagagcgtcaactgggagggaggagatgggacggcgctgggatgtccgggaccagggcgcggctgcaggaggaagatgtgagaacgagtgcctgctgccgtgtggagaggagagataatgctgaggaaaaaatgtgcataagaagataaggctaggagaggatgagcatgtagaagaagatattctaccggttacccacttaagcggcgacagagacaaggaaaaaaatgcatcgaatacgattgctggcaaagaaaatattgatgacggccaatgatattctaggaagtttacgtacatgagaagaaaacaacgatagagagatattttctatagtgaaaaatccaaatacgttgaaaatcataccaaggaatggtggaaatatttagagaaggattttccctattttccttctttttttaaaacaacaaaatacgcatattttagggtatgaaattagagtctaaaaatatacaaaaggatcaaacaaaaatgagaccgacaagaatatttagataggatttgatttggtgaatactctcggaattagatgaattttcactcgttatttatatccgaagttttggatctggccgagaaactcaaggaccaaaacactatccgtatacggtacttgagactctattaatttagttgaactgagataaaaatttatctgttttccgaatcgatttgatttctctacctagaatagcacactaatgaataatcccaattgttaatattgtgcacggtttcttggtaacgcaagcaatccggagtattctttcgaacccagtattatctgctataaaatcaaacattaatctctttgtctcggataatatcgggttcagataggatgcaaataggatgaacccaaacgagatcgagactgatattttaaactatatttgatatgacttgaaatcagataacttcgtctgccactcgaacacctgatcactctgccatagatgatttattggagaagaaaatctcaattataattccttggttagcaatcttgcgcatgatttttctcagacaatgcgtgattcagattattttgccccgaacattttagtcgtcgagttcaaattaatttgttcgggataaaatcatccgagtgggtcaagcttccaattcgtattcgcgcgagcgatgagttttaaataatcactagacgcaccgattttcggaacaactatgttccgaacatcacataaatttaggaagagcctggatagataaaaacgaagtcgaactcgcgacagacgaaacagatgtgatattaaaatcgcgataggtgaagatgattaaaatttagcatctgttttatccactgatattacgtgcttaattccacactcgttgtcgagcggaatataaacaccaggggtgttaca

SEQ ID NO: 127 - DNA, 3453 bp, Artificial Sequence
  Recombinant fosmid cloning vector sequence
gatcttcttttttagagcgccttgtaggcctttatccatgctggttctagagaaggtgttgtgacaaattgccctttcagtgtgacaaatcaccctcaaatgacagtcctgtctgtgacaaattgcccttaaccctgtgacaaattgccctcagaagaagctgttttttcacaaagttatccctgcttattgactcttttttatttagtgtgacaatctaaaaacttgtcacacttcacatggatctgtcatggcggaaacagcggttatcaatcacaagaaacgtaaaaatagcccgcgaatcgtccagtcaaacgacctcactgaggcggcatatagtctctcccgggatcaaaaacgtatgctgtatctgttcgttgaccagatcagaaaatctgatggcaccctacaggaacatgacggtatctgcgagatccatgttgctaaatatgctgaaatattcggattgacctctgcggaagccagtaaggatatacggcaggcattgaagagtttcgcggggaaggaagtggttttttatcgccctgaagaggatgccggcgatgaaaaaggctatgaatcttttccttggtttatcaaacgtgcgcacagtccatccagagggctttacagtgtacatatcaacccatatctcattcccttctttatcgggttacagaaccggtttacgcagtttcggcttagtgaaacaaaagaaatcaccaatccgtatgccatgcgtttatacgaatccctgtgtcagtatcgtaagccggatggctcaggcatcgtctctctgaaaatcgactggatcatagagcgttaccagctgcctcaaagttaccagcgtatgcctgacttccgccgccgcttcctgcaggtctgtgttaatgagatcaacagcagaactccaatgcgcctctcatacattgagaaaaagaaaggccgccagacgactcatatcgtattttccttccgcgatatcacttccatgacgacaggatagtctgagggttatctgtcacagatttgagggtggttcgtcacatttgttctgacctactgagggtaatttgtcacagttttgctgtttccttcagcctgcatggattttctcatactttttgaactgtaatttttaaggaagccaaatttgagggcagtttgtcacagttgatttccttctctttcccttcgtcatgtgacttgatatcgggggttagttcgtcatcattgatgagggttgattatcacagtttattactctgaattggctatccgcgtgtgtacctctacctggagtttttcccacggtggatatttcttcttgcgctgagcgtaagagctatctgacagaacagttcttctttgcttcctcgccagttcgctcgctatgctcggttacacggctgcggcgagcgctagtgataataagtgactgaggtatgtgctcttcttatctccttttgtagtgttgctcttattttaaacaactttgcggttttttgatgactttgcgattttgttgttgctttgcagtaaattgcaagatttaataaaaaaacgcaaagcaatgattaaaggatgttcagaatgaaactcatggaaacacttaaccagtgcataaacgctggtcatgaaatgacgaaggctatcgccattgcacagtttaatgatgacagcccggaagcgaggaaaataacccggcgctggagaataggtgaagcagcggatttagttggggtttcttctcaggctatcagagatgccgagaaagcagggcgactaccgcacccggatatggaaattcgaggacgggttgagcaacgtgttggttatacaattgaacaaattaatcatatgcgtgatgtgtttggtacgcgattgcgacgtgctgaagacgtatttccaccggtgatcggggttgctgcccataaaggaggcgtttacaaaacctcagtttctgttcatcttgctcaggatctggctctgaaggggctacgtgttttgctcgtggaaggtaacgacccccagggaacagcctcaatgtatcacggatgggtaccagatcttcatattcatgcagaagacactctcctgcctttctatcttggggaaaaggacgatgtcacttatgcaataaagcccacttgctggccggggcttgacattattccttcctgtctggctctgcaccgtattgaaactgagttaatgggcaaatttgatgaaggtaaactgcccaccgatccacacctgatgctccgactggccattgaaactgttgctcatgactatgatgtcatagttattgacagcgcgcctaacctgggtatcggcacgattaatgtcgtatgtgctgctgatgtgctgattgttcccacgcctgctgagttgtttgactacacctccgcactgcagtttttcgatatgcttcgtgatctgctcaagaacgttgatcttaaagggttcgagcctgatgtacgtattttgcttaccaaatacagcaatagtaatggctctcagtccccgtggatggaggagcaaattcgggatgcctggggaagcatggttctaaaaaatgttgtacgtgaaacggatgaagttggtaaaggtcagatccggatgagaactgtttttgaacaggccattgatcaacgctcttcaactggtgcctggagaaatgctctttctatttgggaacctgtctgcaatgaaattttcgatcgtctgattaaaccacgctgggagattagataatgaagcgtgcgcctgttattccaaaacatacgctcaatactcaaccggttgaagatacttcgttatcgacaccagctgccccgatggtggattcgttaattgcgcgcgtaggagtaatggctcgcggtaatgccattactttgcctgtatgtggtcgggatgtgaagtttactcttgaagtgctccggggtgatagtgttgagaagacctctcgggtatggtcaggtaatgaacgtgaccaggagctgcttactgaggacgcactggatgatctcatcccttcttttctactgactggtcaacagacaccggcgttcggtcgaagagtatctggtgtcatagaaattgccgatgggagtcgccgtcgtaaagctgctgcacttaccgaaagtgattatcgtgttctggttggcgagctggatgatgagcagatggctgcattatccagattgggtaacgattatcgcccaacaagtgcttatgaacgtggtcagcgttatgcaagccgattgcagaatgaatttgctggaaatatttctgcgctggctgatgcggaaaatatttcacgtaagattattacccgctgtatcaacaccgccaaattgcctaaatcagttgttgctcttttttctcaccccggtgaactatctgcccggtcaggtgatgcacttcaaaaagcctttacagataaag

SEQ ID NO: 128 - DNA, 3452 bp, Zea mays
ggagattttggccccgtgtgccgtgttcgtgttgcagcctggttccgatcaaccgcttcctggctatctcggcgtccttcgagcgccgctgcgggtgctggctcggcgggtgcggcgacatctgctcctgcgccgagggtgttcgacggaatgacgcataatgagagaggtagccagcggttcttctctgactgtacttttttccccattatcgaaattgatgatttgatgtgctatagtagtgtcagtgctacgtagggctggactggactgaaaatatgccctgctgctgcatgtagagtacagttttgtgtgctccgtgtctctgccattccccttttgcaatcttattgcctctgaatttctgcatcatatgaccagagtccctgtggtttattttcgttatgggagttgggtccgtttttttttctttttgtagaagcctggttgaggtaaactctaagtaaggccccgtttggtttggagtaactaaagtttagtcacttttagtccctaaagaagcaaacatggtgactaaactttagatctttagtcacctaaactttagatctttagtcaccaagagggtgactaaaagggactaaattaggatttttaacttatttactctcttcacttttttcttgcaacaaacatccactaattattaagggtaatacagtcattattcacagcgattaatgctctttagtccgatttagtcactgaaaccaaacggggtactttagcgactaaagtttagtctagtgactaaaggaaccaaacaggccctaacttgtgttttgtggaacgctgtttaacgccatcctgattcagggtgagctcatctggaaaataagaatattactgttagcaaagcactgaattgtttaatccttcggtactgttgttctgtcattccaaatggtcgtgccctagcccctctgattttatggttatctaacaattctattcagtaaacaaattctgcaagactgaaaatggacatgaaaaatgaggctattatgactggagtactagtgttcagtgtcacaatataagtgctatgctaaattcagctcgcaaaggtgttaaacctgcagctccattagtttagctcctgatttattttttcaaatgttttttttcattttcaaccatttgtacagattttagtgaaatccggtgtattttctcattttgatttattttaaacttgcattccttttatgacgggatgtaaatttgatagcagaagatatgtgaatgagtatcacaaggttgctacttgtattaacttgctatttctttcagcgatgcaatgcaaaagtttctgattttctgaaggtggacaaacatgctgaaacattcacagttcagtctgcagagaattttttctgctcttagcgtcaagcaaattccacttcctttttgtaagtacaaatcccactttgtgaagtttgcctaaaagtaaaactgagagagtttggggcagctgccttgcttggatgggcatttggtttaaccatcaatctataaaacagtgtgcctgttctcttattgctgtactctccggaattcattttggtgctcgttctttttgtaacaagctaaacaatggaattgccctaaaggatagaagccttattaggtttgacaggaatttgattgacatgtttacgctacatgaacttttgcaacagtgtacacagaagaggtccctcttggttgggaaaggctgccatggtttagccatccatttgggtttggtaactgatactgtcacatgcaatattctcatcaacttgtatacaaaatgtggtaggaatgattgcgctcgccatgtttttgactcaatgtctttcagaagcatagtctcatggaataccatgattgctgggtatacctgcaatggagatggtttacaggctctgaagcttttttcaaagatgcaccaagaagggacacagatgagtgaatttaccctgtccagcaccctatgtgcatgtgctgcagaatgtgctactatagaatgcagacaattacatgctatagcaatgaagcttgcattggactcaaatagttttgttggaactgctgttcttgatgtttatgcgaagtgtaatatgattaatgatgcctgtttggtttttgagaagattcctgagaaaactgcagttacatggagtacattgtttgtaggactcatgcaaaatggtcttcacgaagatgcattacgtctattccagggttcacaaagggaagggatacaattgactgaattcactctttctgctatactcagtacatgtgcaagcctagcattgatgattgaaggaatgcagctgcatgcagatgttatcaagtatggttttaataacaatttgtttgtggcatcatctcttgtggatgtttatgcaaggtgtgggcagattgagaaagcctatctagtatttgctgacatgaaacacaagaatgttgtcctgtggaatgcaatgataactagttttactaggcatggtaaatctttggaagcaatgattctctttgagaaaatgcagcagtcagggatatctccaaatgaagttacttatgtctccatgatgtcggtgtgtggtcatgcaggtttagttgaagaggcccgatgctactttgatctgctggttactgatcagactgttaaacctaatattgttcactattcttgcatggttgatgttttggggcgatctgggaagactgatgaggcttgggaactgattcaacaaatgccatttgaaccaactccttctatgtggggatctttgcttggttcatgccgtaagtacaggaatgtcggaatagccagactagcagctgaacagcttttcaaacttgaaccagaaaatggtgggaaccatgctttgctttcggatgtatatgctgccagcggaagctgggagaatgctgtgttggcaaggaagtatttgaatgatactggtgcaaggaaagatacagcctcaagttggatgtaggcaaagccgcaaaggttaattctcatattattgtttatgagcaaaaagaggagctgtttgtgcagactatcatttaactatttaagtacagcccatgttcttatgtggacttctggtaattgagaactaaatgaggaatagcaagcatttatccgtgactctccaacgctcttacacactcatcatatattaaattgttgccatgtggtagtggcagtgtggcacgctgcacaggaggtaaatgtcagcacttctactgttaacattgtcagtgaagtcaatagtattaatgtcatgctcctggccccatctagtgtaatatcaacactatcatttgaatgttaattataagagtaggtagtgtcaagggcggacctaggtagagactagtgagggacaggccaccgctcaattctctgttgtaagtagtagagcata

SEQ ID NO: 129 - DNA, 3449 bp, Zea mays
gcacgggcacttacctagtataaaatgaaaatggtagaggtgtttccctcaccgctttattcactaatcagccattgaaggtacattaccatgagaaatcataataccctaaacatgtgcaggggtgtaataaacatcaataataatatgaatactaaaagctcatgcttgaccggatcaagcgtgcgatacacctatattgaaacaccaaaatcagtaagcaagcaacataacaagtctccttagccatcacaagagccatagcacacaaatctacctctacacatgaatgagaaaccgcttcttagtcttccaagcaagcaataatagtatcaccaaaaacacaataggtagaaagagtgacaattagaggaaccactaccccaagtagcatgacaatatatctaaatccttaagtgctaggtgggggaaaatcaagcaacaaacaacatgacacagtctcacaaagataatgtaagaaatattacaccaacacacgaaaatattgcataaagtataaatagatatttgtctatgcaagaatatattttatttgagaccaaaataattttatttgagttaaaattgttttgttattgattttatttcatttcgaacatccaagtttaaatttcaaataactatatattggagtggattacatgtttatttcaataaaatagaggggctttcatgcaaaactagaactattagcgttggatgacttaggctctaaccaatatcggcttgttttagccatcagatcacatgtgtgcgtctatgattaaaagagtaattgtgagggtggtgcttagagagcgacgtccttccccatgatagacatcagatctctctcttttaatttattatcaagtgttttctaccttgactaattcatccaccatgcttcttcattgacttctgggtagtgtacaatataaaaaagtgcatgttttgatggcacaaagaaggcatataaaaagttcaaacatttcatagctgaaatcagcagtcagagatgtaggacgacaaccaccaacaactgttgtttcacgggaccactccctccaaattcttctaagttcaactttgaatgcgagtagaacaaggggaacactgacaataaggaatccaccgtgaacttagatcatgaggttaaaaagcttgcatgcatgcatttgttaattgctgaatttagcagtaataatatggattaaattagtaatttctatgtggaattatatgcaacaggaatgcacaattgcttttgtatttttcaaaactcgctatgacgcagttactacatcaaatatggtgcaggcatctaacccaatgaaatgggttactagtctggctccagaaccagaagacttgtatttgtccaatctttggcaatccaacaagtggcgtaaagcaacactaattccaggcaatattatttttgcattcttacttttgctgctgatggtgtgtatacaagcattatttgacccagagcagctgcaacagttgattcctgcttcgttaaaagaaaggttggagaattaagtactaaaacttcagttgggctatctcgatagatgtgtgttcttatgtcactacaaatatatatactatccatttgacctgtctgcatgttgcacctattaaatatatattacccgtcctatttgcaggaaaaactacatgactaacctagtaacgggataccttcctaatgtgatccaacaaattattctatatattgttgggacattgatgatgaaagtttctaaattggaaggtgccacatctcacagtgcaaggaagatgagtgcttgctttaaactgttgtgcttcatagtttggaacatattctttattaatgtactatttagtacattcatgagtcaattgaatttgttattaagcccaaaggacattcctgtcaagcttgctagagctttaactagacagctttagcacaccttcccttttctttatggaatgataatatattggttttgtttatttaattttcatctaacatttctgtttcttttctgtgattttatcttttattgcaggctactttcttcatcacctatgttatgacctcgggatgggctagtttataatccaaacttttgttgttttttaatctgataatagctttataaatatattttgagaaagggataatatagagaagatacagaatttgttcccacattcgcctatcagcatgaggtgccaaaagttctattgtttggactattgggcttcacatgctctatggtggctcctatgattttaccgttcctgctggtatacttttaccttggccgtgttgtataccgcaatcaagtgagaacctagaaatttgtccattcatgataatgtaccatgtgttctttttcagtttctcaatgtttatcgaacaaggtttgacataggaggattgtattggccaattgcacacaacacaactatattctctctcatgctcacccatatcctctgtgctagtgtatttgacactagagagtcgtgggtagctctatgcttgaccatacctcttatcagctctactcttccatttcacttttactatagaaagagtcttctgttattcaagactattccaacaaaggtaatattagttcgttaatataatgtgaaatgttcctttccaaaacgatcatgtggagatgtgactaggtttactagagcataaaataataattgatggctagagtttattgttgccttgtgattttgcaagatctcttctcttatggcatttattgttgccttgtgattttgcaagatttagttgacacggatatggaagatgaacaattaggaagaagggaggaaattcaccacatactccattcttcttattcccagatccttaatattgaagaagtacccttagaggaaattaagattgttggtggtgccgaggagaaatgttctagctcgagtacgtccactagcaaagaaacctctgaaaatcctcaaaaggacaggtctcacccattaaccatatctgtgatgtcgcaatgtcgattacatcaaattctttcctcttaacatgtcccacccattaactatatatgtgatgttgtagagttaaaattcttaagtttgatttctccacacaacaaacttttgtcattcaccaacctcactgtgttacaatgcccatagaggattgtggactagtattccataaagaatggtagacttggagtcgtgatactggacgagacaaccaaacttccggttcctagtgcccatatgtaatctataggaccacatcctactttgaccatatgttttcaatattagacactagtacaagaggagaaatatgcacaaaccccattagactacatgtgaaaatacaatagatctattatatccacaatgctcccctcaccctcaaactcaaggtggatcgg

SEQ ID NO: 130 - DNA, 3431 bp, Zea mays
gtgtacttgatattccaatgttgttgatctttatatactgtaggattgtactacttccggttcatctcactgttgctgcaactggtggtgtcttaactacaatctatacgaacatatctactcaattaatttaaaacttctcgtaaataaaaagactaggagtgggtaatgttcctataagtaatcttataatgatttttacaagtgttttattatttgtttaacggtttgtcatacatgcaacttaaaataataaatacatgctttccatgctctaattttgcttatcattagtagtgcaatgtcacaaatgatgtatatttagttgtttacaacaaaactaaactttgtatgtatgtacaaacattcccatgaaaaagtataaggttgtgggcatttctgttgttagtttattgggtttactttgtcaattatttcatactatcaaaatcttacaaacatattttaaatttgagggctactgcaaaatccaaatcagatattaaactagataactttgtagtgttggtgagagatgtccttgtaacgtctccaaatgaaactataaatttttattgcttcactaaaatactttctatagatcaatggttgtgataggtcacacaaaggtaattctacactttaattatagagagggatacatgtccaaaaacaaccctacaaaaaatgaaatagaaattttattatattctgattacattgcattgtaggctgataaaatataccaagagatcgaatgtcatacggagaaaattgtccgcgctgtcgcgttaaagtcatatatgtaaacttgaaactgaaagtaatacaagggcacaaagcatattaatatgactaatttacttattcttattgataaaaaggttgacacaattgaatattgtagtgattatactaagaaattgttgcccaaattagaagctgaaactgtagagtaccctttttgtcttcttcagtagtagatatgatgaatctcataaatctcaaaatcttcatgctcaagtctatgatgaatggacaattatgaaagctactaaaccacgtcaaataatatggtccaaccttctaatctaaggaaactatacgagaagcaaatcagacaatctatggtttatgttattatctttttcattgtttctcatttttgtttttatatgatttttcttgctgatatctctgttgttacaactttataaaatatggagaaggtaccctttctgaaagtagtggtggagcaacgagaaatcaagatggtttgagtcaaacactcaaacattccccaaattgcactcattatattactcgcatgcctaactacacttcttatgtttctctcaaaacaatagtgaatcccttcgcagagccaagcagctataaggacataagtgaaatatttctatttcatcatttttaatgttttctatttttgacagttgtaagcacattgtttaaatctttgacagacattcacaatcattatactaagattgtgaatatgattgtcaaatatctgtctggaagtgcaacattcttccccagatttgttgcgttcaagtaattctgttgtctcactttatcgttacctactgtcaaaatattattcttaacatttttgcatttgataacaacttcacaccctaactattaaattgttgtcattgatagattctttgttggctttgagctctcttgattgttttatctcatcattttctatcttaaaaaaagggtctatgcaagacgaaggatgaagtgaaagcaacatggtctctaggggttctacaatataacaccagggctccaatttacatgctcatcgcaacagttgttttgtgctactccgccattgcacctttgattatttcattctatgttgcattgctcttagatgacttatagcgaaaaatcaggtaagccagatgttttttttgtgtgaaatgactagaaagaaaagcttccaattatattaaaagaataaaaaatcgaaacagggcaaaacaatagtgcaacaaatgcatcattttttttgtttgcgcactttgatattcagtttgttaatactataactttttatgttgttttgtgaaattatttttatataaatgatcttgttttgttaattggttgtttggtgaagttgattatcgaattatccacctttctaatgcatattttaagagtgtttatagtgcctaccaaacagggtggctcaccgaattaaacttctcatgtcaagttaagtaacttggctagtttggtagggtccatctatagttaaactgatcatctctagttaagggtccatctatagtgcctgtttggtagggtgaaattatctcaagttccacagcaaaattcaaacaaaaattaccactgttttatcccctaacaaaccctagttctggaaatctatatgaataactaaaaatataaccagaacaaacgcaaagccactaaccattcataaagcccagctaaacaacaataggcgcacaatgttgcaagcccaaaaaatctaccaagcaatcagagttaaacatagaccacaatttcaaaacaagcaaacgcaaatctagtatccacaaaaatgttcagctccgatgcaaggaactacagaatctccaacctaataatagccgccctagaaaaagtgcacatccgaatctaatccttgagtttatatatgaaacatcacattgaagggccgacaacacgtcaggaagaataatagggctgcaaatcgcaaaaaaaaaagaccgaaccgaaaaaaataggtgtggaggatggcctcgtgaatgatcatcgatgcatcaggcgagtcgaacgaaaccctaacctccatcaagcgcgcgcggccagccatttcgtcacacgaaactaccgtttccagacaaggggaaggcgcgggatgacaactcaccttttgactcgaatcccgttagccggatttccttctccaaatctagaacgagagcgatgcaaccaaggccacgacacaagaggatttctcaccttttttcgcagaaacaaaccaaccgcgtcagttcgaggggccgcattcggctaaccggcggcgaggaatagcgtcagggagaggacctcgagcgaggagagcagcgagacggaggcagcgatgaagacgagggagaccgcgacccagagaggaagagggtcagaagagcacgagtggggagggaaaggccaacagcccaaccctagcgcaggcggctggctatctacctccggactctggagacgcacgtaaatgggcctagaggaaacgcctgcccacgagcaactgtttggaaatataaaagtttcaactcataaaaaatggctccaattttttataaaaaacagtttcaactgtgttctattatataatgggcctgtttgtttcggcttctggc

SEQ ID NO: 131 - DNA, 3500 bp, Zea mays
gtgcgacagaccaacgcgtagtggcaccgacaagctctaattcgccgtagaggagaagaaccgggcgggtcgagggtactctatagagaaatcctagccacggagtgggtcgatcgagcgcaccgaggacagcgcgggctctccagtgaggagtttgggacatctagggccacaactttggcaaggggtggagctgtatcggccggacgccgtggaggtgcggcgaaccgacgtgcagaggcaccggcaagctctaattcgccatagaggagaaaaactgggcgggtcggggctactctagcgagcaatcccatccacggagtggggcgatcgagcgcagcgaggccagctcgggctccggtgacgggtttgggacatctagggcctcaacttaggcaaggggtggagctgcattggccggacgtcgaggaggttctacggaccgacgtgcagcggcactggctagttctaattcaccgcagaggagaagaactgggcgggtcaggggtactctagcaagcaaatccaaccacagagtggggcgatcgagcgcactgaggacagtgcgggctccggtgaggggtttgggacatctagggcctcaacttgggcaaggggtggagttgcatcggccggacgccgtggaggtgcggcggaccgatgcgtagtggcaccggcaagatataattcgcctaagaggagaagaaccgggcgggtcgggggtactctggcgagcaatcccatccacatagtggcacgatcgagcgcaccgaggatagcgcgggctctggtgagggatttgggacatctagggccacaacttgggcaaggggtggagctgcatcagtccgacgctgtggaggtgcggcggaccgacgcgcagcggcaccagcaagctctaatttgtcacagaggagaagaaccatgtgggtcgggggtactctggcgagcaatcccagtcactgagtggggcgatggagcgcaccgaggacaacgcaggctccggtgagggggttgggacaactagggccacaacttgggcaaggggtggagctacatgggccggacgatgtggaggtgcgtccgaccgatgcgcagcggcactggtaagctctcattcgctgcagaggagaagaacggggtggatcgggggtgctctggcgataaatccaagccatggagtggggcgatcaagcgcaccgaggacagtgggagcttcggtgaggggtttgggacatctagggccacaacttgggcaaggggtggagctacatcagtcggacaccgtgtaggtgcggcagaccgatgcgcagcggcaccaacaagctctaattcgccgaagaggagaagaaccgggcgggtcgagggtactctggcgagcaatctagccacggagtggggtgatcgagcgcatcgaggatatcgcgggctcccgtgacgggtttgggacatctagggccacaacttgggcaaggggtggagctgcatcgaccggaggtcgtggaggtgctgcggaccgatgtgcagcggcactggcaagctctaattcaccaaagaggagaagaaccaggcgggttgggtgtacaattgcgagcaatcctagccacggagtggggcgatcgagcacaccaaggaaagcgtgggctccagtgcggggtttgggacatctagggccacaacttgggcaaggggtgaagctgcatcggccattcgtcgtgaaggtgcggcggaccaatgcgtagaggcaccggcaagctctaattcaccgtagagaagaaccgggtggatcgggggtactctgacgagcaatcccagccacggaatggggagatcgagcgcactatggacagggcgggttccgatgaggggtttgggacatctagggccacaacttgggcaaggggtggagctgcatcggccggacaccatggaggtgtggcggaccgacgcgcagcggcaccggcaagctctaattcgccgcagtggacaagaaccgggcgggtcgggggtactctagccagcaatcccagccactgagtgggaagatcgagcgcaccgaggatagcgcgggatcaggtgagggctctgggatatctagggccactacatgggcaagggatggagctgcatcggccgcacgtcgtggtggtgcggcagaccgacgcgcagtggcaccggcaagctctaattcgacgcagaggagaagaaccgggagggtcagggctactctggcgagcaatcccagccacggagtggggtgatcgagcgcaccgaggatagcgcgggctccggtgaggggtttgggacatctagggccacaacttgggaaaggggtggagctgcatcggccgcacaccgtggaggtgcggtggaccgacgcgcagcggcaccggcaagctctaatttaccgtagaggagaagaaccaggcgggtagggggtactctggcgagcaaccccagccacggagtggggcgatcgagcgcaccgtggacaacgtgggctccggtgaggggtttgggatatctagggccacaacttgggcaaggggtggagttgcatcggtcggacgccatggaggtgcggcgaaccgacgcgcagtggcaccgacaagctctaattcgccatagtggacaagaaccttgtgggtcgggggtactctggtgagcaatccgagccacaattaaagtggggcgatcgagcgcaccgaagaaagcgcgggctccggtgaggggtttgttacatctagggccacaacttgggcaaggagtggagctgtatcagccgcacgtcgtggaggtgcggcagactgacgcgcagcggcactggcaagctctaattcgccgcagtggaaacgaacctagcgggtcggggtataaaatgaaaatggtagaggtgtttccctcaccgctttattcactaatcagccattgaaggtacattaccatgagaaatcataataccctaaacatgtgcaggggtgtaataaacatcaataataatatgaatactaaaagctcatgcttgaccggatcaagcgtgcgatacacctatattgaaacaccaaaatcagtaagcaagcaacataacaagtctccttagccatcacaagagccatagcacacaaatctacctctacacatgaatgagaaaccgcttcttagtcttccaagcaagcaataatagtatcaccaaaaacacaataggtagaaagagtgacaattagaggaaccactaccccaagtagcatgacaatatatctaaatccttaagtgctaggtgggggaaaatcaagcaacaaacaacatgacacagtctcacaaagataatgtaagaaatattacaccaacacacgaaaatattgcataaagtataaatagatatttgtctatgcaagaatatattttatttgagaccaaaataattttatttgagttaaaattgttttgttattgattttatttcatttcgaacatccaagtttaaatttcaaataactata

SEQ ID NO: 132 - DNA, 3429 bp, Zea mays
tataaaatgaaaatggtagaggtgttttcctcaccactttattcactaataagccattgaaggtacattaccatgagaaatcataataccctaaacatgtgcgggagtgtaataaacatcaacaataatatgaatattataagctcgtgcttgaccagatcaagcgtgtgatacacctatattgaaacaccaaaatcagcaagcaagcaacataacaagtctccttagccatcacaagagccatagcatgcaaatctacctctacacatgaatgagaaaccgcttcttagtttccaagcaagcaataatagtatcaccaaaaacacgataggtagaaagagagtgacaattagaggaaccactaccccaagtagcatgacaatttgtctaaatctttaagtgctagatgtgggaaaaacaagcagcaaacaacatgacacagtctcacaaagataatgtaagaaatattacaccaacacatgaaaatattgcataaaatatatatagattttttctatgcaagaatatattttatttgaggccaaaataattttatttgagttcaaattgttttgttattgattttatttcatttcgaacatccaagtttaaatttcaaataactatatattggagtggattacatgtttatttcaataaaatagaggggctttgatgcaaaactagcactattagcattggatgacataggctctaactaatatcagcttgttttagccatcagatcacatgtgtgcgtctatgattaaaacactgattgtgcgggtggtgcttagagagcggcgtccttccccatgatagccatcagatctctctcttttaattatcaagtgttttctaccttcactaattcatccaccatgcttcttcattcacttctgggaagtgtactatataaaaaagtgcatgttttgatggcacaaagaaggcatataaaaagttcaaacatttcatagctgaaatcggcagtcagggatgtaggacgacaaccaccaacaactattgtttcgcgggaccactccctccaaattcttctaagttcaactctgaatgcgagtagaacaaggggaacactgacaataaggaatccaccgtgaacttagaacacgaggttaaaaagcttgcatgcatgcatttgttaattgcttaatttagcagtaataatatggattaaattagtaatttctatatggaattatatgcagcaggaatgcacaactacttttgtatttttcaaaactcgctatgacgcagttactgcatcaaatatggtgcaggcatctaacccaatgaaatgggttactagtctggctccagaaccagaagacttgtatttgtccaatctttggcaatccaacaagtggagtaaagcaacactaattccaggctgtattatttttgcattcttacttttgatgctgatggtgtgtatacaagaactatctaacccagagcagctgcaacatttgattcctgcttccttgaaagaaaggttggagaagtaagtactgaaacctcagttgggctatctccatagatgtgtgttcttatgtcactacaaatatatatactatccatttgacatgtctccatgttgcatctattgaatatatattactcagcctatttgcaggataccttcctagtgtgatccaacaaattattctgtatattgttgggacattgatgatgaaagtttctaaattggaaggtgccacatcttacagtgcaaggaagatgagtgcttgctttaaactgttgtgcttcatagattggaacatattctttgttaatgtactatctagtacattcatgagtcaattgaatttgatattaagcccaaaagacattcctgtcaaggttgctagagctttaactagacagctttagcacaccttcccttttctttatggaaagataatatgttggttttgtgtatttaattttcatctaacatttctgtttcttttctgtgattttattttttattgcaggctactttcttcatcacctatgttatgacctcgggatgggctagtttatcatctgaacttttgctgttctttaatctgataatgagctttataagaaatatattttgagaaagggaaaatatagagaagatatagaatctgttcccacattccccagtcagcatgaggtgccaaaacttctattgtttggactattgggcttcacatgctccgtggtggctcctatgattttaccgttcctgctggtatacttttaccttggtcgtgttgtataccgcaatcaagtgagaacaaagaaactatatttttttcttacttaccccaaaatttgtccattcatgctaatgtaccatgtgttctttttcagtttctcaatgtttaccgaacaaggtttgacataggaggattgtattggccaattgcacacaacacaaccatattctctctcgtgcacacccatatcctctgtgctagtgtatttgacactaaagagtcgtgggtagctctttgcttgaccatacctcttatgagctgtactctttcatttcacctttactatagaaagagtcttctgttattcaagactgttccaacaaaggtaatattagttcgttaatataatgtgaaatgttcctttccaaaatgatcatgtggagatgtgactaggtttactagagcatagaataataattgatggctagagtttattgtgccttgtgattttgcaagatctcttctcttatggcatttattgttgccttgtgattttgcaacatttagtttacacggatatggaagttgaacgattaggaagaagggaggaaattcaccacatactccattcttcttattccgagttccttaatattgaagaagtacccttagaggaaattaagattgttggtggtgccgagaagcaatgttctagctcgagtacgtccactagcaaagaaacctctaacaatcctcaaaaggacaggtctcgcccattaaccatatctatgatgtcgcaatgtcgattacatcaaattctttcttcttaacatgtcccacccattaactatatatgtgtggtcatagagccaaagttcttaagtatgatttctccacacaacaaacttttgtcattcaccaacctcactgtgttacaattcccatagaggattgtggactagtattccataaagaatggcagactaggagtcgtgatactggacgagacagccaaacttccagttcctagtgcccatatgtaatctataggaccacatcctactttgaccaaatgttttcaatattagacactagtacaagaggagaaatatgcacaaaccccattagactacatgtgaaaatacaatagatctattatatccacaatgctcccctcaccctcaaactcaaggtggatcgg

SEQ ID NO: 133 - DNA, 3424 bp, Zea mays
taaaatgaaaaatcttaatttcagaagttgtttttattaagagagagaaccttaattcgaaaatcttaatttgaatatgaaatgagcgtatgttcatgacagcacacaattttcacatttgtcggcacgagcaaaagcgaaaaaaacggaacaactcatattatttattgttaattcaaattacgaggaactaatttgaaactatggtcaaattgagtcaaaccattttaaaaagggaacgtgagaaaatttttaggcaacgtcatctagaatctctgctagattaatcgtgtttgtcgtttcgctattgcgagccatttagtacgatcacatcaataatttagtataagattttaaaccttaatctaattattattttttattaatgcctatcctacgtcatgtaagtgagaaaaaaacaaatagaaaggcgaaaggaacagaaaccctcgtgtagcagcctacgagcgcaggctttggcctctgcgtatcttgcgcgggttggccaccgttgggcatggccaacggacagccgccgccacgctgcccaatgtgcggtgcgagccactcgccgcacagccagcctcgcctttgaagctccatgcattgccttgctccatttcttttcattcgaacgaaggagcacctgcagtatgcagcccgaccttcttctacctctagccttccccagtagagctccttggaacatggaattttccacctctactgcaccttccctggctacgcacttggcctcacctccccgccatctccctcaaccagcagccaccatctccctgtatttccaagccgtggagcccaggatgccgaccagggacaccagcaaccggcgtccccagctcgagcaggtgctctccccatggtgacccctctcctccccacatagtcggcgcaggcaccttctcccatggcgctcagccccgtgctccctgcgtgggtctccagccggctcccccctgcgagctccctgccccacgcgccctcagccatggcgcgggaccttctctggtccgagctcaagcagtgcctggactgcgctcgccgatgtcctcctcacgtgctcctccactggtctgtgcccccgcacttgcagcagcggccatggatcccctctgcgtcgcgccctcggcgtgctcgacgtaatgccgcagcaagcagcagcagcgacgccctccgctgcgtcgctctcgccaggtcggtcctcacgccgtcgatctacgcagcgcttgcgcgttgtcgtcgagatccttggtgagcccctcgctagtatcccattgttttttggatctcaagtgcttgataaaaatgtttgaaccactaggtgttattaatcgcagcaagatgttgccgctgcgcctcgcgcaacacatgattcggtgaagcacctaaaccgtggacgcatgcgtaactccactcgggttttggccaagttgtttgctttagagaaaattgtgattttgttttatttacgattcagtcgatggcgtgaatatgtgtgtgaaaatatatttagggccaattccctgtatgccactggaaaatatactcgttccttgtatgccactggccccacatgtcatagacacaaaaaaatatacctatatgccactcagtggcacacaaggaatgagtataaaatcggatggcataccaggaatttttccatatatttatatgaatgaaagcgtgtagagaagaaaatgaagtagaaaagaactcgtatgtttttatgttttcggtaggaatgtattggatgtgtggtttgatgtgaggattaatcttaaaatgcaggttatgttgtggggaatgcatcgataggtgtttacatgaaaagtgtatttgttttatacatgtgatcggtgattgtggtagtcgatgcgattgaggagtatgttggtcctgttggagtcacttgtgctgttgatgtcatgtgcataatgtggggacacgtatgtgtgtgcgtgccgaagtatcataatagtggttgcgtagagttgtctgaagtatttttcggatgcatgctgaaatgcggttgcattcgaaatagggaaggaggtgtgttgtgtgatgagaaggctagattgattttataggttgtatgaaaaacagtctcttaagtgtatacgtcgagtgtgttaattggatcctacatatgcagagtgtagtgtattggttagacgaagagttttggaatagacgagtatgaggcgtgcagttaagccgagattgaagtgcaaatcctatgcaatatgatgggattcgtgattatataggggttatatttgttgatgtgacgagtagtttagaaaatgctagtttgcgtgggggatgtattgttaaggcatgagtgtcggagttcatatattagtggttacgctacgatgatcgaagtgtctcgagtgcacgccacaacatggttgtatgcgagacagggtaaaataaggtgtgctcgacatgaatgttcggtcgttgtaggtagaaattgtcttggcttaattagagaggtggtgacatgccaaagtagtcatcgcttgctctatgtttataagtcgatacaatgcgtattatgcgttcgtaaaattatgcttcacatatagtgtatgattgtgctcacgatttcgagtagacacttcaagtaaatcaagtaggttcgtgatacaagtagtgtaatggagttagtttgctttagaataattattgaaatgttttgatcatatgataaacatgtacgtgttcatgatttgggaagtaagcgcatggtggttgcgagttggagattagtggtttacgattcgtatgatttggtcggtgtgcaaaaatacttgtgaatatgtgtgtttataaaaatgttttagtgtatgttgtgtctcggattgcgataataataggcaagccgacgtgtatgttatttagcgggctatgtcattactctagttagccgaattgttagatggatgtggttaagctcgtggtcacgatgattttcttgttgtagcctaaatacatatggttatggtcgcggatgaaaagtagtagtgctcatgtggtgtctaagttaaaatgcaaactagtgtgtgaagagcgcatcgatatacatatatacccggtctgagtattgtggtgaatgcatttgttaaacatgtgtggtaattctagtgcacggaatgacatggataaaaatttgtaagtctctttgttagtcctcatttgattaatttaactctaacaaatggtaaagtgttagaataattcaggtctctagaacatggcaatttttgaagtaaataggagctgaaatttattagttgctgtttcgggctgcacccactgttttcgtcgtgctgtatgtttgatgatccatatagaaaagttgtagatccatatagaaaagttgtagatccat

SEQ ID NO: 134 - DNA, 3424 bp, Zea mays
cactagtatttaggtgacactatagaagcggccgcgacaacttgtccacatggcagcctttcccaaccaagagggacctcttctgtgtacactgttgcaaaagttcatgtagcgtaaacatgtcaatcaaattcctgtcaaacctaataaggcttctatcctttagggcaattccattgtttagcttgttacaaaaagaacgagcaccaaaatgaattccggagagtacagcaataagagaacaggcacactgttttatagattgatggttaaaccaaatgcccatccaagcaaggcagctgccccaaactctctcagttttacttttaggcaaacttcacaaagtgggatttgtacttacaaaaaggaagtggaatttgcttgacgctaagagcagaaaaaattctctgcagactgaactgtgaatgtttcagcatgtttgtccaccttcagaaaatcagaaacttttgcattgcatcgctgaaagaaatagcaagttaatacaagtagcaaccttgtgatactcattcacatatcttctgctatcaaatttacatcccgtcataaaaggaatgcaagtttaaaataaatcaaaatgagaaaatacaccggatttcactaaaatctgtacaaatggttgaaaatgaaaaaaaacatttgaaaaaataaatcaggagctaaactaatggagctgcaggtttaacacctttgcgagctgaatttagcatagcacttatattgtgacactgaacactagtactccagtcataatagcctcatttttcatgtccattttcagtcttgcagaatttgtttactgaatagaattgttagataaccataaaatcagaggggctagggcacgaccatttggaatgacagaacaacagtaccgaaggattaaacaattcagtgctttgctaacagtaatattcttattttccagatgagctcaccctgaatcaggatggcgttaaacagcgttccacaaaacacaagttagggcctgtttggttcctttagtcactagactaaactttagtcgctaaagtaccccgtttggtttcagtgactaaatcggactaaagagcattaatcgctgtgaataatgactgtattacccttaataattagtggatgtttgttgcaagaaaaaagtgaagagagtaaataagttaaaaatcctaatttagtcccttttagtcaccctcttggtgactaaagatctaaagtttaggtgactaaagatctaaagtttagtcaccatgtttgcttctttagggactaaaagtgactaaactttagttactccaaaccaaacggggccttacttagagtttacctcaaccaggcttctacaaaaagaaaaaaaaacggacccaactcccataacgaaaataaaccacagggactctggtcatatgatgcagaaattcagaggcaataagattgcaaaaggggaatggcagagacacggagcacacaaaactgtactctacatgcagcagcagggcatattttcagtccagtccagccctacgtagcactgacactactatagcacatcaaatcatcaatttcgataatggggaaaaaagtacagtcagagaagaaccgctggctacctctctcattatgcgtcattccgtcgaacaccctcggcgcaggagcagatgtcgccgcacccgccgagccagcacccgcagcggcgctcgaaggacgccgagatagccaggaagcggttgatcggaaccaggctgcaacacgaacacggcacacggggccaaaatctccgctgcgactgcgagtgaccaggcgctagagcctagcggcgagcgacgagaggaaattgcgaaagcaaatatcgagcccgcgggctggtgtgggaactccggagtccggactggggcatacggcccgaaacagagcgaggattagcagctcaatagcatggagactcttccttaaagcccgagcactcatggcacgtttcggcccattgtctgcacgtgtgttttgtattctgcggattgtcgtctcccaaaaggaggaaaatctcaaaaacaaggaataattagatatataccattaaaatattataactttagatataaatcatagactctacatgtcattgacacatgtgaatcccacatataagtaagatagtaatggtatatatctaaagttataatattttagtagtaaactagtaacagatccatatttccccaaaaacaatctccaatttgattaaatatatacagaaactattaatatatatgatcttcagaaaaaataatacattagtcgtcaaatgttttttatgacaaacatagtggaagatattatcttatgcaatcctatgaagatttagaatgttttgactccttgggaaacgagacttccattctttcctggatggagaaaatatttgggtgtgggttatcagatcacctaaaattttagatccagtaatttagtttttttcaaaaaaataggtccttaaattgatagctacagtttgtcttaaaaataaacaatgaaaaaaatacagtatatatatttcaaaactaccgagttctaccaatattcaattgaaaataaacataaatgccaggtgccataaagtacaagtatacattatatatattaacggttaatatatacatttagagtttattggtggtgagaaattgtttcattaacaaaccaaactctaccataatattttctgtaagttattactttgtatacaccttggcataccaaaattggaacccaactgtgagaactccattttttataaaacagtgccgttatacatatgattcttggatagaagataattcaacattttaagtgttgcggtgtagattgaaactattgtcatgtcactgtaatatcaaagaatataatgtatggtacggtctagaatctattttaacaaaatatagttgacatttttaatagaatatataataagaagcaaagtctaaatttaatgtgtggatgaaaaatatgacattcacttagaattagaaattgagattcactaaatatagatttgtaatgtctcaaaaagatgtagcaagggttgatataactccggataaggttttagcaaagtacatattaaaaatcactgaatgtatgacgaaatcatataaagtatataaaaattgttgtgttagatagaacaatcaattttgagtagctatgaggtataaatttatccacatagtgttcagatggtgcaatgcatgtaatagtgtaagcacatgattgctacccacttcactataaattgttgacccatcaatggtggtttttaatttagaaatataaaaatgacgtaaggttctaaaaaatcaacggtgaggactcaggccacgaatcagcaataatatatcactgtcgattg

SEQ ID NO: 135 - DNA, 3411 bp, Zea mays
tcccttgtcccgatgaaagagtagagaataacggagtccccactaccgagtgattacaaagagaataactgaataattcagttatgactgtggaataactgagtaatgagcagagaataactgagtcatcacaccagaataactatgtgcacccattagaataactgagttccgacaaaagaataactgagtgacgaacatggaataactgagtcggcacatcgcaataactgaggtattataacataataactgagggatcagaaccgaacaactgagtgccgacaccagaataattgagtctgcacacaataataactgagtgggcacattccaataactgaggtatgatgataactgagggatcggaggagaataattgagttagcccacaagaataactaaggtattggaacagaataactgagttctgtcgccataataactgagtgcatccattagaagaactgagttgttggaacggaacaactgagtaatgaacagataataactgagtagtgaacatggaatacctgagtgtgcacaacagaataactgagtaatgaacaatagcataactgagttacttgaacgcaataactgactgtgaatagagaataactgagtaataaacaccgcataactaagtgggcacattacaataactgaggtatgatacacgataactgagggattggagtagaataactgagggatcagaaccgaacaactgagtgccgacaccagaataactgagtctgcacaccataataactgagttagcccacaagaataactgaggtattggaacgaaattactgagttctggcaccagaataactgagtgcgtccattagaagaactgagttgttggaacgaaataactgagtcatgaacatataataactgagtaggcacattacaataactgaggtatgacacaggataactgagggattggagtagaataactgagttctgttactcaaataactgagtgtgtcgtctagaataactgagtaatgaacgcacaataattgagtaacgtacagagaataactgagtgttgaacatggaataactgagggcgcgcattagaataactaagtaccgacattagaataactgaggtaggaacatggaataactgcgatattataacataataactgagggtttagaataactgagttaggaacatggaataactgaggtattataacggaataactgagggattggagtagaactgagttggcccacaagaactgaggcatgagcagagaataactgagttccgtcactagaataactgagtgatgaacacagaataaccgagtactgaaccaagaataactgagaaatgaacatggaataactgagtgccgactccagaataactgagtgtcgactccagaataactgagacatgaacatggaataactgagtgcgcccactagaataactgagtcatgagtagagaataactgaggtattagaacggagtgctgacaccagaataactgagtccgcacaatagaataactgagctactgaaagaaataactgagtactgaacatgtaataactgagtgcgcacattacaataactgaggtattagtccagaataactgagtacgtccattagaataactgagttgttggaatgaaataactgagtaatgaaaacacaataactgagtggcgaacatggaataactgagttaatagaacgcaataactaactatgaatagagaataactgagtaatgagcagagaataagtgagtaggcacacgagaataactgagtcatcacaccagaataactgtgtgcgcccattagaataactgagttccgacaaaagaataactgagtgacgaacatggaataactgagtcggcacatctcaataactgaggtattataacataataactgagggatcagaaccgaacaactgagtgccgacaccagaataactgagtctgtacacaataataactgagtgggcacattccaataactgaggcatcggaggagaataactgagttagcccacaagaataactaaggtattggaacggaataactgagttctgtcaccataataactgagtgcgtgcattagaagaactgagttgttggaacggaataactgagtaatgaacagataataactgagtagtgaacaatagaataactgagtgtgcacaacagaataactgagtaatgaacaatagcataactgagttacttgcgcaataactgaatgtgaatagagaataactgagtaataaacaccgcataactgagtgggcacattacaataactgaggtatgatacaggataactgagggattggagtagaataactgagggatcagaaccgaacaactgagtgccgacaccagaataactgagtctgcacaccataatcactgagttagcccacaagaataactgaggtattggaacggaattactgagttctggcaccagaataactgagtgcgtccattagaagaactgagttgttggaacggaataactgagtcatgaacatataataactgagtaggcacattacaataactgatgtatgacacgggataactgagtgatgaacatggaataactcaaggcgcgcattagaataactgagtaccgacattagaataactgagttaggaacatggaataactgtggtattataacataataactgagggtctagaataactgaggtattataacggaataactgagggattggagtagaataactaagttggcccacaagaactgaggcacgagcagagaatagctgagtttcgtcaccagaataactgagtgatgaacacagaataaccgagtactgaaccgagaataactgagaaatgaacatggaataactaagtgcgcccactagaataactgagtgctgactccagaataactgagtcggaaaagtagaataactgagtattagaacggaataactgagtaattagtagaataacttagttattagaacagaataattgagtgtgcacattagaataactgaggtagtagaacgtaataactgagttccgtcaccggaataactgagtactgacaccagaataactgagttattagaatggaataactgagttatgagtagagaataactgagtgtgcacattagaataactgaggtagtagaaggtgaacgacacagattagatcctagggcaaggtgaacggcacagattagatctcgcataccctttcggctaggaaaggtctgggtcgtagatcatcaaacggagggcccgtgcaaaatctgttgtgtggatgatttcgggccattgatctttgatcctagggcagtgaacgcatattggattataaccttcccc

SEQ ID NO: 136 - DNA, 3407 bp, Zea mays
cgattaaaactcttcttagtcaaaattaaatagaaaataatttaatactcctcgatctccaacccaacacagccattggtagccaggatcaactctaacgcacacatccacgaaacccgcgcacatctcaacgaagagaagcgttttttttattcctgtttaatgcaatgtaataacaagtcttatgtacagttgcaggctacaggcctactcccactgaaaagaatcgccaccgaaccatcacgactctgccaccgccagcgccacagccaccacgttctgcccggcatccagttcttctgacaccgcgttctggtcgatgaagttgaacagcgcgagccccgcggcccacacgtcgttgtccatcaccgactcctccggcgagtggctgatgccgccgcggcaccgcacgaacagcatcccgatctgcgaccacacaatccggagcgtgagcgagctgagcttcactattcagcacactagtcaccgccaacctcacattcgttcgcacgcatgcttcgtcttcttaccttggtgagcctggccatcgccatcgcgtcgtgccctgcgccgctcatcagcacgggcgtctcgccggccgccacggtgcgccccggcattgccgacacggtcgaccgcgccgcgcgcttcagctgagacgttaactccgggtcgcagtgcgtcgctgccgccgagtgctggtgcaagcgacatcaaggtcagactcagttcggcagcacaaactctacaccggcagatatcatgagccatgacaccaagagtgctgattcggtgctcctcctcaccttatgctcgaccttgcaatcgaccagtctgtcatcgcatttctggagaacaagcctcgagaagctcgtcacgatcgtctccctcacttggtcgtccatcgcgcggatgtccaccgtgaagtttacctgtcgtgggcacagctccaaggttcagctgactgatctgagccaccagttcatcagcagggccaagaagagtagtgcttggcaagcttacctggcccggaatcacgttgctcgcgcttggccacgtgttcagctcgccgacggtgcacaccaggccggccagggactcctcagtgaagcagctgcactcctcgtcgtaggtcagcaaactgttgggctctttacagaggcgttccagagtcacaacgagctctgcagctgcaaccatcggatcacggcgcaatttcattggaactgtgccagcatgcccttgcgaaccatctactattacctaggcaaacaaaaacaaagactaagcgctgtaactactttccttctcactcgaaagcttggtatacaaagggacttggaagcaacccagaattattaatgacagttgtcgtgggcagcttgagtatttaaatgtcaatgttaaactgaacaatcttggtgacagcaatgcctgtcttcctgaacattaattaactaagacttgttcttgcatcaaagatgacacatgacataggtgtgccaattattgaatgagatggatgttgactaataccccaggtgtttctctgattgattgtttatccattacatgcacatacttggttaacttaatattgaccactcataccctttgctaagagaacactcctatctagaattatttgattgcttacctgttgactgctatactgtcaccttatggttatctaatataaccggtacttcttttttctcagacacatatagtaggctctgatattgattgttttataaggaaagaatgaccttacggtaggaagccatgcagctagaccatattttagttttgtaaatgtagttcttgaatagatttcacaagaatagcagagaactccgatgcaccttcaatcgtgtctgtcctgcaattccttttacaacaccaagtggataatgaagggcttccaggacagggccttgctccatgtgtacctacagtttttaaaaatatatatatgtgatgtattctgtattaccaggcaactacatgaaaaaaggcatacgaaggcttcatacctcaacataactccccacagactccgggttgtacctggcttgactaatagcagtagaggtagcctcaaaagaattcattttcagaacatcttgtagtgtagtgccactgatgaaactcaatacaacaaatgaactgcatcagagacagttctgtaaaatagttcggttggttcacgcgaaaaagacaacacctcttatctgatacttgtaaaattgattcaggtagtgtaccagctacagcagcgcttcccagaaaagttgtctggaatctgatgccctcctcatcgctgaatgcaatgacctaagcttcaaaaaggaaaaatgagtgctaggctccgccatgatgatttttccaggtgacgataatgcaatctaactaatgctgattcataatttgataaaaaaaataatcttcaagccactttggattagagcgttgaagccatacagtgaagaataaaccatgatttggttcacaccaaaacatgccgaccttgatctatagatgatatctagacatttgtttactgaaatgcatgacacaacctgacaacttgtgcattttgattatcaggattgccagaataacaaaagatgaaccgtgcacagaatcttttcaagatctgtaggaggtacgtcgaactgattaaaggggcattataaaactagattcctccaggtttctatagtctttcctgattatattatgatagtaataaagaacctactaggtaccttgcagcttagctatccaatcagcatcaaaagtacaatatataattaaaactgagtaaaatataataactctatgcctgctactggcaataaaacaatgtgaaatattccaatcaaacaaataaaagagtagatggacacaaacaagatcaatgcagacaagtgcgggtctacaagacgtatgtggctcataacgccacttgtagagagcgagaatagtataaggccattcacaagttgcggtggagcaaagaaacacatttaacatatgatactatagtaacatctttagtatactggaagcagtagagaattctctaacctccactggtctcgttaacctctggagtttccccgtaactttcaaaaccttcagtgctgagattgctgaaataatacccaaggctccatcgtacatcccagcatcaacgacagtgtcctgttttttgaacaaggaaaatcgtatcagttgtcgcaatattggatcgccatcaaaacactgaaataaccggatagaggaagatagactcaccatatgagatccaatcaacaaggcatctctggtagaatttgccggctcatatcgaccatgaatattccccatctgatcgacccaccttcacgttgagcagagac

SEQ ID NO: 137 - DNA, 3406 bp, Zea mays
ccaatcggaaggccaaagatcaggtgcactacttgtggagtgacaggtaaaacctttccagaaaattcgatccggagtgggtcacccttaacattcttcatcaaaaacatccctaaagatctgtctaacagcctgctaataccaaaccgcaaaaaatcaccaaatcccaaacttctcaacctctgcttgtaatgctcagacatagggttgattaaatcatacacaaccttgggagagcacctcatgattgagaagtgtcctttgttcttctacaaaaaaaataaaaagatattgatagacgaataacaactgaaccaaaattggacaacataaccgtaatcaaataacaaaaaacaaaataaccgagactaaggaaagaataaataaggataagaaaagaatatctagacactagaacagaaaaaataacaagaattagaaaaaaatatctaggcactagaacagaataactgaccatacctctggaattggggaaccctgacccttcttccattttggtgagggccttgtgaaatcatcgttgtcgtcatcaccatcttcagaagaggaagaaggctgcattgcagctctgcccttcacatcagcagcagctctgcccttcatattggcaacagctttgcccttcacatgttctgcaacttgtggtacttctaatttatgcaaagaacgggacctctttcttaaacgaatgtgcctgggcgatacatcagcgcattcctctattacggcctctactcggctgttatttgtgtgttgagcatctatgtcttctttctccattgcagcctttaatgggctatcaactgggacttgtgcatctataacttgtgcttcctctactgtaggttttactgtctgtaagggtgcatgttctgcaaattgtggtgcttctatcacaaactctactgtctgtgagggtgtaggttccgaaacttgtggaacttctatggcaacctctaagggtgcaggttctacaacttgtggtacttctattgtagcctctactgcctgtgagggtgcaggttctgcaacttgtgctacttctacatcagcaccttcctctattgcggcctctacttggctgtcatttgtgaattgagcatctacgtccattgtggccttgtcttcctctaatgtgatctctgcttggctgtcaactgtgagttgtgcatctatggggctgcatcgggatggggatagactggatagctggttcttatctgtacctgaaactttttgcataattttgaagctattgatttctttagcaagatattggtcatcacgggcatcaaagcaacgcaaacgtctcttcgcatccatgactaggttagaccatattgaattacttctactaagagtatcttcatgtccaaggatccaaagacagttcctgtggtgaaaataatttatttaaataaaaatatagtgggagattgaattatcaaaggatttaaaagtatttcatttgcaacaaaaaggacaaaagttaacaaaccttgctcttgtcaaggccacattagctcttctatcagaatcgagaaatcctatgttcccaccactattacatctaaccgttgaaagaattatgatatccttctcatcaccttgaaatgaatcaacagtttgtactttaatagaaacaaactcattgttctgaaaccaactaattctttcttgcaaagcagtcacttgggcagcatataaagatattacaccaacactggttttcttcttctgtgtgttgcatgctgcagtagtttagacgaaatatacatagatcagccctaaactaattatttataaaattctataaatttacatactataccttcaacaagtctgcctacaatgctggatactacataagcttcaaccaaattgtgtaaactctgaccaatttgctcttctacaccatcttcaacatgaatgaatgaatacataccaaaaatatgaccgagaaaaatatccatagagctcttgtatttagtaccatctataagttttccatcataaaaattttcgtttggaaatttgctgatgtaagggtgcattctatactgcacatttagcaagtgcttgtgataaccaatttcacacaatctctcaaagagacttcgtccatacttggcctctttagcaacctagaaagtagtaaattagcagtaatgagaaagtatgagcaatctagaaattaggaaataatcattagtaacataaggataaattgttttaaaacaaagacataccgggctcatagtcactgattgtagttgcttgtcatccccaacaagcaccacatgttttaccccattaattgaaagaggaatcaatgattcacattctttcaggtttgctgcctcatcgataaccagggtgtcatattgttgatttttcaacttagaggacatgcaaggagtgcaaaatacaagttttgctgctcgtaagttttcagcactatatttcacaaatatttctgaaaggtcattatcagtatgcttcagaagcttctcactaccaaacataacaatgcctctaattaaaaaactggtctcagaggactttttaaccagggaaacaagatgagaagccaattgcaccaaagctgtgttggttggcgcacatacaatagttctgtgtttccatggtaatattagaagttcgtacagaatcattgagactgttttagttttaccagtgccaggtgggccccaaattagatgcacagaagccttagaatatttactttctgagacacaacttccaactgcatcaatctgagatttattcaatccctcactagcaaacttggaaatattttctttatttgtaaaatatccacaatctccatcaacctgaaacatatattcaaacacgacggtgtacaattaaaaaatcaaaactttcttaaattaagaaagagaagtgttagtacatacacgattattatttttggataatatgagattggttagtattgaactttcaacggaaccattcatcatcacttcccaactacgttcataagttgtcatattagttagatgcataacttggtaggaacttgattgactcagattgtctccatatggtgattgtgaaagcaagacatccatcaatgttgcacgacaatctgctttacaatcaccaccatggttggcggacataaccacaaggatggcacaaaaggagccctcctggataatttggtctctatgttctacttcccttgctgataataacatgagatctccttttcttggcatgtccttcccctttggtacttctaacttgattttgtacttatttttccatttagaatctggcttcctttcatagcaatcaatatgtaggcctctggaaatagtatccatgcccgagttga

SEQ ID NO: 138 - DNA, 3405 bp, Zea mays
atagtctcgtgggctcggagatgtgtataagagacagcgtctccagagtccggaggtagatagccagccgcctgcgctagggttgggctgttggcctttccctccccactcgtgctcttctgaccctcttcctctctgggtcgcggtctccctcgtcttcatcgctgcctccgtctcgctgctctcctcgctcgaggtcctctccctgacgctattcctcgccgccggttagccgaatgcggcccctcgaactgacgcggttggtttgtttctgcgaaaaaaggtgagaaatcctcttgtgtcgtggccttggttgcatcgctctcgttctagatttggagaaggaaatccggctaacgggattcgagtcaaaaggtgagttgtcatcccgcgccttccccttgtctggaaacggtagtttcgtgtgacgatatggctggccgcgcgggcttgatggaggttagggtttcgttcgactcgcctgatgcatcgatgatcattcacgaggccatcctccacaccttatttttcggtttggtctatttttttttgcgatttgcagccctattattcttcctgacgtgttgtcggcccttcaatgtgatgtttcatatacaaactcaaggattagattcgaatgtgcacttttttctatggcggctattattaggttggagattctgtagttccttgcatcggagctgaacatttttgtggatgctagatttgcgtttgcttgttttgaaattgtggtctatgtttaactctgattgcttggtagattttttgggcttgcaacattttgcgcctattgttgtttagctgggctttatgaatggttagtggctttgcgtttgttctggttatatttttaattattcatatagatttctagaactaaggtttgttaggggataaaacagtagtaattttgtttgaattttgttgtggaacttgagataattttcaccctaccaaacaggcactatagatggacccttaactggagatgatcagtttaactagagatggaccctaccaaactagccaagttacttaacttgacatgagaagtttaattcgatgtcccaccctgtttggtaggcactataagctcttaaaatatgcataaggtgaataattcgataatcaacttcaccaaacaaccaattaataaaacaagatcatttatataaaaaataatttcacaaaacaacataaaaagttatagtattaacaaactgaatatcaaagtgtgcaaacaaaaaaatgatgcatttgttgcactactgttttgccctgtttcgattttttattcttttaatataattggaagttcttcttctagtcatttcacacaaaaaagaaaaatacatctggcttacctgatttttcgctataagtcatctaagagcaatgcaacatagaatgaaataatcaaaggtgcaatggcggagtagcacaaaacaactgttgcgatgagcatgtaaattggagccctggtgttatattgtagaacccctagagaccatgttgctttcacttcatccttcgtcttgcataaatacttttctttaagatagaaaatgatgggataaaacaatcaagagagctcaaagccaacaaagaatctatcaataacaacaatttaatagttagggtgtgaagttgttatcaaatgcaaaaattttaagaattatatttcgacagtaggtaacgataaagtgagacaacataattacttgaacgcaacaaatctggggaagaatgtttgtacttccagacagatatttgacaatcatattcacaatcttaatataatgattgagaatgtctgttaaagatttaaacaatgtgcttacaactgtcgaaaatagaaaacattaaaaatgatgaaatagaaatatttcacttatgtccttctaactgcttggctctgcgaagggatccactattgttttgagagaaacataaaaagtgtattaggcatgagagtaatataatgagtgcaatttgggggaaggtttgagtgtttgaccctaaaccatcttgatttctcgttgctccaccactactttaagaaagggtaccttctccatattttctaaagttgtaacaacagagatatcagcaagaaaaatcatataaaaacaaaaatgagaaacaatgaaaaagataataacataaaccatagattgtctgatttgcttctcatatagtttccttagattagaaggttgaactatattatttgacgtcgtttagtagcttccataattgtctattcatcagacttgagcatgaagattttgagatttatgacatacatcatatctactactgaagaagacaagaagggtactctactgttcagcctctaatttgggcaacaattccttagtataaccactacaatattcaattgtgtcaacctttttatcaataagcataagtaaattagtcctattaatatgctttgtgcccttgtattactttcaaatttcaagtttacatatatgactttaacgcgacaatgcggacaattttctccctatgacattcgatctcttggtatattttatcagcctacaatgcaatgtaatcagaatagaataaactttctatttcattttctgtagggttatttttggacatgtatccctctctataaataaagtgtagaattacctttgtgtggcatatcacaaccattgatctatagaaagtattttagtgaagcaataaaaatttatagtttcatttgaagacggtacaaggatatctctcaccaacattacaaaattatctagtttaatatctgatgtggattttgcagtagcccttaaatttaaaacatgtttgtaagattttgatattatgaaaataagtgacaaagtaaacccaatagactaacaacagaaatgccacaaccttatacttttttcatgggaatgtttgtacatacataaaaagtttagttgtgttgtgaacaattaaatatacatcatttgtgacattggaccactaatgataagcaaaattagagcatgaaaagtatgtatttattattttaaattgcaagtatgacaaaccgttaaacaaataattaagcacttgtaaaaactattataagattacttatagaaacattacccacccctagtctttttatttacgagaagttttaaattaattaattaagtagatgatagttaagacatcaccagttgcagcaacaatgagatgaatcggaagtagtacaatcctacagtatacaaagatcaacaacattggaatatcaagtacacaattttaaaaaacataataatttgttaatagttgaagaaaatcgttaaaaaaatctaccaaaccccaaccaccaaactaaattttaaatgtatttat

SEQ ID NO: 139 - DNA, 3405 bp, Zea mays
ttagactattatgtgacgggcctaaaacccagcacaagaggccaattagggttagactacgtaacataagttcactgcagtgctatatgcatctctctctcctttcattttgtcatttgaaacaaagaaccttgagtttttttcagccatactaccagagctcatgagaacaattttctttgcttgaagaataggccgtaacaaaattttaaactgaatgtgatagatttaaacttccaagaaagtttgaggtcagtgaaattgatgaaggtgatttttgtactaaccttcctcatcaaatataacttgattaataataatgttgtgcgaatcaatctcaaactttgctaactcttgcaccaatctctctgtttcatacaatgaaagaaattccgggatacaaacacatacaaaagttgtcaaatcctaggaagaaaataaaaatggaagttagaaggggataccataaacattaggtgcctaaagaatgtagatatgcaaagtaaagataacgaagattagaaattatcagataatccagcatgtttggtcagttcgtgtttacccagcggtgctcatgtacttaaattggacacgtgcagaggctatctgttgtgatgttaaaaactgctctgtaaagtaactatgcaaactgtaagttgagcatgtagtgtgagtcaagtctacaatctatacttttggttttaagcaagaaacacaatcaactcgaatcttaagaggactaatgcttttttagttccaagtttcactatcatgaatttcccatgtgtggtctcgctatatcctttaaccagtgacattttttaacgccgagtaccatagcatgatctgttactagtagattaaaacgcaattctgcttccatacaaggtagggagtcttactggatctttaaattgcctgttcacttgttcgatcacgtccttcataccctcaagtctcccaagcattgcatcctcgttcagctcatcgccaagaccaaacaatcgactggcctgccaaatgcattcattattatattagctatacatgtgagtttccatctgggtaggtccaatgtataatctgcacatgcaaaagttcaccatgtacatattaccatctgacctcatcacctcagtatgaacaaagatatgtcatcaagtcaatatttttctttgctttgctttttgtccaaggagaactcataatatgattgtatttgcaatactggaacatcagaactttctttgggataagcttggcgattcaggctctgttgagcatatcacaaaatatctctatcatttatttggttataatttagagaagatgcagcctagtaccctgaagtaattgcctaattgatatcaatagtgttttatttagagaagcaaataacatattagacacataccctagcaacttctccaaaaaatggttttccagtatattaaaatgtatataaaatacctgattcaacagaccaccaaatctatttttcaactccatcattttctcaagacccttctctaaagttgctgggaactgaagcaaccgcaatgtatgccctgtaggagcagtatcaaaaactacaacagagtaatccattgtttggactaatctgcagtgaggaaaatataatattcaaaaagttgctgaaagccaagaaatgcaaggaagtaccattttcaggataacaatggtaatcaaaatctaactctcttgacatattggagacattgaacaatgaacaagggaattagaaagggtagcgagtgaaatatgaaatagatggtaacaaaagtagctggccatattgggaagcatggcaaacaactgaacggagcaaaaccttactttagcatttcagcaaaactcatagcttcatctactcctggaatcgcatttgtcagttctgaaaggaatccctccattccttcattggctaaatcatcattttctaccttcgggtcaatttcctgcagataaagttacggaatgagattattcagccaaaataccagctgtaataacatgaaccgagccatttttcgaaaacaaataatcaaactaaggaaatagcagattactcttaaaaaatagaactcatagggcaacaaatgaaacatgttttgctatgtatatcatttgtgagaatacaaagaaatgactaaataggttcatatcagtaccatgcttgtcatggatgaaaatacaaagaaaaggaggcaaatgctgaatctcgtgcttagtcaatggtcatacatttttttaatatccaagtggaacatgttctaagtgaaattgcaatggaatgggtattctataaggcaaccacctaatatgttatcaacatcttcctagaataaagaaaaaaataccaataaagattgggtacttcttttgtacaggtctgctacctattcttaaacttccataatcgactcaagaaataatgcagaaatcacagacatatcattcacagagcataatcaccacttggtatggttcacgaagatgcaggccccatctctgagcaataatcctgtgaccaacatgccacaaagtacaaacacaaacccaaaccgaccccgaattgataactttgcatctcgtatagcctggccttaggtaagttcctatgacttccacacgtggaaaattatgggccacatgcgacttctctctctgcatactgcctgtctcctcagacaaccctgctaaccccctcacaaaaattcggtgaggctacaatccaatccaatcaccattcgccagaacacgcagcctgcccatccaatcctcacaagcaccacctcattgggtggggcaagtgaagacgacccggcgagaagtgtggattggagacgtaagaaagagaatataatggaggaattttgctttctgtgtgtgtgtgcgcgcgcgcgcgtttaccatggcgtagaggttggtgaatccgcggacgagggtgggaaacttggtgaaccgctgctggaaggcatcgctgaggttgtgcgcggggtcggtggagatgactagcacggactggcggacccccgcgaggaggacggaaaggatggagctgcaggtggtcttgcctacgccgcccttgccgccgacgaagacccacttgagggactcctggtctaggaggttccgcaccgtgggctccggcgcgtcgccggcgtccaccgccgccgcagacgccatgctccgatacccgcgcggtgatcggggtgggcgataggacttaggaggcaatgagatctggcggagtggaggctggagaggaagcgaacggcggtggtgcctcactggcggcagatgcggtactggaattgtctacgtggaaaatacctttcctcctttggacgttttcaactttagtacggttagtggtac

SEQ ID NO: 140 - DNA, 3399 bp, Zea mays
accggggcttgcctggaataaccactatgttagtgtttgttagacgacgtccacttgacgaccatcttttgtcttgacattcgtcagattatccatctttaggttcgtccgactgacgacgtcgtcttgcggagatgttcactctctgcattatcctagggtcgtgttctgcatcacgtgatcaacaaacgtacctaaatgatttgcataatgcacatgaatgcagataaacaagaatagtgctagactaaatattactacatgtaagcgaattaaaccagcgaggcattgtactacttcatacgatatacgactaagtgcaatagtcataaaataataaattatacgcacgtctattttccttagctaaggtccaacaccagaagactatcaaacctagatttatttattaggaacacaatagaccatatgagttccacctttttatatgactaaagcataatacaaaaagactaattacttagactcattatgttggaacacgaaattcgaagtatggaccgaaacaactcaactaactatttaaaccactcttttgaattaatccttaaaatatcctaactaataaaacatcacgctatacttaatttatcaagtagagcatcatcacaccactctctcgataagaaaatcgtcgatcatatcctactccaacattatcgatcacaaacatagatgatactaactactagcgcaggacatcgacttcatcttacgcgcactgaacacaattaccatcgacagatttatcgacaatcgtataaaatactgaatttaacctacgcgtcaccgaaatactacactcagcaaaatagaactagttcgaatatactcggcaactaaactcctcgaagcacacctcgcatcgctggcatctttaacttaaactttatacgcaaactaagcgtcttatttcacgatcataaaatcaatagtaaaaatagtaaatcggctcaccgttccaatagctgactcgaatccacgagatcggtaatgattctctgatttaggcaatttgtcgagcgcttggcagatactatccaaacttcacggaccgcaccatccaacctttggacatcttttcttggggcctcttttgtcatcacgactccaactcggaggcatcacgtagggaccgacatcgagacaggtgaccgaacgacgacgacaagacaaaggttagagatgactggatatcaatgacaagcactagagttttacgacgggctgttgtaatgggacgtcgatacacgatccatggcaattaggagatcgacgtcggcggaaccgatagccaaacaggaactgcgcagatcgacgacgcgagactcgatctggcgagcacgacacaagggatcgcagctgctgcttcgacatgaattacttgctgccgagcacgacgaaggtcggggagcaggaacgctgcgcagcgaaacccacagttgcacgtaggggtgaactcggctgtgcgtggcaattggagcaggcggccactggggcagcgcctaggtacgcacgatgagaatccgagcagggcaagtgtgcagcgaccatggaaaagatccgagctaggctgaatctgagctagagctcacaacatcagggagcagggctagccagggactggaagacgccatggcgagcagcagggagcttcgacggagagaggcgcgacaggaaggtggagcagggagacggacgagcaggagaggcgcgcgccttgggagatggctgtgcaagcgtgtcagggagaaatgtcggctgcgcgcagggcaaactcggcatgacaaccatggacgagatgggcgagtggaggaacgacgcgatggaggagcgcggcttgcgatggagagcagggctgaccggctgccattggagatcgacttggcgagcaccggcggctggagaaagtcgaggggaggtcgaggagctgagcggctgtgcagtggagcaagcagccatggaagagcagagagtcgactgggagggaggagatgggatggcgctgggatttccgggaccagggcgcggctgcaggaggaagatgtgagaacgagcgcctgttgccgtgtggagaggagagataatgctgaggaaaaaaatctgcagaagttaaggctgggagaggatgcgcacgtagaagaagatattctaccggttacccacttaagtggcgacggagacaaggaaaaaatgcatcgaatacgattgctggcaaagaaaatatcaatgacggccaacgatattctaggaagtttacgtacatgagaagaaaacaatgatagagagatattttctatagtgaaaaatccaaatacgttgaaaatcataccaaggaacggtggaaatatttagagaaggatttttcctatttttccttctttttttttaatacaaaaaaatacgcatattttagggtatgaaattagagtctaaaaaatatacaaaaggatcaaacaaaaatgagaccgacaacaatatttagataggatttgatttggtgaatactcacggaattagatgaattttcacccgttatttatatccgaagttttggatctggccgagaaacacaaggaccaaaacactatccggatacggtacttgagactctattaatttagttgaactcagataaaaatttctcttttttccgaatcgatttgatttctctacctagaatagcacactaatgaataatctcaattgtaatcttgtgcacggtttcttggtaacgcaagcgatccggagtattctttcggacccagcattatctgctataaaatcaaacgttaatctctttgtctcggataatatcgggttcggataggatgcaaatagaatgaacccaaacgagatcaagactgatattttaaactatatttgatacgacttgaaatcagataacttagtctgccactcgaactcctgatcactctgccatagatgatttattggagaatcaaatctcaattataattccttggttagcaatctcgcgcatgatttttctcatacaatgctcgattcagattattttgccccgaacattttagtcgtcgagttcaaattaatttgttcgggataaaatcatccgagtgggtcgagcttccaattcgtattcgcacgagcgatgagttttaaataatcactggacgcaccgattttcagaacaactatgttccgagcatcatgaaaatttaggaagagcccggttagataaaaacgatgtcgaactcgcgacagacgaaacagatgcgatattaaaatcgcgataggcaaagatgattaaaatttagcatccgttttatccattgatattacgtgcttaattccatactcgttgtcgagcgggatataaacaccaggggtgttaca

SEQ ID NO: 141 - DNA, 3399 bp, Zea mays
tttctatatttaattcttttgttataaatatcattgatatagttgtaatagattaaaagtagaattacataaatatagttgtcaactccagaaaattactgatctaaaaaatatacatgttgcactttaaacatttctaaagttacctcattcttcatatctacaaactctagtgccagcattggaacatccaatatcttgggccccaaactcatgctataggttgtcttgcacttgggttgatgatgaagcaattgaaacaacatgttgcatagctcacgcctatattaaattgaagatatgaaaaaatctacatgttgtgcttcaatcgcttttagagtcacatcatccttcatatgaccaaatctagtgctaacatgcgacaatctatggttgcatactcatgttatggttgtcttgaatatgggttaatgatggtttatgcgaaacaacacgttgggtccatccgtaaaaactgtctgtctaaacaatacaacatttagggcttcaaaatgcatcgaagttggcgcacatcagaaatcgatatatcatgcaacaaacttgtacgaatataatacccattagacccatactcatgttttgatcggtcttaaacttgggttgaagtgttcacaactaaggaacgttgcaaatagcacaatatatgttacaaggtaacatgcctaaacaagtatgtcttttagaaaagagtaatgaaagtggaaatataaatttttccattaatagatgtcgtaactttgcaaaatagtttatcttgaaaaatctgcatattgcaattcaaatacttttaaagttacctcattctttaaaacattgaactttaatcgacatgcgaccatctaattatgtgggtcccatactcaagttattgattgtgttgaattttagttgatggtggagcgtgtgaaacatgttagatcattctgtaaatctaccacataatttagggctttgaaaagcttcaaagttttcgcatggttcatgccacaattttttcgagaaaacatgcacaaaatcatgaccctttactcacaaatcagtgtattgcgaaaacttttatgacaaaccttgttgggtcctttttgtgaaaactaccgttctaaacattacatcatttagggctttgaaccgcttcaaacttacattaatgtccataaccatgaaacatttaaaaaatttccacatatctcatgagataacatgcccaaacaagtgatgtttacagtttgtcaataagcaaattgtaatgtaattttccttggttaaattgttttgtgataaatgtcatgagtcacataattgttttttgagtggcctcaaaacatgcattgttgtccataaccaagaatcatttaaaatagcactacatatggtttaagatagcatgcctaaactattgttgtttatagtctagcatagagcaaattgtaattaaaattggaatgaatttttttctatatttaattctttcgttataaatatcattgatataactgtaacagaataataacaaagaatcttaaaacatggattgaaataaaagcagaaatgcataaatatagctctcaactccagaaatatacatgttgcactttaaacatttctaaagttacctcattcttcatatctacaaactatagtggttgcattcgaacatacaatatcttgggccccaaactcatgctataggttgtcttgcacttaattaggttgatgatgaagcatgtgaaacaacatgttgcatagctcactcctatagtaaattgatgatttgaaaaaaatctacatgttgtgcttcaaacgcttttagattaacctcatcctttatatgaccaaatctactgctagcatgcgacaatctagggtcacatactcatgttatggttgtcttgaacattggttaatgatggtgcatgcgaaacaacacgttgggtccatctgtaaaaactatctgtctaaacaatacaacatttagggcttcaaaatgcttcgaagttgacgcacatcagaaatcgatatatcatgctgcaaacttgtacgaatataatacccattagtcccatacacatgggttgatgtgttcacaactgaggaacattgcaaatagcactatatatgtttttaaggtaacatgcttaaacaagtatgtcttatagtacgacatttagaaaagagtaatgaaagtataaatataaattttcttccattaactatttttccattaatagacaccgtaactctacaaaatagtttatcttgaaaaatctgcatattgcaattcaaatacttctaaagttacctcatcctttaaaacactaaaccttaatcggcatgcgaccatctaattatgtgggtcccatactgaagttattgagtgtgttgaattttagttgttggtggagcgtgtaagacaacatgttggatcattctgtaaatctaccaaataatttagggcttcaaaaagctacaaagttttcgtacggttcatgccacaatcttttcgaaaaaacatgcacaaaatcatgacactttactcccaatcagtgtattgcgaaaacattgatgacaaatcttgttgggtcatttttgtaaatactaccgttccaaacattacgtcattaagggctttgaactgctacgaacttacattaatgtccataacaatgaaacatttaaatctttccacatatcttatgagataacatgcctaaacaagttatgtttacagtttggcaataaaaaattgtaatgtaattttccttggttaaattgtattttgataaatatcatgagtcccatatttgttttttgagtggcctcaaaacatgcactattgttcataaccaagaatcattcaaaatagcactacaaatggtttaaaacagcatgcctaaactaatgttatttatagtctggcataaagcaaattgtaattaaaattggaatgaaatttttttctatatttaattcttttgttataaatatcattgatataattgtaatagaataataacaaagtatcttaaaacatggatcgaaataaaagaaaaattgcataaatatagctctcaactctggaaaattaccgatcttaaaaatatacatgttgcactttaaacatttctgaagttacctcattcttcatatcaaacaaactctagtgccagcattcgaacatccaatatcttgggcccaaactcatgctataggttgtcttgcacttgggttgatgatgaagcatgtgaaacaacatgttggatagctcacgtctatagtaaagtgatgatctgaataaaatctacatgttatgcttcaagcgcttctagagttacctcatccttcatatgaccctgtctcttatacacatctgacgctgcc

SEQ ID NO: 142 - DNA, 3387 bp, Zea mays
cttaccgatggccatgccatcatcttctacctacggctcggcgcacaggatcctccccgacactcccagatcgccgcaccgagcgccaacatagaagatgcaacggagtgcggaggggaaactcaccgtcgacggaagcagagttgaccgaccgtggcgcttggatcacggagacgctctaaactccgacgtccagtcccctcgccacgtggtcgctccagaccacggctcggccgagcgcgggtgaccgcgcagagatcccaggtgggagatggcaacccacgcgctggacaagcagcgccagacagccaaccgcaccgtcggcaccaccccacgccgtggacaagcagtgccagacgacccaagtccggcgagcttcacaccccgcgacactggttgtccacccttctattctctctcggctagcacaaaaaaaacgttcctggaagattgcaagctcccagcagcggatgagatagtgcagggagtcacgggggtttggttttaatactccggagctggttcagttggcatctggcagaaatttcggatctcaacaacctgctcctaatcgcaatgagcccgcccgcagaaaccgtatgcatagacggttaccagatttgatttgtacgtaacaaactatgcatggatacaattctagagaatagggtccacacatgatagtctccgtagagcacaacaaccgctgtgacctgttagcgctggagccacggatatcgtgatgaagcagccgatagaaagaataaagaaatgagaaaaagggttaaaaaaatttgtatgcacgctcatgcttgcatgtcgagtgaaatggtctgaccattttatggttagcccggtttaattctctcttttctcttttttttctattttaatttctttactaaaattaaattttaaattcgaactgcgttttgaagtttaaatctaagtcaagtgcacaattgaagtcccaacatgatgcacaatttatatatttagataattattatttaccttaattggacccacattgttgatatgcaaaaaaatatagtcacaaaatcatataatcaaggattctattttatttctaagattttgggtattacactctcgcgtggaacatggaagaggatgacctccttctccggcagcgtgactgggcccgacatgacgggctcgccccattcgaagtcggcgccgtggaactcgaggcgcgaccacgtggtgatgagcagcgtgcacgccagcgacgaccgggcccgcgtcgcctcaaagtagtccaccaccgaccgcatgtagtcgtcagtcaccatccgcacggcctcctgcatgagcccggctgcacgcaacacgggcgcggacagcagctcgccggccgtggccagggcgttggtcagcagtcagcacgatgccgttgccgaagtagccccgcgggagcggcggcacgaaccgacgccatccgtccacgcgaacaggcgaacagcagcttcgtgcgctgcccgggcgccagcccgagcgccttggtgcgcgcgccacacgagccccgacagtgcctcgaaggtggtgcagcggccgagggcgccgtcagcaagcgccagcccgcggacgcgctccagccggtccgggtggaagcagaaggagcggtactgtagcagctgtgccaaacaggcactatggcgggcgggcggcggcgtttgctgggggacggacggacgaaaggttgaaggcttcaccttttttttctttccacatcggtttcacgatgcttctagcagctatcccacgtgtcctgtcactgcgacggtcgatgctctatctgacgacacaaaaataaaaggaacgacgtggatactctaaatgggcagctttgcgtccgcgtttgttatatagaaatatttgcattgtgtttttccagctgaggcatataattgacctaaaaaggcacttcaagcaggcaggaaacccaaggcccttcccaaatacttccaaataagtagcctaatcgccatcgggtatacttattcagcatttttgttatcacatcctaatctgtggaaagctttatatgtggctgatgtgtactgaatatttgaatgttggctttaggtcggtacggtcattgagcctgcatctgagttctactcaagtaggctaaaaaatagggaacgcaaggcaatattggttggcgagctgttatcagattaatctctcaagagctacatgtatgctcatcatacttttgccgttttgcatgtacatcaatggacagtggcttgtttttcagtgcaagatttcctataaaatttgtatatggtcttttgcaagattttctggtgccttgtttcaaagtccaaccagcataataattacacggctctggtgtgtacatctaaaatgggtttcacgggttacaactaaggtgagttaattaactcttgtttccataatcaaaaaaaaactgatagttaattagtacttttttatatatccagatagatatcagtccaacagttttcttcaagatgcaattagcacttataacaacattgattttttatctctactactattataatcctaacgtaggcgtccacttctccagcaagtgcacgttttgccgcatccagcgcgtccaacccgtatccaacgcccctgccgcatcccgcgtccctcccgcacgcgtccctgccgcagcccccgtgatccccttcccaagcatggcgtccctgccgcagtcctcgcagccccgcgatcccgcctgccaagcatggcgtcgccgcggccgttgcccccgcgatccccttccatcgatcccctgccaagcatggcatcgccccggccattgccacgcccgccgcacacgccgcgatgagatcctggaccccccacgacatcctcctccaccgcgccatggccgcccccgacgtcctcgcgcgccgcttcccgaggtgggcatggtgcgcacgaccatcgcgggggtcacgacggcggcgcggttccaggagctggtggactggatggaggagtggaaggcggcgttcagggacgacagcaagtggacggagacggtgaacctggggctcgggagcctcgcgctcatcatgtctgggctgcttccgttcgccatcgactgggacctcgggttcgggaagcccagcctcgtgctaccctaggtgcgcgatggccggctgggatccacgtccgtgatggtggtgccctgccccagcagcgacaggtcgtgtttcttcggcggcaccaggatgtggctgcggctcatggaggtggtcgaatccgaccctttgatgaagccgacagtgaacctgggaatggcgacagcggcgggatcccgtttgtgactgtgagctcgcgctggcggtacctgcc

SEQ ID NO: 143 - DNA, 3385 bp, Zea mays
aaatgcatcggggcttgcctggataacactaagttagtgttgttagacgttgatcacttcacgaccatcgtttgtcttggcacttgttcggattatccgtcttcaggtaaatccatcagcatcatcttgtggaaaagctcacgcttgacattatcttgtggtcgactcagctctggttctccgcatcacgtggttaatcaacgtacctaaatgaaatgcatgatgcacatgattgacaatgagcaggaatagcacaatactaaatatttttataccaaagaggattaacacttatggtcaggcatcacaaactagaatacataaatactagatactgatataagactaagtataacattcgagcttcttctatttatctgatgctagctcaaacatcacagaacaataatctataaacatacaagaagtacaacactcacgcccttcctacttaaccaaatttaactcatacaacaggcaacaacacactaagtataagttttatactttccctaagctataacctataccaaataattaacaaaacttaggctcacgtttccaagataattaaactcaagactatagataggaatcatttatagctttctaacccactacgctaattagctcatacaatacactagacaaataacagtatcacgtatgactagattgaccacatcagctatgaagaaccaatttaattacacgttgtacaagttatatcttgaatctaagttttaccacctgacattactacatcattagcatgactacaagtatatcactgcctataatgaggtatttcgacaaacattcaatatcacgacaaggcacatgctattgtcaagagaaacgacgtaactgataggactacccaattcatccaactatgacacttgatcggccactagcagaaaatgtgacgactgctaaaacaatctatcgatgtcgtcacacatatacagtgagtctactatagacacatgaatacaatcgtagcacataaataggatcacatcaaatctaatagaccgatattcaaccagaatactttgttatccaacaatctatcttcttttcaaccgcacatgtcaacacataattgcaagcgatttaggcatttcatcatcacatatacccaccaattaagctaattaacctgaaatacgaaattactcaccatcacaaaatcaggctcgatattcacaaaacgacaacaatctctggtttgagccttttgtcgaacgcttagtgagcaacgcattggacttcgctttctccttcatctatagctccaccttcttccacaaaaaaaatctgaactggacgacgacgtgactagggacataggaaattgcggccacggcatgggcaagatgacgacgaactctagttcaaacagttagcggagtcagcaacgagcactaaggagacaacgacgatattgctgaagaagatgatagtggtcgctgaagttgaagaccgatggacacgacgagaccgcagttgcaggcgaacctttgacgacattttaaaatatggcgagccagcaagctccatagcgagctgagaacagcgcccgatgacctggtggaacaagattttatcgtgaccagagggaaacaaggatggcgtggccaatcggcgagatccaaataccgcgcgatgggcatcagggacaagcgcgcgacagcgactatggtcgactagcctaacgatatagggccaagcgaggtcgacggcgttgggggtctacgacaaggcaaggtcgagcacacagggcaaccagctatggatctagagcaggccgagcgcggcatcgggggcgagcagggcgcgatggagatgcccgagaaggaggaatcctagcgccgtcaagagcaggcgcgccatggggaggaagcggctacgcgcacaggaagcaggctcacgcgcaggggagcttgacgacaaccatggaggggctcggtagggagaaacagagcagagtctaggcaagcgcaaaaaggagctcgcggggaagggaagccgcgagggagagagagaggcagggcgcggcagaggagctagggacgcgcggaagagaactcgacgttggcaatccggggcgagcacagcagggagccgggacgagaccgcagccgagcgagctccagccagcatgtgcgtgacagccagggagctggtgggcgcgcaggaaggcagaagcttgcgggggagaacgcaggggatgggcgtgccatgggagctccgcgagctggagtcctggagagggaagccgcggcgcgtagggagaacgctgagctcgcgcggccagggaaatgcgcgtggactgcgaagacggctcggtctgagaagaggctagctaggcgcgcggagcgagcagggagctgggcgcagggaggagcgcgctggcgagcacacggcgaccatgggagacaggtctgagacaggggcgcggcagagagcaccgcggcgagaaggctcggatggcgtccggcggctgggccatggagaagagagagaggcaaagaaaagcaggggacgccgcgacactgggacagggcagagcgccggccaagggataacaacggcgcgcggcagaggaaagatcaaggcggcgggatttttcttcagagctgagcggcgtaggggataagccccacgacagagaaaaaaattcagggggaaagagagagagagcggctgggagattttttctttttttcttttttttaacggagaatcgtagatattttggatcacgatttttggcgataatcaatgggtcaaataattaggatcgacaacaacaattggacaggatttgatttggcgaatactctgaagtcagatgaattcgtaccgtcaaatcactttttgaagatttagatcgaggcgagaagcaacagaccgaattaaatggatttcggcttcgataatttactctgcgtgattcgactaaaattagctgaaaccatatctgctaatgtatacgcgttttcgtcgccagaacagtgtgctgaagaatgaatgggatcataacctcgcgcacgatttctctcagaaaatacgcgattcagattattttgccccgaacattttagtcgtcgagttcaacttaatctggtcgggatataaatcatccaagtgggtcaagcttccgaattcgtattcgcgtgagcgatgaattttaaataatcaccggacgcaccgattttcggaacaattatgttccgaacatcacgaaaatttaggaagatcccagataaataaaaacgttgtcaaactcgcgacaaacgaaccagattaagacagagagactgttattcactgctatcacgttttaaagtccgcactcgtggtcgagcagacgata

SEQ ID NO: 144 - DNA, 3383 bp, Zea mays
gaacctagggtcgggacctagagagatgtgattagtctgacctagagagatgcgatttctttcaatggcatcatccggtttttcctcaatatatcacgaatttgttgggggacttgcgagacatagtggatgaactgacgaaggagattgatgcattacaaaataaggaacaagaacttaaggactctttggaaggtatgatgcagctattgaatttggagtgaaggtgtagtcgtgttcatgcagccttagcagtaagcccttattttgttttctgcctatttctcttttgtagccatgtcagttatttatactttgttctttttatgctgagaagggcttggggtgctagtgaccaatgtgctggtggttacctccattgtggcaactacgcacaagtagtagcacggaggaagtaaccatcagcatattgggcacacctccaccatccgccgtgacgctctcctggccaaaaggttggtcattgctgcaaggaggactagtcggctcagatgacaggctgcctcagctgctaccaagtcaggctacttagagtttgtagggtgatgtcatttggacctcgacgagatccaccactcgattatattgtactggatgctcacttatttatgttccaaattcagttattctatgatgaacgctcagttgttttatgtgccactcagttattttattctgaatagttattctaatatgtgcaactcagttattgtaatatgtgcaagttatttatgtgccactcagttattctaatggacgcactcagttagtctggtgtcagaactcagttattccattctaatacctcagttattcttgtgggccgactcatttattttcttctcgtgactcagttattctactccaatccctcaattattccgttataataactcagttattgtaacgtacccactcggttattctctgttcacaagtcaattattccgttccagtaactcagttattctagtgtggcgactcagttattcttgtgtcagtactcagttattctggtgacggaactcagttattacgttctactacctcagttattctaatgtgcacactcagttattctctactcattactcagttattccattctaataactcagttattctggtgtcagtactaagttattctggtgacggaactcggttattacgttctactacctcagttattctaatgtgcacactcagttattctgttctaataactcagttattctactaattacttagttattccgttctaatacctcagttattctactgttccgactcagttattctggagtcagcactcagttattctagtgggcgcacttagttattccatgttcatttctcagttattctcggttcagtactcggttattctgtgttcatcactcagttattctggtgacgaaactcagctattctctgctcgtgcctcagttcttgtgggccaactcagttattctactccaatccctcagttattccgttataatacctcagttattctaaaccctcagttattatgttataataccgcagttattccatgttcctaactcagttattctaatgtcggtactcagttattctaatgcgcgccctcagttattccatgttcaacactcagttattctttgtacgttactcaggtattgtgcgttcattactcagttattctagacgacgcactcagttattcgagtgacagaactcagttattctactccaatccctcagttatcctgtgtcatacctcagttattgtaatgtgcctactcagttattatatgttcatgactcagttattccgttccaacaactcagttcttctaatggacgcactcagttattctggtgccagaactcagtaattccgttccaatacctcagttattcttgtgggctaactcagtgattatggtgtgcagactcagttattctggtgttggcactcaattgttcggttctgatccctcagttattctcagttcgttactcagttattgtgcgttcattactcagttattctaatcgacgcactcagttattcgtgtgacattactcagttattctactcgaatccctcagttatcctgtatcatacctcagttattgtaatgtgcccactcagttatgcggtgtttattactcagttattctctattcacagtcagttattgcgttcaagtaactcagttatgctattgttcattactcagttattctgttgtgcacactcagttattccatgttcactactcagttattatctcttcattactcagttattccgttccaacaactcagttcttctaatggacgcactcagttattatggtgacagaactcagttattccgttccaataccttagttattcttgtgggctaactcagttattctcctccgatgcctcagttatcatcatacctcagttattggaatgtgcccactcagttattattgtgtacagactcagttattctggtgtcggcactcagttgttcggttctgatccctcagttattatgttataatacctcagttattgagatgtgccgactcagttattccatgttcgtcactcagttattcttttgtcagaactcagttattctaatgggcgcacatagttattctggtgtgatgactcagttattctcgtgtgcctactcacttattctctgctcattactcagttattctctttgtaatcactcggtagtggggactccgttattctctattcacagtcagttattgcgttctattaactcagttattccatgttcgccactcagttatttcattccaacaactcagttattctaatggacgtactcaattattctggactaatacctcagttattcttgtgggccaactcagttattctactccgatcccttagttattccgttctaatacctcagttattctctgctcatgactcagttattctagtgggcgcactcagttattccatgttcatgtctcagttattctggagtcggtactcagtaattctagtgggcgcacttagttattccatgttcatttctcagttattctcggttcagtactcggttattctgtgttcatcacctagttattctagtgatggaactcagttattctctgctcatgcctcagttcttgtgggccaactcagttctactccaatccctcagttatttcgttataataccttagttattccatgttcttaactcagttattctaaaccctcagttattatgttataataccgcagttattccatgttcctaactcagttattctaatgtcggtactcagttattctaatgcgcgccctcagttattccatgttca

SEQ ID NO: 145 - DNA, 3430 bp, Zea mays
tattatcatggctgattgtaaaaatatgcaagctaaacacataaaggaatcataagaaacaacactgaaaaagttccttgaacctatatatcatggtgatcgatgacaaaatttattaatggataatctgaacacacaaaagtgaataattattgattccactactcggctgcaaatagcccagcatatcaaaaactcatctgtcacgacactgagaagattttgacttgctaacgccatccatttggtctttcagggcatccatacttttgcccaaagtgtttagttgtttgtggatgacataaacgtctaccttggagggagacatgtcatgccacgacgatgctggcggggacgacgatggtgtccttgatggcgcacgtgttgggggcatcggtggtggctggaatggcgcatgtcgtggcggtgtcgcttcatcttgttcgtgaaacaatctctcaagtagatacaaattcttaggtggttcatttatcatatgcttgaaatcattgccacatttctaaaaatgaaacaaacgtataattagaatatatataatctggattcaatcaaagagagacagagaatacccttgtttttttaatatgcatcttgcggcttttcgtctcccccatgtttgaagagtggatacgatgcagaacatggtcatcatacaactgtttcatacggttccatctgtttatgagtgttttatttgaaattgttattgttgtcaccttataaagtttttccgacaaatattccagagctgtatcatccaaggtggattgcctctgctttatgatgctgctgtcaagcaagtcgacgcagcccctgcagaacacagtgtctatatcaggataccagcggaacctaccctcatattggggcatattttccatctacaagaaataatgaaagaaatcacaaaaaaacatatacatatacatataagctagcacatttactggtaagagaggggtacgtacgtaagaaaactcacatcaaactgtgggtcacgactgaggtgtgactgtctggaagcaaacttaagcgcaatgataataagctataacaacagggattctttttagatctatcgcgctgaaggccatgggaagtatattaatagaagcccccggtggcaatatgcatggcacacgtacgccactccgcttcctctccctaatttgttccgttcttatccaagcgaacaacaacgatcgatcgagtcttgcgatcgcttgcacgggggaagcgcgcgtcgctggcgactggcgagtgcgtcgactgcatgcatgctccatctatgtgcatgcaagggaagtatattaatagaagcccccgatggcaatatgcatggaacacgtacgccactctgctttttgtccctaatttgttcggttcttatccaagcgaacaacaacgatccatcgagtcttgagatcgctcacgggggaagtgcgcgtcggtggcggccgtcgactgcgtcgactgcatgcatgctccatctgtgtgcatgcagtcgctggttgtttttatttaagtgagtttgtttagcgctgatgttgcaaggaggccacctagctagtgcgtgtgtgcacgtcggtgcgtggccaggtcgtaagccggcgcgccaagtctcctgcatgcatgcgtgctgcagcacaatgccggcggctctgttggtcgcgttgctcgtaccgccatgatgacgggttcggcgcatctgctgcgcgccgctcgagcaccgcatcgagggtcttgtcattgggaccgatggatttcgggctggcaaacgggaccgacccctcctctctctctctcgatgccattgtgcgctgtgcatatgccgacctgggcctgacgcggtgagaatacacatgctgcatttccctaattcaaaatttggatactaactgcgggaatagtccaagatgtagcaacataaacattctgctaattcaaaaacagacagagttgtgtattctttcttctttgtaaactgtagcaaggataattagacatagttcgtggaattatggttgttgtatattaagttaggatctctatttgtatggagtttgtggagtatgtagtctaatttttttgttgttgatgcttctgagaataaacactacgttagtgtctcttagacgacgtccacttgacgaccatcttttgtcttgacattcgtcagattatccatcgtcaggttcgtccaactaacaacgtcgtcttgcggagatgttcactctctacattatcctggggtcgtcttccgcatcacgtgatcaacaaacatatctaaatgatttgcataatgcacatgaatgcagataaacaagaatagtgcgagataaaatattactacatgtccgcgaattaaacacctagcagcgaggcgttgtactacttcatacgatatacgactaagagcaatagtcataaaataataaattatacgcacgtctattttccttagctaaggtccaacaccagaagactatcgaacctagatttatttattaggaaaacaatataccatatgagttccacctttttatttgactaaagcataatacagaaagactaattacttagactcattattttggaacacgaaattcgaagtatggaccgaaacaactcaactaactatttaaaccactcttttgaattaatccttaaaatatcctaactaataaaacatcacactatacttaatttatcaagtagagcatcatcacaccactctctagataagaaaatcgtcgatcatatcctactccaacattatcgatcacaaacatagatgatactaactgctagcacaggacatcgacttcatcttacgcgcactgaacacaattaccatcgacagagttatcgacaatcgtataaaatactgaatttaacctacgcgtcaccgaaatactacactctacaaaatataactagttcgaatatactcggcaactaaactcctcgaagcacacctcgcatcgctggcatctttaacttaaactttatacacaaactaagtgtcttatttcatgatcataaaatcaatagtaaaaatagtaaatcggctcaccgttccaatagctgactcgaatccgcgagatcggtaatgattctccgatttagaaaatttttcgagcgcttggcagatactatccgaacttcacgcaccccaccatccaacctttggacatcttctcttggggcttcttttgtcagcacgactccaacgtactcggaggcatcacgtagggaccaatatcgagacggggtgaccgaacgacgacgacaagacaaagattggagacgaccgaatatcaacgacaagcactagagttttacgacggactgttgtaatgggacgtcgatacacgatccatggcaattaggagatcgacataggcgg

SEQ ID NO: 146 - DNA, 3372 bp, Zea mays
agcttattgaagtgcttttgttttattatttactgtaaatattgttattctcatgatacaatgattagatggcaaaacatgtacgggattaactcttttcatatgttttacaatttgggcattacagttgttctctcggatctcgcgtttgttggcgcaaacagatcctcggtatttttcggccagaatgatctttttcgttacggatagggcttctgaactgggcgagaggaaaagaatctcagttctttgttcactgattcgagtttgatattataatacatgcctagctattagtttttccaaatcactatctatgcttccttccccgtttgcactttgctgtgaatgtgattgggtgacttatcaaaccacacactgtcgtcgattccaatatttgggctgagagtgggttccagttagatgtaccaaatgtgcattcgctggaacacggtctctcatctatgggagtaataaatctaggctatcggtaaagctgcagattgtcaaatcgtgcaggctcttacgtttgcacactgaattgtgcttctgtttgttgtcctaagttcgttagttctcacgtgctaattagtacatccgctctcatccttgccttttgtgttttcgtttgatttatttattttatttctttctcggtttattgctattattctactagattcggatatgattagatgttggaatgattagcatcccctcacagtttaattcatgtccgatgtctcaagccctcaattccctgttgcttcgactgcgccctctagactgcacaaaccagatctaacccactagaaatgaacgaataacgcacataaatcttaaattattgtttagtcatattagaaataaataagttgaaattctttaattttagatcctcaattttgaattttggtctagactcctaaaaatcctagaaatgcaccctgcttctatctttagcccccctttggaactcaagattgacaaaatgcacgaatagaaaaaaatgtagaaatatagttcatgatacttgcaatcctacaagatttaaaagtgcaggaaagcttctaatacagtgtttgtatgcaacacaggacaaacacaggaattagaggggagggatagatacagaggaaagattttcaagaggttggatcttatgttagaaatcttccaaaatcttactataatatgctatcccataagaattttatagaatttggaggagctcaatcctttgtttcaaagtaccatataggaaatttttttattggattctaatcctccaaaattcctccacttttggttgctcattcatctaggggcagaacattaatattaggtctacgatgttaattaatatgttactaactcatatcttatggtcacaaacactgctatcacatttttgtatgatcttattttctgtccactactataaacataaaaagttataaagatagttttaatatcgcgcgcagtgcgcacgtcatttagtagtagccaacaccgcgcagcctcatcccgcaccgtctgcagcccccagatgaacacacgccctcgctcctcgctcatcccgtcaaacgcggcaatggcccgtgtcgctcgcgttgcctaacagcatccagtagtagttatgtaaacatgttcctaaatcttagtttaagaagttattagaaaaaaaactcatctccagtggcattgtaaatgttgttgctaaatttataaagttgctatatttttcttcctcgttgctacatgtggcaagcccgtaagagcaactccaatagttatgtaaattttagatctctaaatcacagatttaagaagttgctaaatgacttttagagtaaaaaaatgtaagttctccaatagttctctaaatataggttgtaattttgttttgtatttatccacataaaaaataagtcacaacaactatataatacagtcaacatttttatttagggagttgttaaatggttgccaaatgtaaagagaaaataaggttagatgacaagttgttaaatttagaaagttcatttagagaactattggagaatagttttcatgttaactacctaaattattgatttaggaagtattttagagaactactggagttgttctaaggactcaccaaagcttattccatgcgaaatgaagcctactttcttttctatttcgatttattgcccacactttcaacggtgggcatcatatgctacttttatattatttagtttcatagagtacacttatatatgaataatctgtggaattttagttgcatgttatgctcccatatactgtttccaattcagtttcatgtgtatttgcggctaaaattcagatagaattgtatgtgttttaagttcacatagaactcttgaattctaggtatgtgcattctgatcgtggccgtcctgctacacaatctgatcgtggctgaaataattcatggggcactgatttcttttatgaaacagatgtggactaccaactattacttggtaacaattaaactaccacatgcagcgagtagtactacctaaatatctgatgaaggagcaaaactaataagccaagaccttgcatgatttgatctacatgcttgcctggatcaagacaaactaggtccatttaaaaaaggcactttcaaataagttgagttgacattattttaaaaaaattagcaattaaaaataaagaactattgaagaacatagaattttttatatctctattattatttagcaactccctacgtagtcttttagggaactttttattttagggaactttttttttacaaaactaatgaacatgctctaaccccgccaacaaacccggacgagtacgatcgatgacctggttgttggttgccatgtcgaagagagaaccggaaggaggtgctagagtcgttgcagacttgatctggaggacatgctgtctcccatctcccgtcatggccaagaggcccaagactgtcatgggccatgctcgtagcggtctctgcttgctacaacgttgctaagatccgccgctgcacaggggagctcggatagctcacacccaccgaccagctgctcaccagtcgccacctctcttcgaggcgtcgttcatggccgtcatgggtatttatgtgcctccttatttgctaaggaacaggcgagcgccttcatgggcgaccgattcaactcacaaagcttcttccgatcaatgcaataaacacacatggatgggaacccgtacagtctctagctagttggccggattgaccaccaccacctccggcaggtcggtctcgaatgccctcacgaggttccccaagaacttgcgggtaactccggtgaggttggtcacctt

SEQ ID NO: 147 - DNA, 3372 bp, Zea mays
tataacacccctggtgtttatattccgctcgacaacgagtatagaattaagcatgtaatatcagtggataaaacggatgctaaattttaatcatcttcgcctatcgcgattttaaaatcgcatctgtttcgtctgtcgcgagttcgacatcgtttttatctatccgggctcttcctaaattttcgtgatgttcggaacatagttgttccgaaaatcggtgtgtctggtgattatttaaaactcatcgctcgcgcgaatacgaattggaagctcgacccactcgaatgattttatcctgaacaaattaatttgaactcgatgactaaaatgttcggggcaaaataatctaaaccgcgcattatctgaggaaaatcatgcgcgagattgctaaccaaggaattataattgagatttgattctccaataaatcatcattggcagagtgatcagttgtttgagtggcagacgaagttatctgatttcaagtcgtatcaaatatagtttaaaatattagtctcgatctcgtttgggttcattctatttgcatcctatccgaacccgatattatccgagacaaagagattaatgtttgattttatagcagataatactgggtctgaaagaatactccggatcgcttgcgttaccaagaaaccgtgcacaagattaacaattgggattattcattagtgtgttattctaggtagagaaatcaaatcgattcggaaaacagataaatttttatctgagttcaactaaattaatagagtctcaagtatcgtatccggatagtgttttggtccttgtgtttctcggccagatcctaaactttggatataaataacgggcaaaaattcatctaattccgagagtattcaccaaatcaaattatatctaaatattgttgtcggtctcatttttgtttgatccttttgtatatttttagactctaatttcataccctaaaatatgcgtattttgttgttttaaaaaaaagaaggaaaaatagggaaaatccttctctaaatatttccaccgttccttggtatggttttcaacgtatttggatttttcactatagaaaatatctctctatcgttgttttcttctcatgtacgtaaacttcctagaatatcattggccgtcatcgatattttctttgccagcaatcgtattcgatgcatttttttccttgtgtcgccgcttaagtgggtaaccggtagaatatcttcatctacgtgcgcattctctcccagccttatcttcttctgcagatttttttcctcagcattatctctcctctccacacggtagcgggcgctcgttctcacatcttcctcctgcaaccgcgccctggtcccgaacatcccagcgccgtcccatctcctccctcccaatcgactctctgctcttccatggctgcttgctccactgcacagccgctcagctcctcgacctcccctcgactttctccagccgctggtgcttgccaagtcgatctcccatgtcagccggtcagccctactctgcatcgcaagcctcgctcctccatcgcgtcgttcctccgctcgcccatctcgtccatggctgtcgtgccgagttcgccctgcgcgcatccggtgtttctccctgacgcgctcgcacagccatctcccatggcgcgcgcctcccctgcgcgtccgtctccctgctccaccttcctgtcgcgcctctctccgtcgatgctccctgctgctcgccatggcgtcttctagactctggctcgccctgctccgtgttgccgtgagctccagctcggatcttttccatggtcgctgcgcactggccctgctcggattgtcgtcgtgcgtacctgggcgctgccccagtggctgcctgctccaatcgccgcgcccagccgagttcaccctgcgcgcaatcgtgggttttgctacacagcgttcctgctccccggcctccgtcgtgctcgccagcaagtaattcatgtcgaagcagctgctgcgatcccttgtgtcgtgctcgctatatcgagtctcgcgtcatcgatctgcgctgttcctgtttggctatcggttccgcctacgtcgatctcctaattgccatggatcgtgtatcgacgtcccattacaacagcccatcataaaactctagtgcttgtcgttgatatccggtcgtctccaacctttgtcttgccgtcgtcgttcagtcacccatctcgatgtcggtccctacgtgatgcctccgagttggagttgtgctgacaaaagaagccccaagagaagatgtccaaaggttggatgtgcagtgcgtgaagttcggatagtatctgccaagcgctcgacaaattggctaaatcaaagaatcattaccgatcttgcggattcgagtcagctattggaacggtgagccgatttactatttttactatttattttatgatcgtgaaataagacgcttagtttgcgtataaagtttaagtgaaagatgccagcgatgcgaggtgtgcttcgaggagtttagttgctgagtatattcgaactagttctattttgcagagtgtagtatttcggtgacgcataggttaaattcagtattttatacgattgtcgataaatctgtcgatggtaattgtgttcagtgcgcgtaagatgaagtcgatatcctgcgctagtagttagtatcatctatgtttgtgatcgataatgttggagtaggatatgatcgacgattttcttatctagagagtagtgtgctgatgctctacttgataaatttagtatagtgtgatgttttattagttaggatattttaaggattaattcaaaagagtggtttaaatagttagttgagttgtttcggtccatacttcaaatttcgtgttccaaaataatgagtctaagtaattagtctttcggtattatgctttagtcaaataaaaaggtggaactcatatggtctattgttttcctaataaataaatctaggtttgatagtcttctggcgttggaccttagctaagggaaatagacgtgcgtataatttattattttatgactattgcgcttagtcgtatatcgtatgaagtagtacaacgcctcgctgctaggtgtttaattcgcggacatgtagtaatatttgatctcgcactattcttgtttatctgcattgatgtgcattatgcaaatcatttaggtacgtttgttgatcacgtgatgcggaagacggccccaggataatgcagagagtgaacatctccgcaagacgacgtcgttagtcagacgaacctgaagatggataatctgacgaatatcaagacaaaagatggtcgtcaagcagacgtcgtctaacaaacaataacgtagtgtttattcc

SEQ ID NO: 148 - DNA, 3368 bp, Zea mays
ttcatcattaatcagccattgaaggtacattacgaagagatatcataataccctaaacatgtgtaggagtgtaataaacatcaacactaatatgaatactataagctcatgtttgacaggatcacacgtgtgatacacctatattgaacaccaaaatccacaagcaagcaacataacaagtctccttagccatcacaggagccattgcatgcaaatctacctctacacatgaatgagaaactacttcttagtcttccaagcaagcaataatagaatcaccaaaacacgataggtagaaagagagtgacaattagaggaaccactaccccaagtaacattacaatatgtctaaaatcttttaagtgctggaatgagggaaaaacaggcaccaaacgacatgagatagtctcactaagataatgtaagaaatattacaccaacacatgaaaatattgcataaaatatctgtagatttttctatgcaagaatatattttatttgagaccaaaataaattttttgagttaaaatgattttgttactgattttatttcattatcgaacatccaagtttaaatttcaaataaccatatattggagtgtatcacatgtttatttcaataaaatagaggggttttgatgcaaaactagcattgttagcgttggatgacttaggcgctaaccaatatcggtgtgttttagccaacagatcacacgtgtgcgtcttagattaaaagaatgattgtgcgggtgatgcttagatagcagcctccttccacatgatagccatcagatctctctctctcttaatttattatcaagtgttttctgacttgattaattcacccaccatgcttcttcattcacttctttagaacttgaggaagaatgagcagtgtacaatatatcgaagtgcatgttttgatgtttacttgcatgcaggctcttggtccattgtgcggtactgtacataatttctagagtaaaatgcttacttgtgtacattgtaagtttgtttcccatttgaattgctaaaaggctctatctccttgtagttagaacgttttatggtgatctattctttttcttcaatgaggaggggaagcacattgccacgttgaggtcccttcatcttagaagggcaatgccaaatccaagccaatttgcaatccttgttcatgaaataccaaagagagctaaagaatcatacagtgatgttgttggaaaattctccacaaagtatcactcgtctagttatgtcttgcatcaaattgtctacaaagttgggaatggccacaagataatggtatctagtactcaatgcatgcatttctcttttactattatatattctaagcgaagtataaataagacttcttcatcttatgaatagctaggttttctcataattttttttgtctttttgacatgaacaagtgaacaaatgtccagttcctttagtgttgcatggtttttctttccttatgtgtatttgtaattcacctcttggtttttgtgttactctaatctttaacttatctgacagactggcacagagaaggcatataaaaagttcaaacatttcatagctgaaatcgatagtcagggatgtaggacgacaaccaccaacaactgttgtttcacgggaccaccccctccaaattcttctaagttcaactcggaatgcgagtagaacaaggggaacactgacaatgacgaatccaccaaaaacttagattacgaggttaaaaagcttgcatgcatgcatttgttaattgcttaatttagcagtaataatatggatagtaatttctatgtggaattacatgcagcaggaatgcgcaactgcttttgtatttttcaaaactcgctatgatgcagttactgcctcaaatatggtgcagacatctaacccactgaaatgggttactagtctggctccagaaccagaagacgtgtattggtccaatctttggcaatccaacaggtgtcgtaaatcaacactagttccaggctgtattatttttgcactcttacttttgatgccgatggtgtgtatacaatcactatctgacccagagcagctgcaacagttgatgcctgcttccttaaaagaaaggttggagaagtaagtactgaaacttcagttgggctatctcgatagatgtgtgatcttatatcgctacaaatatatatactatccatttgacctgtctccatattgcacctattgaatatatattactcggcctatttgcaggaaaaactacatgactaacctaataacgggataccttcctaatgtgatccaacaaattattctatatattgttgggacattgatgatgaaagtttctaaattggaaggtgccacatctcacagtgcaaggaagatgagtgcttgctttaaactgttgtgcttcatagtttggaacatattctttgttaatgtactatccggtacattcatgagtcaattgaatttgttattaagcccaaaggacattcctgtcaagcttgctagagctttaactagacaggtttaacacaccttcccttttctttatggaaagataatatattggttttgtgtatttaattttcatctaccatttctgtttcttttctgtgattttattttttattgcaggctaccttcttcatcacctatgttatgacctcgggataggctagtttatcatccgaacttttgcagttctataatctgataatgagctttataaggaaatatattttgagaaagggagaatatagagaagatacagaatctgttcccacattcccctatcagcaggaagtgccaaaagttctattgtttggactattgggcttcacatgctctgtggtggctcctatgattttacctttcctgctagtatacttttaccttggtcgtgttgtataccgcaatcaagtgagaacctagatactatattttattttcttacttaccctgaaatttgtccattcatgctaatgtaccatgtgttctttttcagtttctcaatgtttatcgaacaaggtctgatacaggaggattgtattggccaattgcacacaacacaatcatattctctctcatgctcacccagatcatccgtgctggtgtatttgacactaaggaatagtgggtagttgtatgcttgaccatacctcttatcatctctactctttcatttcacctttataatagaaagagtcttccgttattcaagattattccaacacatgtaatattagttccttaataaaatgtgaatgttcgaacatagaataataattgatggctagagtttgtcttgagagtgagtagctctcttctcttttggcatttattgttgccttgtg

SEQ ID NO: 149 - DNA, 3359 bp, Zea mays
tataattatcattgatataactataatagaataataacaaagtatcttaaaacatggatcaaaataaaagcagaattgcataaatatagctctcaactccggaaaattaccgatctaaaaaatttacatgttgcactttaaacatttctaaagataactcattcttcatatctataaactctagtgccagcattcgaacatctaatatcttgggcccaaactcatgctataggttgtcttgcaattgggttgatgatgaagcttgtgaaacaacatgttggatagctcacgtctatagtaaagtgatgatctgaaaaaaaatctacatgttatgctttaagcgcttctagagtcacctcatccttcatatgaccaaatctagtgcaagtgtgctgcaatctagggtcgcatactcatgttatggttgtcttgaacattggttaatgatggtgcatgcgaaacaataagttgggtccatccgtaaaaactatatgtctaaacaatacaacatttagggcttcaaaatgcatcgaagttgatgcacaccagaaatcgatatatcatgtagtaaacttatatgaaattaatactcattagtcccatactcatgttttgattggccttaaacttgggttgatgtgttcacaactgagaaacattgcaaatatcactatatgtgtttaaggtaacatgcctaaacaagtagtcttacagtacgacatttagaaaagagttatgaaagtggaaatataatttttcttccattaattatttttccattaatagaggtcgtaactctgcaaaatagtttatcttgaaaaatctgcatatagcaattcaaatacttttaaagttatctcactctttaaaacactgaactttaatcggcatgcgaccatctaattatgtgggtcccattagttattcattttgttgaattttagttgactgtggagcgtgtgaaacaacatgttggatcgttctgtaaatttaccatataatttagggcttcgaaaagcttcaaagtttttgcatggttcatgccacaatcttttcgagaaaacatgcacgaaatcatgaccctttgctcctaaatcagtgtactatgaaaactttgatgacaaaccttgtttggtcctttttgtaaaaactaccgttctaaacattacatcatttagggatttgaaccgcttcaaacttacattaatgtccataaccatgaaacatttgaaaatttcccacatatcttatgagataacatgcttaaacaagtgatgtttacagtttggcaatgagcaaattgtaatgtaatttttcctaggttaaattgttttgtgataaatattatgtgtccaatacttgttttttgagtggactcaaaacatgcattgttgtccataaccaagaatcatttaaaatagcactacatacggtttaagatagcatgcctaaactagtattgtttatagtctcgcatagagaaaattgtaattaaaattggaatgaaattttctctatatttaattcttttgttgtaaatatcattgatataactgcaatagattaataacaaagaatcttaaaacatggatcgaaagaaaagcaaaattgcataaatatagctctcaacttcgagaagttaccaatctaaaaaatatacatgttgcactttaaacatttctaaagttacctcattcttcatatctacaaactctagtgccagcattcgaacatctaatatcttaggccccaaactcatgctataggttgtattgcacttaggatgatgatgaagcatgtgaaacaacatggtggatagctcatgcatatagtaaattgactacacgaaaaaaatatacatgttagatttcaagcgcttatagagtcacctcatccttcatatgaccaaatctagtgctagcatgcgacaatctagggtcgcatactcattatggttgtcttgaacatgggttaatgatggtgcatgcgaaacaagttgggtctatccgtaaaaattgtctgtctaaacaatacaaaatgcatcgaagttgacacacatcagaaattgatatatcatggagcaaactagtacaaaattaatacccattagtcccatactcatgttttgatcggccttaaacttgggttgatgtgttcgcaactgaggaacattgcacatagaactatatatgttttaaggtaacaggcctaaagaagtatgtcttacagtacgacatttagaaaagagtaataaaagtgcaaatataaattttcttccattaactattttccattaatagaggtcgcaactctgcaaaatagtttatcttgaaaaatctgcacattgcaattcaaatacttttaaagttatatcattatttaaaacactaaactttaatcggcatgcgaccatctaactatgtgggtcccacaatcacgtgtttgattgttttcaatattagttgatggtggagcgtgtgaaacaacatgttggatcattctataaatctaccacataatttagggcttcgaaaagcttcaatgttttcgcatgattcatgccacaatcttttcgagaaaacatgcacgaaatcatgaccctttactcccaaatcagtgtattgcgaaaactttgatgacaaaccttgttgggtgctttttgtaaaaactaccattctaaacattacatcatttagggctttgaaccgcttcaaacgtacattaatgtttataaccgtgaaacatttgaaatctttccacatatctgatgagataacatgcccaaacaagtgatgtttacagtttggcaatgtgcaaattgtaatgtaattttccttggttaaattgttttgtgataaatatcatgagtcccatacttgttttttgagtggcctcaaaacatgcaatattgtccataaccaacaatcatttaaaatagcactacatgtattctaacataacatgcctaaactagtaatgtttatagtctggcataaagcaaattgtacttacaattggaatggaattttttctatatttaattcttctattaaaaatatcattggtataactgtaatagaataataacaaagtatcttaaaacatggatcaaaataaaaccagaattgcataaatatagctctcaacttcggaaaattatagatctaaaaaataaacatgttggactttaaacatttctaaagttacctcattcttcatatctacaaactctagtgcctgcattcgaacatccaatatcttgggccccaaactcatgctataggttgtcttgcacttgggttgatgatgaagcatgtgaaacaacatgttgggtaactcaggcctatagtaaattgatg

SEQ ID NO: 150 - DNA, 3358 bp, Zea mays
  misc_feature (723)..(723): n is a, c, g, or t
ggggaaggttataatccaatatgcgttcactgccctaggatcaaagatcaatggcccgaaatcatccacacaacagattttgcacgggccctccgtttgatgatctacgacccagacctttcctagccgaaagggtatgcgagatctaatctgtgccgttcaccttgccctaggatctaatctgtgtcgttcaccttctactacctcagttattctaatgtgcacactcagttattctctactcataactcagttattccattctaataactcagttattctggtgtcagtactcagttattccggtgacggaactcagttattacgttctactacctcagttattctaatgtgcacactcaattattctgttctaataactaagttattctactaattactcagttattccgttctaatactcagttattctacttttccgactcagttattctggagtcagcactcagttattctagtgggcgcacttagttattccatgttcatttctcagttattctcggttcagtactcggttattctgtgttcatcactcagttattctggtgacgaaactcagctattctctgctcgtgcctcagttcttgtgggccaacttagttattctactccaatccctcagttattccgttataatacctcagttattctagaccctcagttattatgttataataccacagttattccatgttcctaacntcagttattctaatgtcggtactcagttattctaatgcgcgccttgagttattccatgttcatcactcagttattcgagtgacagaacacagtgattctactacaatccctcagttatcccgtgtcatacctcagttactgtaatgtgcctactcagttattatatgttcatgactcagttattccgttccaacaactcagttcttctaatggacgcactcagttattctggtgccagaactcagtaattccgttccaatacctcagttattcttgtgggctaactcagtgattatggtgtgcagactcagttattctggtgtcggcactcagttgttcggttctgatccctcagttattctactccaatccctcagttatcctgtatcatacctcagttattgtaatgtgcccactcagttatgcggtgtttattactcagttattctctattcacattcagttattgcgttcaagtaactcagttatgctattgttcattactcagtaattctgttgtgcacactcagttattctattgttcactactcagttattatctgttcattactcagttattctgttccaacaactcagttcttctaatgcacacactcagttattatggtgacagaactcagctattccgttccaataccttagttattcttgtgggctaactcagttattctcctccgatgcctcagttatcatcatacctcagttattggaatgtgcccactcagttattattgtgtgcagactcagttattctggtgtcggcactcagttgttcggttctgatccctcagttattatgttataatacctcagttattgagatgtgccgactcagttattcttttgtcagaactcagttattctaatgggcgcacatagttattctggtgtgatgaatcagttattctcgtgtgcctactcacttattctctgctcattactcagttattctctttgtaatcacttagtagtggggactccgttattctctattcacaatcagttattgcgttctattaactcagttattccatgttcgccactcagttatttactcagttgttgtgttttcattactcagttatttcattccaacaactcagttattctaatggacgtactcagttatttctttcagtagctcagttattctattgtgtggactcagttattctggtgtcagcactccattctaatacctcagttattctctgctcatgactcagttattctagtggacgcacttagttattccacgttcatttctcagttattctcggttcagtactcggttattctgtgttcatcactcagttattctctgctcatgcctcagttcttgtgggccaactcagttctactccaatccctcagttattccgttataatacctcagttattccatgttcctaactcagttattctaaaccctcagttattatgttataatactgcagttattccatgttcctaactcagttattctaatgtcgatactcagttattctaatgcgcgccctcagttattctatgttcaacactcagttattctctgtacattactcagttattctctgtacgttactcggttattgtgcgttcattactcagttattctagacgacgcactcagttattcaagtgacagaactcagttattctactccaatccctcagttatcctgtgtcatacctcagttattgtaatgtgcctactcagttattatatgttcatgactcagttattccgttccaacaactcagttcttctaatggacgcactcagttattctggtgccagaactcaataattctgttccaatacctcagttattcttgtgggctaactcagttattatggtgtgtagactcagttattctggtgtcggcacttagttgtttggttctgatccctcagttattctatgttcgttactcagttattgtgcgttcattactcagttattctaatcgacgcactcagttattctactccaatccctcagttatcctgtatcatacctcagttattgtaatgtgcccactcagttatgttcctaactcagttattctaatgtcggtacccagttattctaatgcgcgccttgagttattccatgttcatcactcagttattcgagtgacagaactcagttattctactccaatccctcagttatcccgtgtcatacctcagttattgtaatgtgcctactcagttattatatgttcacgactcagttattccgttccaacaactcagttcttctaatggacgcactcagttattctggtgccagaactcagtagttccgttccaatacctcagttattcttgtgggctaactcagtgattatggtgtgcagactcagttattctggtgttgccactcagttgttcggttctgatccctcagttattctccgttcgttactcagttattgtgcgttcattactcagttattctaatcgatgcactcagttattcgggtgacattactcagttattctactcgaatccctcagttatcctatatcatacctcagttattgtaatgtgcccactcaattatgcggtgtttattactcaattattctctattcacagtcagt

SEQ ID NO: 151 - DNA, 3356 bp, Zea mays
gacctagtttttggtgaattttgactttagcttggctcattatgagcatccgcaggagttacgcacgagttaggcaggagttatgtaaacaactttataaatatagatttaaatttaagaagtttataagaaaactcttctccaacagttatgtaaaacagatttctaaatttacaaactcctgaccaaatctaatttgatccctacatttatcatcttgttgggactcttgaaataaatgtttttgctaagatattgcgataagcatactctgactacggtttcgccgtctctttatctgccaccgctagataacctcttgtgccaaggtgtcgctagagcacctcctgtgctgcctccatgccgtagttgcgagggcgtccgtggatagtgtgtgctgttgttgcaatcatctggtccatcgacaactccgacctcccaaaacgttaaggaaggttattggtataaatttatgccatcaactcgatttaaaatagaaagtatgtcttttttttacattgacaacttaaaaaattaccaaccaatgttggagcataaacattttttactcaagtgttatagtaactttctctataatttagaatgctaaatttacataacttggattgctttatgtttgtcttgaagtttgatcttcaacagcccagggatataccaaatttaaagaaagctccataaatggtgcagttggcccgttaagtcagttattatgcacccctactgatgatagaatttggcaaaggtcattgttgttagttgtaactgctcaacattaaacctaaattaaagcaagtattatttacaccaggaagttttggccatatccccacaaaaactcacagaagaaattaaaattctctatatacagaagaacaacaaaagctgaatcactagtactttcctctgtttcaaacttttcagtgtatgccaagagcctggaatctcctcactagagcaagattggtcgcgttcctcctctgccagtcctccgtgctctccttcctctgctccagcttgtccagcacgtcttcgttgccgtccagaatgctcgcgatcttcctcatgctcggccgcgccgccgggtctgaccgggtgcacgccatgccgagccgagccagccgcacgagctccctacggtcaaacttgccgtccagccgccggtccgccagggcctccaccggccggtcctgctgctcaaggagctggaccttcctaacgaggaggacctccggcagcctcccgtccacggccattgtgccggtcaccacctccagcaccaccacgccgaagctgtagacgtcggccatggtggtcgcctcgcccgtgtccatgtactccggcgacatgtagccgaagatgccccgggccgagctggcggtgaccaccacgtggtgcccgccgccgtggcgctcgttcctcgacaggaactcggcgagcgcgaagctcccgagccgcgggttcatgtcggggtccaggaacaccgccgacgacgtgatgctgcggtggatcacctgctcgtcccactcctcgtggaggtacaggacggccgacgccagcgccctgacgatgctgtaccgctgccgccacgggaggaccgcgccgcagtcgcgccgccggagcaggtggtggctcaggaggctccccggggagtagtcgtagacgacgagcatctcgccgtggtccgtgcaccacccgcgcagctgcacgaggttcctgtgccggagcttggccacgttgcatagctccctggcgaaccggacgcgcagcgccgggcacgtcttcatgccgaggcgcttcacgaggacgtggacgcggccgtggccggtgtccaggaagccctcgtaccctgtcccgaagtccagctccgcgaccacctgcgactcggagaagtcgttggtgatggcgacgatctccttgtagggtatctcgcgcggcgtgtccacgtgcgggatcgccacgggcgctagccgagacgacgaccgccggccggagtcagcggacgcggacctggaaccggtcgtcctcccgtcttccgcggtgtggtagatggtgtccgcggccgcggtgtcgtagacggggttggaattggttagagacgtcgccgccgtgctcctgtcggtggtgacggtcgtggcgccggagtcggaggccgacgacgaggtgagagagatgtacttggggagcgccacgaacgacggcagacgcgggaggtcgccagcagagcagccgtcggagaggttctctaccacccacctcatggtcggacgcgccctggggtcgtgcagcgagcagaggagaccgaggtgcatgagccgcgcgacgtcgaacagcgcagaggcgccgtccggcagcttcgcgtccgcggcgttgagcagcttgccctcgtccgacagccgccgcacccagtcgagcatgaagatctggtcgtcggggtacgccaggtcgacggcgcgccgccccgtggccacctccaggagcacgatgccgaagctgaagacgtcggacttggcggtgccgccggcggcccggcgatggaagctctcaggcggcaggtacccgatggtcccgccgatgcggctggtgtccatgagccggaattggtagttggccgagaccgcggccgaggcagatgacgacgacaggcgcagggacggtggcgacgcctccgggtgcagcgggttcagggcgtcgtcggcgcccaccgcgtgctcgagccagcgggcgaggccgaagtcgccgagccgtgcgttgtactcggagtcgagcatgacgttgctggtcttgacgtcgcggtggatgatctgcgtgtccagctgctcgtgaaggtagaagagcgcggcggcgagcccggcgacgatgcggcggcggcggtcccagctgagccgcggagccgaggccggggccgcggccttgggcggcgcgaagagcaggcggtcgaggctgcggttgggcatgtagtcgtagactagcatgagctcctccccggcgcgcacgcaccagccgcggaggcgcaccaggttgcgatgccgcagcctggccacggccgcgagctcggccaggaacgacttgtcgctgcgggcgcccgcgctgctggctgcgacgcacttgacggccaccgtggtgccgtcgctgggcagaacggcgcggtacacccggccgaatcccccgctgccgagtacctccgcgtcgctgaacccgcgcgtcccgatgtagagctccgagtagctgaatatcctgggcccgccgcccgcgagctgcttcctgccggcgacgtcgtcgaccacgccggcgatgtcctcgaacgccgccgccttttccgaagagtcgtcgtgcca

SEQ ID NO: 152 - DNA, 3241 bp, Zea mays
atcctcaatagtacataataacatgcaatgcaagttgatacaaaagccaaaccaaaagatatagtaaatagactaaaataaaaactagtatataaggtcaaaagcttccctctaaaaaatgaagctaacacccaacactctacacaagcaagcaactcttcactagtgtgaagtcatatcttgtaatatatgtgaaatatattcttttttgcttcaccccgttccttgtactacttagccatagtcccttaagattgcaaggtgatggccttgttcataccatggtcccaaacataatggccctagatcatgaggtttttgttaggtttgatgacctttgtaagggaagtagattctctccatgttttaagcggcttatggacctaagagccaagagttaaggcggagtaggttttggagcccttggttctataggggccctgaaggggtcctctctcttggtcccaaagttgttgtgggagggggaaacagggcgacaaccatagttgtattcaggacccttggcaccacaagggtcctagatgtgatgtgtcatagtcctcttaagattcatttatcttgagatctagggaccttgataacacaaggggcccggttaggacttgtatgacacctagggtaacaaaatccctaaggccctaggggagaagctcaccatgccttctagaatgatttgagttattcttgcctacaatcttagaaaaaatgataaagtttagcttgttgggggcatccttacactatatttagctatgtattctcaattttttcctaaatcctttttggcccccctaattgatgtcttaggaatgagttgtgaaccaacatgtcctaactaattaagtggtagcatagtggaagggtagataggtcaagaagagcgacccaccatggaatagcggacctacaccatggtttagcttttgccagggtattgtgtttatgcatctttgcccatccatttagcattagagcatgctcccatacaccaaatcaacttgacttaccaaacagttcaccgactttattgaatagaaggtcaattgtgttttagtgtaaggattggacccctaaagaatgattgaaaaactttaaggatagtttttattaaataaatattgcttaaaccgtgagtgagtacttatggatatgccaccccttgcttgtggggctagagtgttaaccccacaagggccccaaagaaggagctccttaaagttaggattcttagggcagatgaaaaatcattcattcgccaatccttggagaaggcgataaaatattacctaattaggggacttatttacatcatacttagcaaattcctatatttaactcctaaaacctttttgaggccctagtttatgcttcaagagggtggcatgataatcaatagaccctgactaagcggtggcacagagaaaggatggtctaggatagaaagggtgacccaccatggcagagcaaatctatactagggctttgttgtttctaggtaatgcctattggcatatttgttggaccacacaatatatatctatcatacatcactacatcctagtttgccaagggtcgcaccgactctattaaataggaggctagaaggaaccacatatgagtgtaaaatatagttaggaaccctgaaggggtataaccaaaaaaagttggaaggtattttctataataattatgtgtataatagtcctgaccatagggaagcttcctagtaggacatgctcatgttcctgcaataactcaatgagtgtaaatttttccgtgtcaggggccacacatataccatactcaacctatttccttaagacaactcttgaaattgccttagtgcctagaagacaatatagggaaattgtgtaatctactaggcatgtctcgtaccaagggacaatgcaaatgagaggatggctaggcttagagagtggcaacccaccatggaagagttgattcataccatgacttagccgttcttagggctacacctctaggcctcatggtgaaagttttgaaaacacatccattgcatccgacaatggactatctgatgcatctcatagaggaccatccactgcatctcacagaggaccatccaccacatctcatagtggacacatcaccaagtcacatggtgaagtattagagtttttagttcattttcaagatcttgtctattttactgtgaccagtgtgaggatggttcatatgcaaaaacatataaaacagaaaaagtacagagtaatcaaaaaaagaaaaaacatggatggacattatttttaaagtgtgtaaaatatatccgggggacgtggcgtcactgttgtaatgacattcagcacgctcactcaaaactttcaatgacacacttagtgacacttactcaacacattcagtgctcacgaacgacaaagtgttggtacaactgtatttatagagaagacacccaaccaggaagcggtactgaatacttaacatttagtattagttctataaaagaattagtgcttatctaattctggtgggaatcctatttggggtggcgagaaatgaagatacctttcagtatcggttcttaccaaaaacttgtactagagttgtctctactttttgagccaactgttggttttttagtaatggttagtgtttccaacaggtactaaattagttaatattagcaccggttgtggacaacaaccggtactaatatattttgcatggatcttcaaatttaaaatcgacactgaagctaatacaaataacgattttaaatcaacctaaacaaaagttgttggattgatgccccattctctagtaatgttaaaatgatactaaaaactcaacacatagcctactataaaatagcaaactaaactctaaagtagatgtctcttgtaattttgaatcttgtttgtttagtttatattgatattatatagtcaatttaaattgcctctaaatattatattttctaacaaggatggactcccacggggataatttccctgacaaggacggagatgggagaaaaagctcccacgtgactgttcgtgggataagggcggtgaattttctcctagcggggatggtgatggtgagccattttccaatggggaattctccattgcaatacctatttatgatccaacacactactgcaacatgtagatgctctggactatctcacatttactcgcacatatatcacttaagc

SEQ ID NO: 153 - DNA, 3341 bp, Zea mays
  misc_feature (619)..(620): n is a, c, g, or t
cgattaaaactcttcttagtcaaaattaaatagaaaataatttaatactcctcgatctccaacccaacacagccattggtagccaggatcaactctaacgcacacatccacgaaacccgcgcacatctcaacgaagagaagcgttttttttattcctgtttaatgcaatgtaataacaagtcttatgtacagttgcaggctacaggcctactcccactgaaaagaatcgccaccgaaccatcacgactctgccaccgccagcgccacagccaccacgttctgcccggcatccagttcttctgacaccgcgttctggtcgatgaagttgaacagcgcgagccccgcggcccacacgtcgttgtccatcaccgactcctccggcgagtggctgatgccgccgcggcaccgcacgaacagcatcccgatctgcgaccacacaatccggagcgtgagcgagctgagcttcactattcagcacactagtcaccgccaacctcacattcgttcgcacgcatgcttcgtcttcttaccttggtgagcctggccatcgccatcgcgtcgtgccctgcgccgctcatcagcacgggcgtctcgccggccgccacggtgcgccccggcnnagctgagacgttaactccgggtcgcagtgcgtcgctgccgccgagtgctggtgcaagcgacatcaaggtcagactcagttcggcagcacaaactctacaccggcagatatcatgagccatgacaccaagagtgctgattcggtgctcctcctcaccttatgctcgaccttgcaatcgaccagtctgtcatcgcatttctggagaacaagcctcgagaagctcgtcacgatcgtctccctcacttggtcgtccatcgcgcggatgtccaccgtgaagtttacctgtcgtgggcacagctccaaggttcagctgactgatctgagccaccagttcatcagcagggccaagaagagtagtgcttggcaagcttacctggcccggaatcacgttgctcgcgcttggccacgtgttcagctcgccgacggtgcacaccaggccggccagggactcctcagtgaagcagctgcactcctcgtcgtaggtcagcaaactgttgggctctttacagaggcgttccagagtcacaacgagctctgcagctgcaaccatcggatcacggcgcaatttcattggaactgtgccagcatgcccttgcgaaccatctactattacctaggcaaacaaaaacaaagactaagcgctgtaactactttccttctcactcgaaagcttggtatacaaagggacttggaagcaacccagaattattaatgacagttgtcgtgggcagcttgagtatttaaatgtcaatgttaaactgaacaatcttggtgacagcaatgcctgtcttcctgaacattaattaactaagacttgttcttgcatcaaagatgacacatgacataggtgtgccaattattgaatgagatggatgttgactaataccccaggtgtttctctgattgattgtttatccattacatgcacatacttggttaacttaatattgaccactcataccctttgctaagagaacactcctatctagaattatttgattgcttacctgttgactgctatactgtcaccttatggttatctaatataaccggtacttcttttttctcagacacatatagtaggctctgatattgattgttttataaggaaagaatgaccttacggtaggaagccatgcagctagaccatattttagttttgtaaatgtagttcttgaatagatttcacaagaatagcagagaactccgatgcaccttcaatcgtgtctgtcctgcaattccttttacaacaccaagtggataatgaagggcttccaggacagggccttgctccatgtgtacctacagtttttaaaaatatatatatgtgatgtattctgtattaccaggcaactacatgaaaaaaggcatacgaaggcttcatacctcaacataactccccacagactccgggttgtacctggcttgactaatagcagtagaggtagcctcaaaagaattcattttcagaacatcttgtagtgtagtgccactgatgaaactcaatacaacaaatgaactgcatcagagacagttctgtaaaatagttcggttggttcacgcgaaaaagacaacacctcttatctgatacttgtaaaattgattcaggtagtgtaccagctacagcagcgcttcccagaaaagttgtctggaatctgatgccctcctcatcgctgaatgcaatgacctaagcttcaaaaaggaaaaatgagtgctaggctccgccatgatgatttttccaggtgacgataatgcaatctaactaatgctgattcataatttgataaaaaaaataatcttcaagccactttggattagagcgttgaagccatacagtgaagaataaaccatgatttggttcacaccaaaacatgccgaccttgatctatagatgatatctagacatttgtttactgaaatgcatgacacaacctgacaacttgtgcattttgattatcaggattgccagaataacaaaagatgaaccgtgcacagaatcttttcaagatctgtaggaggtacgtcgaactgattaaaggggcattataaaactagattcctccaggtttctatagtctttcctgattatattatgatagtaataaagaacctactaggtaccttgcagcttagctatccaatcagcatcaaaagtacaatatataattaaaactgagtaaaatataataactctatgcctgctactggcaataaaacaatgtgaaatattccaatcaaacaaataaaagagtagatggacacaaacaagatcaatgcagacaagtgcgggtctacaagacgtatgtggctcataacgccacttgtagagagcgagaatagtataaggccattcacaagttgcggtggagcaaagaaacacatttaacatatgatactatagtaacatctttagtatactggaagcagtagagaattctctaacctccactggtctcgttaacctctggagtttccccgtaactttcaaaaccttcagtgctgagattgctgaaataatacccaaggctccatcgtacatcccagcatcaacgacagtgtcctgttttttgaacaaggaaaatcgtatcagttgtcgcaatattggatcgccatcaaaacactgaaataaccggatagaggaagatagactcaccatatgagatccaatcaacaaggcatctctggtagaatttgccggctcatatcgaccatgaatattccc

SEQ ID NO: 154 - DNA, 3335 bp, Zea mays
tcaatcaaagttccgagaatcaaagttccaaagccaggcatgagctcatctctagagaacacacctgctgtgaattgccactcaggcctcatatccccaaccattacccctactcacacctattgtatctagataaagctgtacttgtttgactacgtcaggaattctgagttacactccgcaacatttatcatgatcagacttttttcatatttcctacttgagcttgttgccttttggaatgcttctgtatgttgatatgcgcccgagtttgagcatctgctggatgcggtcggcatgcatgctgttcgttttgttctgcgtattgctctttgttcaactcctatttcctacataactagcacactcctatttcctacatattttccccttatttatacatgttgcctccaggtatatgtttttcggttcctccagttatgtacatgttgcctcctctggtagatgtttcctcggagttccctacatgtttcctcaattcctcctgtataatgtttgccctttttttgtatatgttgcctcctggtgcatgtttcatccatgcttcctccgctttattcatgttgcctccattataatacctcagttattataatatgcccactccgttattctctgttcattactcagttattccgttccaataactcagttattctatgttcattactcagttattctggtgacggaacttagttattccggtctaatacctcagttattctaatgtgcacactcagttattctctactcattactcagttattccgttctaataactcagttattctaatggacgcactcagttattctggtctaataccttagttattcctgtggacgcactcagttattctctggtttcttcccttcgcgtcctctcccgccgccgccgccgttgaccagatgggtcgcgtcatacgcgcccagcgtaaggaagccggctccgttttcaagtctcaggaggactggtcgtctcagcgaacaggctgcctcagccgcagcaaagtccgacaaggccacttagacaacttttgcggttgtttcaattacattagttgatagtcttctttgtgataaaacagttaaagctaaatatcaaaatcatatcaaagaagctgtagatttctgaaattttgattaattttctttttagcaacatctgcaggcactctgtttccaaatatgccgagcatgacaaggagctgcaaacccggtgcagcccacaactgaaaatccaacaagttcttggcctgctctgagaaggttctcccaagtccatcttcaaaagcttcagcagatgaacaatatgtcaaaatgtacgaagtgctgaaaatagtatctgaaaagtttcctctgagacagaaaaataaaggtggtgctagtcaacagaccaatgaagtacctgctggacaacagaccaatgaaggtggtgctggtcaacggaacgatgaagtacctgctagtgttaagagaacctatttcaccgtgactaacattgtaaagttggctcaacattcggataacgaggagatctccatgcacatggacacagatatgctcgtcagacattttttcagtgtggtcttaaataacctgctactgccacaaaagtctatttttatgtaacctcacctgaacttcaagctgtatatgacctagaaaagttgaaaaaggttgactggtcatatgtgatatttcattcattaaagaaagctcttgcactgactttaagaagaatccggggcatatgaatggatgtgtccttatgtttctagtaagtaccaggataatgcagagcatatccataattccttaaagtaattgtttttctcatgttgggtaggaaagtgactaagtgaagaatcgttggttcacaggttgttttcatggactgtattcaaaggaacagcttggacacaatgttgcagaattaacctgtatacggaggcaatggtcgataaccttttgagtgcaaaaccaattaagaaaatcagtaagaggacaaaaagggtacgaaaaggaacctttaagacattttgactgcatctgattgttgcaatgcaacttcttatttctttatgtccctttcagctggctgcggaggaaaaggaaagggcagcagaggcacagaagaaagtgatgttgctggaggatgttgatgtaagtactattctattattgttctatgaggtgatgcggaagtgtagtccaaagaaactgactgcacccccttgatgtcctttttagttgattagctgggaagatagctgcttcagacaatttgcagtgctgcatgagaagtcttcttgtaagaggtaaaactagaataattgttaattttttaacctctattgcaaatttacctaacctctgtttcaacttttttagcatcttgacataaatgatgcagatagcatatacaagaagcatattttagaaagatcccacaacagaattgttttagactttccttcctgtgaagtacgggaatctacttttattaattgtttgcaaccatgtggtcatatgcattcccttgtatttcatttggtatgcgaactatggtcagtggggtggcatgataaaattattcttagtgaaggtgctgtggtaagtacttttacctatgattgtcatctcaaacttagttattgttattctttaactatggttgttgtatctttgattgttattccagaatgatttgttgaataaagacataataactgctaaaagtctgaacagggagcttactccaaataaagtgaggtatgtgaatcaggtttgtgctctttgtatttcaatgttactgggaaagctctgtatttctcaatgctctgtatgtctaattgttttttccccagatttttgttcctatagtttataatcatcattggtcgctagttgttgtttctactgtgcaaagaaagatatatgtccgactcttgtcgaggcatatataaagaggtgccaattacgttgcttgaaaaactgcagacgtttttgcaacgtaatcacatggacatatctggttatgatacagaaacactgatggttcagcagcaaaataacacgtaattgaacgtacaccaccttagtcttgtagcctcctccgtcttgtcatcttgctttataagaaaaaaaattgactgaactactgctaggtttttctttagcgtttaccatgctatctcctattttcaaccttgctgcttcctgtttccaccatctttgatctctctttctgcgaattcttgcagctattactgtggttttcatgtattgttgttgtcatgtacgggcgcaagtat

SEQ ID NO: 155 - DNA, 3333 bp, Zea mays
agttgggtccatccgtaaaaactgtttgtctaaacaatacaatatttagggcttcaaaatgcatcgaagttgatgcacatcagaaatcgatatatcatgcagcaaacttgtacgaaattaatacccattagtcccatactcatattttgattgtccttaaacttgagttgatgttttcacaactgagaaatattgcaaatagcactattaacatgcctaaacaactatgtcttacactacaacatttagaaaaaagtaatgaaagtggaaatggaaattttcttccattaactatttttccattaatagaggtcgtaactctgcaaaatagtttatcttgaaaatctgcatattgcaattcaaatacttttaaagttacctcattctttaaaacactggactttaatcagcatgcgaccatctaattatttggtttccatactcaagttattgattgtgttgaattttagttgatggtggagcgtgtgaaacaacatgatggatcattctgtaaatctaccacataatttagggcttcaaaaagcttcaaagtttttgcattgttcatgccacaatcttttcgagaaaacatgcacgaaatcatgaccctatactcacaaatcagtgtattcgaaaaatttgatgacaaaccttgttgggtcctttttgtaaaaactaccgttctaaacattacatcatttagggcttttaaccactttaaacatacattaatgtccataaccatgaaacattctaacattttccacatatcttatgagataacatgctcaaacaagtgatgtttacggtttggcaatgagcaaattgtaatgtaattttccttggttaatttattttgtgacaaatatcaagactcacatacttgttttttgagtggcctcaaatcatgcattgttgtccataaccaggaatcatataaaaaagcactacatatgatgattcttgtgaaacaacatgttgcatagctcacgcctatagtaaattgatgatccgaaaaaatctacatgttgtgcttcaagcgcttttagagtcacctcatccttcatatgaccaaatctagtgctagcatgtgacaatctagggtcgcatactcatgatatggttttcttgaacatgggtcaatgatggtgcatgcgaaacaacacattgggtccatccataaaaaatgtctgtctaaacaatacaacatttagggcttcaaaaagcattgaagttggcgcacattagaaatcgatatatcatgcagtaaacttgtacgaatataatatccattagtcccgtactcatgttttgatcggccttaaacatgggttgatgtgttcacaactaagaaacattgcaaatagcacaatatatgttttaaggtaacatgcctaaacaagtatgtcttttagaaaagacaaatgaaagtggaaatataaattttcttctattaactaattttccattaatagaggtcgtaactctgcaaaatagtttatcttgaaaaatatgcatattgaaattcaaatacttctaaagttacctcattctttaaaacactgaactttaatcagcatgcgaccatctaatttgtgggtcccatactcaagttattgattgtgttgaattttagttgatggtggagtgtgtgaaacatgttggatcattttgtaaatcgaccccataatttagggctttgaaaagcttcaaagttttcgcatggttcatgccacaatcttttcttgaaaacatgcaaaaaatcacgacgctttactcacaaatcagtgtattgcgaaaacattcataacaaaccatgttgggtccttttgtaaaaacaacagttctaaacattacatcatttagggctttgaaccgcttcaaacttacattaatgtccataaccatgaaacatttaaaagttttccacataccttatgagataacatgcccaaacaagtgatgtttacattttggcaataagcaaattgtaatgtaattttccttggttaaattgttttgtgaaaaatatcatgagtcacataattttttttagtggcctcaacacatgcattgttgtccataaccaagaatcatctaaaatagcagtacatatagtttaagatagcatgcctaaaatattattgtttatagtctagcatagagcaaattgtaattaaaattggaatgagaatttttctatatttaattcttttgttatagatatcattgatataactttaatagaataatatcaaagaatcttaaaacatggatcgaaataaaagcataattgcataaatatagctctcaactccggaaaattaccgatctaaaaaatatacatgttgcactttaaacatttctaaagttacctcattcttcatatctacaaactatagtggcagcattcaaacatacaatatcatgggccccaaactcaagctataggttgtcttgcacttaggttgatgatgaagcaagtgaaacaacatgttgcatagctcacgcctatagtaaattgatgatctgaaaaaaatctacatgttgttcttcaagcgctcttagagtcacctcatcctttatatgaccaaatctactgctagaatgcgacaatctagggtcgcatgctcatgttatggttgtctcgaacatgagttaacgatggtccatgcgaaacaacatgttgggccatctataaaaactgtctgtctaaacaatacaacatttagggcttcaaaatgctttgaagttgacgcacatcaaaaatcgatatatcatgtagcaaacttgtgctaatataatacccattagtccattactcatgttttgatctgccttaaacttgggttgatgtgttcacaactgaggaacattgcaaatagcactatatatgtttttaaggtaacatgcctaaacatgtatgtcttacaagacgacatttaggaaagtgtaatgaaagtggaaatataaattttctttcattaactatttttccattaatagaggttgtaactctgcaaaatagtttatcttgaaaaatttgcatattgcaattcaaatacttttaattctttaaaacactgaactttaatcggtatgcgacccgctaattatgtgggtcctatactcaagttattgattgtgttgaattttagttgttggtggagcatgtcaaacaacatgttggatcattctgtaaatctaccaaataatttagggcttcgaaaagcttcaaagtttttgcatggttcatgccacaatcttttcgtaaaaacatgcacgaaatcgtgacactttactcccaaatcagtgtattgcgaaaacattgat

SEQ ID NO: 156 - DNA, 3328 bp, Zea mays
cttcggaagacgaaggcccccaacatgttgaaatgttgtgttttgaattatatatatatatatgttttgatagttatcgacatcttacaagtgttttctaccttgattaattcatccaccatgcttcttcattcacttctttagaagttgaagaagaatgagcagtgtagaatatagcaaagtgcatgttttgatgattccttgcatgcaacctcttgatccattgtgcggtgatgtacataatttctggaataacatgcttaattctgtacattgtaaatttgtttcgcatttgaattgctgaaaggctccatctccttgtagttggaacgttttttgctaatatgttttttcccttcaatgcaggaggtgaagcacattgcctcgttgacgtcctttcatctcaaaagggcaacgccaaatccaagccaatttgcactccttgttcatgaaataccaaagacaactaaagaatcatatagtgatgctgttggaaattttttcacaaagtatcatttgtctagttatctcttccatcaaattgtctacaaagttgggcttgtccacaagataatggtatctagctagtactcaatgcatgcatttctcttttactaacgaagaacatttactattatatattctaagggtaagggaagtataaataaaacttcttcatcttataattagctaggtttctcataattttttttgtctttttgacatgaacaagtgaacaaatgaccagttccttcagtgttgaatggtttttctttccttattcgtgtttgtaattcacctcttggtttttgtgtctttaacttaactcatagactagcacatagaagacacataagaacttcaaatatttcgtagctgaaatcagtagtcagggatataggacgacaaccaccaacagttgttgtttcgcgggaccaccctctccaaattcttccaagttcaactccgaatgcaagcaaaacaaggggaaccctaacaatgaagaatccaccctgaacttagatcgcgaggttaaaattcttgcatgcatgcatttgttaattgcttaatttagcagtaataatatggattaaattagtaatttctatatggaattatatgcagcaggaatgcacaactacttttgtatttttcaaaactcgctatgacgcagttactgcatcaaatatggtgcaggcatctaacccaatgaaatgggttactagtctggctccagaaccagaagacttgtatttgtccaatctttggcaatccaacaagtggagtaaagcaacactaattccaggctgtattatttttgcattcttacttttgatgctgatggtgtgtatacaagaactatctaacccagagcagctgcaacatttgattcctgcttccttgaaagaaaggttggagaagtaagtactgaaacctcagttgggctatctccatagatgtgtgttcttatgtcactacaaatatatatactatccatttgacatgtctccatgttgcatctattgaatatatattactcagcctatttgcaggataccttcctagtgtgatccaacaaattattctgtatattgttgggacattgatgatgaaagtttctaaattggaaggtgccacatcttacagtgcaaggaagatgagtgcttgctttaaactgttgtgcttcatagattggaacatattctttgttaatgtactatctagtacattcatgagtcaattgaatttgatattaagcccaaaagacattcctgtcaaggttgctagagctttaactagacagctttagcacaccttcccttttctttatggaaagataatatgttggttttgtgtatttaattttcatctaacatttctgtttcttttctgtgattttattttttattgcaggctactttcttcatcacctatgttatgacctcgggatgggctagtttatcatctgaacttttgctgttctttaatctgataatgagctttataagaaatatattttgagaaagggaaaatatagagaagatatagaatctgttcccacattccccagtcagcatgaggtgccaaaacttctattgtttggactattgggcttcacatgctccgtggtggctcctatgattttaccgttcctgctggtatacttttaccttggtcgtgttgtataccgcaatcaagtgagaacaaagaaactatatttttttcttacttaccccaaaatttgtccattcatgctaatgtaccatgtgttctttttcagtttctcaatgtttaccgaacaaggtttgacataggaggattgtattggccaattgcacacaacacaaccatattctctctcgtgcacacccatatcctctgtgctagtgtatttgacactaaagagtcgtgggtagctctttgcttgaccatacctcttatgagctgtactctttcatttcacctttactatagaaagagtcttctgttattcaagactgttccaacaaaggtaatattagttcgttaatataatgtgaaatgttcctttccaaaatgatcatgtggagatgtgactaggtttactagagcatagaataataattgatggctagagtttattgtgccttgtgattttgcaagatctcttctcttatggcatttattgttgccttgtgattttgcaacatttagtttacacggatatggaagttgaacgattaggaagaagggaggaaattcaccacatactccattcttcttattccgagttccttaatattgaagaagtacccttagaggaaattaagattgttggtggtgccgagaagcaatgttctagctcgagtacgtccactagcaaagaaacctctaacaatcctcaaaaggacaggtctcgcccattaaccatatctatgatgtcgcaatgtcgattacatcaaattctttcttcttaacatgtcccacccattaactatatatgtgtggtcatagagccaaagttcttaagtatgatttctccacacaacaaacttttgtcattcaccaacctcactgtgttacaattcccatagaggattgtggactagtattccataaagaatggcagactaggagtcgtgatactggacgagacagccaaacttccagttcctagtgcccatatgtaatctataggaccacatcctactttgaccaaatgttttcaatattagacactagtacaagaggagaaatatgcacaagccccattagactgcatgtaaaaatacgatagatctattatatccacaatgctccgctcaccctcaaactcaaggtggatcgg

SEQ ID NO: 157 - DNA, 3325 bp, Zea mays
ttttgtcttgacattcgtcagattatccatctttaggttcgtccgactgacgacgtcgtcttgcggagatgttcactctctgcattatcctagggtcgtgttctgcatcacgtgatcaacaaacgtacctaaatgatttgcataatgcacatgaatgcagataaacaagaatagtgctagactaaatattactacatgtaagcgaattaaaccagcgaggcattgtactacttcatacgatatacgactaagtgcaatagtcataaaataataaattatacgcacgtctattttccttagctaaggtccaacaccagaagactatcaaacctagatttatttattaggaaaacaatagaccatatgagttccacctttttatttgactaaagcataatacagaaagactaattacttagactcattattttggaacatgaaattcgaagtatggacggaaacaactcaactaactatttaaatcactcttttgaattaatccttaaaatatcctaactaataaaacatcacactatacttaatttatcaagtagagcatcatcacaccactctctagataagaaaatcgtcgatcatatcctactccaacattatcgatcacaaacatagatgatactaactactagcgcaggacatcaacttcatcttacgcgcactgaacacaattaccatcgacagatttatcgacaatcgtataaaatactgaatttaacctacgcgtcaccaaaatactacactctgaactagttcgaatatactcgacaactaaactcctcgaagcacacctcacatcgctggcatctttaacttaaaattaatacacaaactaagcgtcttatttcacgatcataaaatcaatagtaaaaatagtaaatcggctcaccgttccaatagctgactcgaatccgcgagatcggtaatgattctccgatttaggcaatttatcgagtgcttggcagatactatctgaacttcacacaccgcaccagccaacctttggacatcttctcttggggcttcttttgtcagcacgactccaactcggaggcgtcacgtagggaccgacatcgagacggatgaccgaacgacgacggcaagacaaaggatggagacgaccggatatcaacgacaagcactagagttttacgacgggctgttgtaatgggacgtcgatacacgatccatggcaattaggagatcgacgtaggcgaaaccgatagccgaataggaactgcgcagatcgacgacgtgagactcgatctggtgagcacgacgcaagggatcgcagctgctgcttcgacatgaattacttgctgccgagcacgacggaggccagggagcaggaacgctgcacagtgaacccctcggttgcgtgcaggggtaaaatcggctaggcgcggcgattggagcaggcggccacaggggcagcgcccaggcacgcacgacgagaatccgagcagggccagtgcgcagcgaccatggaaaagatccgtgttgggctgaatccgagctggagctcgtggcaacagggagcagggcgagctagagactggaagacgccatggcgagcagtagggagcttcgatggagagaggcgtgacaggaaggtggagcagggagacggacgcgtaggggaggcgcgcgccatgggagatggctatgcgagcgcgtcagggagaaacgccggctgcgcgcagggtgaactcggcacgacaaccatggacaaggtgggcgagcggaggaatgacgcgatggaggagcgcggcttgcgatggagagcagggctgaccggatgccatgggagatcgacttggcaagcaccggcggctggagaaagtcgaggggaggtcgaggagctaagcggctgcatagtggagcaagcagccatggaagagcagagcgtcaactgggagggaggagatgggacggcgctgggatgtccgggaccagggcgcggctgcaggaggaagatgtgagaacgagtgcctgctgccgtgtggagaggagagataatgctgaggaaaaaatgtgcataagaagataaggctaggagaggatgagcatgtagaagaagatattctaccggttacccacttaagcggcgacagagacaaggaaaaaaatgcatcgaatacgattgctggcaaagaaaatattgatgacggccaatgatattctaggaagtttacgtacatgagaagaaaacaacgatagagagatattttctatagtgaaaaatccaaatacgttgaaaatcataccaaggaatggtggaaatatttagagaaggattttccctattttccttctttttttaaaacaacaaaatacgcatattttagggtatgaaattagagtctaaaaatatacaaaaggatcaaacaaaaatgagaccgacaagaatatttagataggatttgatttggtgaatactctcggaattagatgaattttcactcgttatttatatccgaagttttggatctggccgagaaactcaaggaccaaaacactatccgtatacggtacttgagactctattaatttagttgaactgagataaaaatttatctgttttccgaatcgatttgatttctctacctagaatagcacactaatgaataatcccaattgttaatattgtgcacggtttcttggtaacgcaagcaatccggagtattctttcgaacccagtattatctgctataaaatcaaacattaatctctttgtctcggataatatcgggttcagataggatgcaaataggatgaacccaaacgagatcgagactgatattttaaactatatttgatatgacttgaaatcagataacttcgtctgccactcgaacacctgatcactctgccatagatgatttattggagaagaaaatctcaattataattccttggttagcaatcttgcgcatgatttttctcagacaatgcgtgattcagattattttgccccgaacattttagtcgtcgagttcaaattaatttgttcgggataaaatcatccgagtgggtcaagcttccaattcgtattcgcgcgagcgatgagttttaaataatcactagacgcaccgattttcggaacaactatgttccgaacatcacataaatttaggaagagcctggatagataaaaacgaagtcgaactcgcgacagacgaaacagatgtgatattaaaatcgcgataggtgaagatgattaaaatttagcatctgttttatccactgatattacgtgcttaattccacactcgttgtcgagcggaatataaacaccaggggtgttaca

SEQ ID NO: 158 - DNA, 3325 bp, Zea mays
tagggaagaggggaagagagggagagagggagggggcggtggctgcatgggggagtagagagggggtcgactagggttaggggggaaattaggagagactcccaaccactagatgcggatcgatagctcacagcccctgctccccattgagctcccggtcccagcaaataaagcctgaaaaactacagtacaacggaggtattagcctccctgaactacagagcgcgaaagaagagggaaaaggaatttaacttcttttcttcaaaattccggtatcacaatcgtactgtaagacatacttgtttaggcatgttaccttaaaacatatattgtgctatttgcaacgttcctcagttgtgaacacatcaacccaagttgaaggccaatcaaaataggagtatgggactaatgggtattatattcgtacaaatttgctgcatgatatatcgatttctgatgtgcgtcaacttcaatgcattttgaagccataaatgttgtattatttagagagacagtttttacagatggacccaacatgttgtttcgcatgcaccatcattaacccatgttcaagacaaccataatatgagtatgcgaccctagactgtcgcatgctacactagatttggttatatgaaggatgaggtgactctaaaagcgcttgaagcacaacatgtagatttttttcagatcatcaatttactataggcgtgagctatgcaacatgttgtttcacatgcatcatcatcaacccaagtcgagagctatatttatgcaattctgcttttatttcgattcatgttttaagattctttgttattattctattacagttatatcaatgatatttataacaaaaaaattaaatatagaaaaaaattcattccaattttaattacaatttgctctaagccagactataaacaataaaagtttaggcatgctatcttaaactatatgtagtgctttttaaaataattcttggttatggacaacaatgcatgttttgaggccactcaaaaaatgagtatgggactcatgatatttatcacaaaacaatttaaccaaggaaaattacattacaatttgctcattgccaaactgtaaacatcacttgttttggcatgttatctcataagataagtggaaaattttcaaatgtttcatgcttacggagattaatgtatgtttgaattggttcaaagccctaaatgatgtaatgtttagaatggtagtttttacaaaaaggacccaacaagggttgtcatcaaagttttcgcaatacactgatttgtgagtaaaagggtcatgatttcgtgcatattttcacgaaaagattgtgggttggaccatatgaaaactctgaagcttttcaaacccctaaattatgtggtagatttacagaatgatccaacatgttgttccacacgctccaccatcaactaaaattcaacacaatcaataacttgagtatgggacccacataattagatggtcgcatgccgattaaagttcagtgttttcaagaatgaggtaactttaaaagtatttcaattgcaatatgcagatttttcaagttaaactattttgcagagttacgacctctattactcttttctaaatgtcgtactgtaagacatacttgtttaagcatgttaccttaaaacatatattgtgctatttgcagtgttcctcagttgtgaacacatcaacccaagtttaaggccgatcaaaacatgagtatgggactaatgggtatcatatccgtacaagtttgctgcatgatatatcaatttctgatttgcgtcaacttcgatgcattttgaagccctaaacgttgtattgtttacagacagtttttacggaaggatccaacgtgttgtttcgcgtgcaccatcattaactcatgttcaagacaaccataacatgagtatgctaccctagattgtcgcatgctagcactagatttggtcatatgaaggatgaggtgactctaaaagcgcttgaagcacaacatgtagattttttcggatcatcaatttactataggcgtgagctatgcaacatgttgtttcacaagaatcatcatatgtagtgcttttttatatgattcctggttatggacaacaatgcatgatttgaggccactcaaaaaacaagtatgtgagtcttgatatttgtcacaaaataaattaaccaaggaaaattacattacaatttgctcattgccaaaccgtaaacatcacttgtttgagcatgttatctcataagatatgtggaaaatgttagaatgtttcatggttatggacattaatgtatgtttaaagtggttaaaagccctaaatgatgtaatgtttagaacggtagtttttacaaaaaggacccaacaaggtttgtcatcaaatttttcgaatacactgatttgtgagtatagggtcatgatttcgtgcatgttttctcgaaaagattgtggcatgaacaatgcaaaaactttgaagctttttgaagccctaaattatgtggtagatttacagaatgatccatcatgttgtttcacacgctccaccatcaactaaaattcaacacaatcaataacttgagtatggaaaccaaataattagatggtcgcatgctgattaaagtccagtgttttaaagaatgaggtaactttaaaagtatttgaattgcaatatgcagattttcaagataaactattttgcagagttacgacctctattaatggaaaaatagttaatggaagaaaatttccatttccactttcattacttttttctaaatgttgtagtgtaagacatagttgtttaggcatgttaatagtgctatttgcaatatttctcagttgtgaaaacatcaactcaagtttaaggacaatcaaaatatgagtatgggactaatgggtattaatttcgtacaagtttgctgcatgatatatcgatttctgatgtgcatcaacttcgatgcattttgaagccctaaatattgtattgtttagacaaacagtttttacggatggacccaacttaatgttttgcatgcgccatcattaacccatgttcaagacgaccataacatgagtatgcgatccatagaattggactatcgcatgctagcactagatttggtcatatgaagaattaggtgactctagaagcgcttgaagcccaacatgtagatcttttagatcatcaatttactatagaggtgagctacccaacaagttgtttcacatgcttcatcatcaacccaagtgcaagacaacctatagcatgagtttggggcccaagatattggatgttcgaatgct

SEQ ID NO: 159 - DNA, 3298 bp, Zea mays
tgtaacacccctggtgtttatattccgctcgacaaggagtatggaattaagcacgtaatatcagtggataaaacagatgccaaattttaatcatcttcgcctatcgcaattttaataacgcatatgtttcgtctgtcgcgagttcgacatcgtttttatctatctgggctcttcctaaattttcgtgatgttcggaacatagttgttctgaaaatcggtgcgtccggtgattatttaaactcatcgctcgcgcaaatacgaattggaagctcgacccacacggatgattttatcccgaagaaattaatttgaactcgacgactaaaatgttcggggcaaaacaatctgaatcgggcattgtctgagaaaaatcatgcgcgagattgctaaccaagtaattataattgagatttgattctccaataaatcatctatggcagagtgattaggtgttcgagtggcagacgaagttatctgatttcaagtcgtaccaaataaagtttaaaatatcagtctcgatctcgtttgggttcattctatttgcatcctaactgaacccgatattatccgagacaaagagattaatgtttgattttatagaagataatactgcgtccgaaagaatactccggatcgcttgcgttaccaagaaaccgtgcacaagattaacaattgggattattcattagtgtgctattctaggtagagaaatcaaatcgattcgaaaaatagataaatttttatctgggttcaactaaattaatagtctcaagtaccgtatccggatagtgttttggtccttgtgtttctcggccagatccaaaacttcggatataaataacgggtgaaaattcatctaattctgagagtattcaccaaatcaaatcctatctaaatattgttgtcggtctcatttttgtttgatcattttgtatatttttttagactctaatttcatactctaaaatatgcgtattttgttgttttaaaaaaagaaggaaaatagggaaaatccttctctaaatatttccaccgttccttggtatgattttcaacgtatttggatttttcactatagaaaatatcactctatcgttgttttcttctcatgtacgtaaacttcctagaatatcattggccgtcatcgatattttctttgctagtaatcgtattcgatgcattttttccttgtcttcatcgccgcttaagtgggtaaccggtagaatatcttcttctacgtgcgcatcctctcccagccttatcttcttctgcagatttttttcctcagcattatctctcctctccacacggcagcaggcgctcgttctcacatcttcctcctacagccgcgccctggtcctggacatcccagcgccgtcccatctcctccctcccagtcgactctctgctcttccatggctgcttgctccactgcgcagtcgctcagctcatcgacctcccctcgactttctcgatccgccggtgctagccaagtcgatctcccatggcagccggtcagccctgctctccattgcaagccgcgctcctccatcgcgtcgttcctccgctcgcccacctcgtccatggttgtcataccgagttcgccctccgcgcagctggcgtttctccctaacgcgctcgcacagccatctcccatggcgcgcgcttcccctgtgcgtccgtctccctgctccaccttcctgtcgtgcctctctccgtcgaagctacctgctgctcgccatggtgtcttccagtctcaggcttgccctgctccctgttgccgcgagctctagctcagattcaacccagctcggatcttttccatggtcgctgcgcactggccctgctcggattctcgtcgtgcacgcttgggcgctgcccagtggacgcctgctccaatcgccgtgcctagccgagtttacccctacgcgcaactgtgggttttgctgcacagcgttcctgctccccggcctccgtcgtgctcggcagcaagtaattcatgtcgaagcagcagatacgatcccttgtgtcgtgctcgccagatcgagtctcacgtggtcaatctgcgcagttcctgttcggctatcggttctgcctatgtcgatctcctaatttctatggatcgtgtatcgatgtcccattacaacagcccatcgtaaaactctagtgcttgtcgttgatatctggtcgtctccaacctttgtcttgccgtcgtcgttcggtcaccctgtctcgatgtcggtccctacgtgatgcctctgagtatgttggagtcgtgctgacaaaagaagcgccaagagaagatgtccaaaggttggatggtggggtgcgtgaagttcggatagtatctgccaagggctcgacaaattgcctaaatcggagaatcattaccgatctcgcggattcgagtcagctattggaacgatgagccgatttactatttttactattgattttatgatcgtgaaataagacgcttagtttgcgtataaagtttaagttaaagatgccagcgatgcgaggtgtgcttcgaggagtttagttgccgagtatattcgaactagttctattttgcagagtgtagtatttcggtgacgcgtaggttaaattcagtattttatacgattgtcgataaatctgtcgatggtaattgtgttcagtgcgcgtaagatgaagtcgatgtcctgcgctagtagttagtatcatctatgtttgtgatcgataatgttggagtaggatatgatcgacgattttcttatctagagagtggtgtgatgatgctctacttgataaattaagtatagtgtgatgttttattagttaggatattttaaggattaattcaaaagagtggtttaaatagttagttgagttgtttcggtccatactttgaatttcatgttccaaaataatgagtctaagtaattagtttttcgttattatgctttagccaaataaaaaggtggaactcatatggtctattgttttcctaataaataaatctaggtttgatagtcttctggtgttggaccttagctaaggaaaatagacgtgcgtataatttattattttatgactattgcgcttagtcgtatatcgtatgaagtagtacaacgcctcgctgctaggtgtttaattcgcggacatgtagtaatatttagtctcgcactattcttgtttatctgcattcatgtgcattatgcaaatcatttaggtacgtttgttgatcacgtgatgcggaagacgaccccaggacaatgcagagagtgaacatctccgcaagacgacgtcgtcagtc

SEQ ID NO: 160 - DNA, 3291 bp, Zea mays
cctctaggcgactttcactaagaatctcaaaccttcctaaggctcatagcccaaggcccatgcaaactgggtgccatgggacatataagttggccctttgtgatgctaaagtgttggtgatgcaaagtaaagagaatcatgatgaagacaacattaatgtatgaaattattttactagcacaaaaccaatcatcaaggcatagattacaagttgtatagaagacaggggcatggactaattattgtagctacccacccacccatacttcattgtcactatcatgttagagtttgctgcttctcaaatctagcagctggctgccatctttgtagcctcactttgtcttttgcctatcaggaagtgtgtcctttagcccctagtaaatgggtttaaggagaactcttgggtctagctcttgagggtcaccaggatgtagaacgaccacctgaagacctagctcccaatcctctcataaccattgggcattaaccttgccttagaacttgaccaacttgttggtaatctggatgaacccaaggtaggtgcccccatgctctattgatggtcctaagacctacaagcgcaaggcattagtcgcctgtttgagggcttcccgtgctagggtgcactcctctttagtgacatctagagctaggtgatgacttcctctagctacttgactttctcttgtgaggcccccaagtcttgggaggacccaacacaacctctcagttcgtcatcctcttagttagagccttcaagctctcttcctttgaaaggcatgctctcaatcttatcttgaggccctcccttttcccatttaactctttccatgcattacggggtcataggagtttgatagcaggacctgctcctgcttcatcatgttctcatcaatggcacacttcgtctctcacaacctggtgagcctctttgaaatatgaatttttccctacgagagggcctgctcttgagtcaggagaccaacggcaacagtctctaaaaattttcatcagagctgaagatcttattcttctttgaccccaatagcttctcactcaacctcctggcaaggttaaccaaactgttttaatggggaaaaccgcaacccagcggtaacgatttatcgccggtaaaccgccaaaaaccgactgatttggccagttcaaaccaaagcaaatttaaaacggttttccctgcaaaaaccggcgataaaccgccaaaagctgctggtaaaccagcctcacgaaccggttttttgtaatttacagaaaaatgaattttttgacagggtttatttttgctcaattcatgttgcacaataaataataattggtccacacaacatgtgttcaacaaaatggcatacatcatacatacgcaactacaaactccaattctcatgcaacaaacaaccaatgaacttcaccatactcaaatacaagttcttttatagctctccaatgacacataggtcgacttgtttcatagtattcacagatttagctcgactcttagtgatagtacccaggcatgttggaaggatcatgatatggttccaatctgtcactgtgatagtgatagttctatgcaaaagatatgagatacattagcgaggaaaacaagaacgataaatgaatactaatcgacgaagcaaaagtaacatatcggtgcaacgagaacttgtccatacccatactttagttctggtggatacatttgtgacaaatttgaatatggcattagaggggtccatacccatacatgatcgatggaagtacttcgcctagtggtcactgacccggttgtcattgccacacataaggattatagatttggtcttgtctgggcagatagttagaagaactagagctacttgagctacggattccatcttagataggaaatgaaaccgaacaacgttgactgcttattgtctcctgctatgaatgaggtgcatcatggtaagaatattgtgtggcatgggtgaaccgacttcctccaatgaacctccaatctcttgcaccactccctcctgcaccactctctcctgcaccatataatatagcatcaccatggcttccatcatcacctgcactagggtcggttgtgctatcatcactgtcttcatcctcttcttcctctttgagttgtacatccaactacagatcctttgggcgcttttaatcatcgcttcatgatgtggccactttccaatgttcttcaacatcagattaatggtatgtgctaaacatggctgccatactatatgattgtactctctggcttctctgctcaacatcttacaagccttcttaaagttggaaccattatctgttacaattttgatacatgttcaataatcttcgagacctccttgatctcctgctacatcaacatacatatgagtggccagtaaaaaagggtgaagcaattatgagtacatacatatgtgttcaaccttatcatacctgcattatgaatttaaggtccttgaccactccagttgcatcaacggtctttaaaaaatacatcatcccgttgcaatataccaaaagttaatgatgttcttttgtgtaggaccagtccatgaatcacacattagagtcgcaccaaacttattccactcatccttctatttttcaatctctttttgaaactcctttacattttcatcaagatacttgccatcaatctctcgaccagttggtaatgtgactcccgcacctgcattgaaggtaacaagattatatcaacaacataaatcaaatacaaaaaatatattgtgttatttgttaccttgtttttgggactccataatcgtggccctaaaatatgggttatcgacctttcgacccggcatgcccatggcatgacaagcctttgtccgagccctaccaagaatctctttcgagctccttcccttacttgcccaaagatcagtatatatcctcttttgccttggtccaaaggattgagcaagattatagcctctaacacgctcaggtacttgttctctactccttcccatcatcctatcaagtggccctgaagataccctctggctagaggatccagatccaccacccatgtcataccttgcgctagccatctgactaaattcgtgctccacacgtgactaatgcagagccgctaactgaacctagacctcttcttttcctttgtcttatctatgtcaagttggaagtatgcttttatgtctagaggaacagagggacatttcttgacattcttccctctatgcatgagatgctccttcaattgggtac

SEQ ID NO: 161 - DNA, 3289 bp, Zea mays
agtattttctttttccacacacataatttcttcttgaaacaagttatgggcagtaaagcacaagtgccacatgtacatttctaaattctgccagtacttaggtaggtagtaacagaaaccacatgtacatttctaaattctgccaaataacacgcaacatgaggcaaaagggtcatgacgcttgagttacacagccctagatcctgggaatcaaatgtcatccacataaacctcaactgaatcgtgcattcgtatcggcagctagatctgcttgtaacaagtctacgctaggagtaagctgggggtagctttgagcagtaccaaaaacaagctacagcaaaagtcatacttcaggcacgccatgttctagagctctcctgtaggtaagctgggtcatggatggatgttaggcaaggttgccttcccactccactcagtccaaggaactgctgcggcgctgcccggttaaccaagtgtcaagctactgcatctgccgagcagttcctcctcaacaatctgaaatgaatgaagtactggatcagatgcaggctagtaaagaacaaacaaacaaaccattaaagattaaactgtggtactgtactgtaacaggtagccgcagttgaatttaccttgtaagtttcaagcatcagctgaccaccgatttgtttctctgtcacatagctgacatatgtttccatcaaaggagcattaacagcctgcaaagagtaaaatcagcagattgtctaatgcttgttgcatgcatgcaatgtacagaatcccaataaagcataggcagcagcagattccacttcccaatttaacacttcactcctggtagccaagtgtagagagcgcataaattgggaaataaacaaggaacatatgaattttgagttcaaaacgaagtgcttgtccaaaatcaaatttccttgcccacgtgcaagtgtaatcaagtttgggcaaggaaaccaaacataacaacaacactggataacctacatcaattgtatgatactacttccaacagaagcaagagcgacaaatactgttaacgtgacagtagaaagaaacctgcaaacagagcgggtagctatccccacttgaaatttccagatagtaagccagcctcttggtttccatttccatactttcctcaacctgtaagacaccataatcagcagtgtctacaagctgtagaagaatgccattgattcctacaatattataaatatattgaccttagcaaggtaatctggcaaggagtagtgcttaatccattcggaacttctcaccgagtagtagccatatatttcatcaagaaaagcattttgcattatggattttgcttcagaacaacatatgccatgcataacatcccgaaggctcgaatccatcctgatcccatcacgttcttgttggatctaggatcagcttgaatgttatgtacagaaggaacacgttgaacaaacaaaaggtgaaagacagctatctagaaattaccatagtaagaagagccgttcttgcttcatcattgaagtaggaaaagacctagcagatgggcaaaagacataagaagtgggtaagcagtcaccttcacaagcaggaggaaatgtggaagcaaaacattttcttgaataacactcactggatcaaagaaagaggtagcagcagtgttgctaagcgatggtagtttgtactgcttcacatagcagcggtccaaatagctgaagaagccaattacacatctaatcatgatgcaatagtttgaccacattttcacaagctctctgaaaaagctgtcattttgcttgtgcatgagatggggcagaacctaatatacaaacaagagtgaaatatgtcaagacggggtaaaggaagatatccttgccaaaatcaattaacttggtaagcatctctaaaccgaattgtacacagatacatggagtatatctgaagtgaggtatttcaataaaataccatggttgttctacagtaaatcagggtggtctactacagtaaaatgtcattatagacgtatactgcagtaaagcagggaaacaacagtaatgcacctcctcctttctcactctgatccatatctattttgtttgtggcaaactgttttttattttgtcaatgaaaatttaggtaggagcctcgcttccagaattcctaaaaacagcaatgttttatcatgttggtatatgagtatatgaccgcacaaatatgcacagttacactttcaagtttcaaccatagtagttcactactgtatccactttatttataatatgagcacatgcctatttcatatcacatcaacatatcacaatcaagtgtaaatttgttgtgtaagtgtatctgattttgttgccaaggcaattagatacacggtggcttttgcagcaattcctgctagtgtcagctcgtaatttgcctcaaatcaagcaaaaacacgatagtaaaagaaaccaaataggagtataggtaataaatattcaacaaatagtactaacagatctaagcttcaatttttatgggcagcaaggctctggtctagttgctgtggaagtgtggatctatactattaaagatttattagccagggttttaactgaggacaaatatagaaacaacacagatacttgatgaaataactcatgcatcacaagatttcatacactgaagcagagatataaaaaagttagaactgcacccgcagtggtccttatatgattcagttaacccttttcagcatcagaactcgagatgttcaactctagaatattttacctcaactacagtagatcatggagtagaaacaaaaaaataattatagtaccattgtgcggacacattctgcaagcatcatcttgaaaccattgtacatttctggacagtaatgttgtttctgcacagccatcctgtaagcacaactagaatagtagaggaacaaatgatgagctgcaactttaagtaacacatggataatagtaaagatatgcacatcgtcttgaagccatagaagcatactcatagtagttcatgtattcgttcacggtaggccttgtactggtgcactccaaaatcttcgagcattttacaatcccctgttccaggactttccagccctcctcgaagcttaggtggttgttcattttgctaccttgttctgacacagctgcactagttaaaaatgtatcagaagtgtttttttttagattcagcaataacagaagaaatgaagcaaatattagatcttttcagtgtttacaagtcgtccgactaa

SEQ ID NO: 162 - DNA, 3288 bp, Zea mays
gaacccagggtcgggacctagagagatgcaattagtctgacccagagagatgcgatttctttcaatggcatcatccggtttttcctcaatatatcacgaatttgttgggggacttgcgagacatagtggatgaactgacgaaggagattgatgcattacaaaataaggaacaagaacttaaggactctttggaaggtatgatgcagctattgaatttggagtaaaggtgtagtcgtgttcatgcagccttagcggtaagccgttttctgcctatttctcttttgtagccatgtcagttatttatactttgttctttttatgttgagaagggcttggggtgctagtgaccaatgtgctggtggttacctccattgtggcaactacgcacaagtagtagcacggaggaagtaaccatcagcatattgggcacacctccaccatccgccgtgacgctctcctggccaaaaggttggtcattgctgcaaggaggactagtcggctcagatgacaggctgcctcagctgctaccaagtcaggctacttagagtttgtagggtgatgtcatttggacctcgacgagatccaccactcgattatattgtactggatgctcacttatttatgttccaaactcagttattctatgatgaacgctcagttgttttatgtgccactcagttattttattctgaatagttattctaatatgtgcaactcagttattgtaatatgcgcaagttatttatgtgccactcagttattctaatggacgcactcagttagtctggtgtcggaactcagttattccattctaatacctcagttattcttgtgggccgactcatttattttcttctcgtgactcagttattctactccaatccctcagttattccgttataataactcagttattgtaacgtacccactcggttattctctgttcacaagtcagttattccgttccagtaactcagttattctagtgtggcgactcagttattcttgtgtcagtactcagttattctggtgacggaactcaattattacgttctacgacctcagttattctaatgtgcacactcagttattctctactcattactcggttattccattctaataactcagttattctggtgacggaactcagttattacgttctactacctcagttattctaatgtgcacactcagttattctgttcaaataactcagttattctactaattactcagttattccgttctaatacctcagttattctagtgggcgcacttagttattccatgttcatttctcagttattctcggttcagtactcggttattctgtgttcatcactcagttattctggtgacgaaactcagctattctctgctcgtgcctcagttcttgtgggccaactcagttattctactccaatccctcagttattccgttataatacctcagttattctaaaccctcagttattatgttataataccgcagttattccatgttcctaactcagttattctaatgtcggtactcagttattctaatgcgcgccctcagttattccatgttcaacactcagttattctttgtacgttactcaggtattgtgcgttcattactcagttattctagacgacgcactcagttattcgagtgacagaactcagttattctactccaatccctcagttatcctgtgtcatacctcagttattgtaatgtgcctactcagttattatatgttcatgactcagttattccgttccaacaactcagttcttctaatggacgcactcagttattctggtgccagaactcagtaattctgttccaatacctcagttattcttgtgggctaactcagtgattatggtgtgcagactcagttattctggtgtcggcactcagttgttcggttctgatccctcagttattctactccaatccctcagttatcctgtatcgtacctcagttattgtaatgtgcccacttagttatgcggtgtttattactcagttattctctattcacagtcagttattgcgttcaagtaactcagttatgctattgttcattactcagttattctgttgtgcacactcagttattccatgttcactactcagttattatctgttcattactcagttattccagtccaacaactcagttcttctaatgcacgcactcagttattatggtgacagaactcagttattccgttccaataccttagttattcttgtgggctaactcagttattctcctccgatgcctcagttatcatcatacctcagttattggaatgtgcccactcagttattattgtgtgcagactcagttattctggtgtcggcactcagttgttcggttctgatccctcagttattatgttataatacctcagttattgagatgtgccgactcagttattcttttgtcagaactcagttattctaatgggcgcacatagttattctggtgtgatgaatcagttattctcgtgtgcctactcacttattctctgctcattactcagttattctctttgtaatcacttagtagtggggactccgttattctctattcacaatcagttattgcgttctattaactcagttattccatgttcgccactcagttatttactcagttgttgtgttttcattactcagttatttcattccaacaactcagttattctaatggacgtactcagttatttctttcagtagctcagttattctattgtgtggactcagttattctggtgtcagcactccattctaatacctcagttattctctgctcatgactcagttattctagtggacgcacttagttattccacgttcatttctcagttattctcggttcagtactcggttattctgtgttcatcactcagttattctctgctcatgcctcagttcttgtgggccaactcagttctactccaatccctcagttattccgttataatacctcagttattccatgttcctaactcagttattctaaaccctcagttattatgttataatactgcagttattccatgttcctaactcagttattctaatgtcgatactcagttattctaatgcgcgccctcagttattctatgttcaacactcagttattctctgtacattactcagttattctctgtacgttactcggttattgtgcgttcattactcagttattctagacgacgcactcagttattcaagtgacagaactcagttattctactccaatccctcagttatcctgtgtc

SEQ ID NO: 163 - DNA, 3286 bp, Zea mays
gtcttgcggagatgttcactctctgcattatcttggggtcgtcttccgcatcacgtgatcaacaaacgtacccaaatgatttgcataatgcacatgaatgcagataaacaagaatagtgcgagactaaatattactacatgtccgcgaattaaacacctagcagtgaggcgttgtactacttcatatgatatacgactaagcgcaacagtcataaaataataaattatatgcacgcctattttccttagccaaggtccaacactagcagactatcaaacctagatttatttattaggaaaacaatagaccatatgagttccacctttttatttgactaaagcataataccgaaagactaattacttagactcattattttggaacacgaaattcgaagtatggaccgaaacaactcaactaactatttaaaccactcttttgaattaatccttaaaatatcctaactaataaaacatcacactatacttaatttatcaactagagcatcatcacaccactctctaaataagaaaatcatcgatcatatcctactccaacattatcgatcacaaacatagatgacactaactgctagcgcaggacatcgacttcatcttacgcgcactgaacacaattaccgacgacagatttatcaacaatcgtataaaatactgaatttaacctatgcgtcaccgaaatactacactctgcaaaatataactagttcgaatatactcggcaactaaactcctcgaagcacacctcgcatcgctggcatctttaacttaaactttatacacaaactaagtgtcttatttcatgatcataaaatcaatagtaaaaatagtaaatcggctcaccgttccaatagctgactcgaatccgcgagatcggtaatgattctccgatttagaaaatttttcgagcgcttggcagatactatccgaacttcacgcaccccaccatccaacctttggacatcttctcttggggcttcttttgtcagcacgactccaacgtattcggaggcatcacgtagggaccaatatcgagacggggtgaccgaacgacgacgacaagacaaagattggagacgaccgaatatcaacgacaagcactagagttttacgacggactgttgtaatgggacgtcgatacacgatccatggcaattaggagatcgacataggcggaaccaatagccgaacaggaactgcgcagatcgacgacgcgagacacaatctggcgagcacgacgcaagggatcgcagctgctgcttcgacatgaattacatgctgccgagcacgagggaggccagagagcaggaacgctgcgtagtgaaacccacggttacgcgcaggggtaaactcggctgggcgcggcaattagagcaggtggccactggggcagtgcctaggcgcgcacgacgagaatccgagcagggccagtgcgtagcgaccatggaaaagatctgagctgggctgaatccgagctggagctcgcgtcaacagggagcagggcgagccagagactggaagttgccatgggagcagcagggagattcgacggagagaggcgcgacaggaaggtggagcagggagacggacgcgcaggggaggcgcgtgccatgggagatggctgtgcgagcgcgtcagggagaaacgccggctgcgcgcagggcgaactcggcacgacagccatggacgaggtgggcgagtggaggaatgccgcgatggaggagcgtggcttgcaatggagagcagggctgaccggctgccatgggagatcgacttggtgagcaccggcggctagagaaagtcgaggggaggtcaaggagctgagcggctgcgcagtggagcaagcagccatggaagagcagagagtcgactaggagggaggagatgggacggcgctaggatgtccggaaccagggcgtgactgcaggaggaagatgtgagaacgagagcctattgccgtgtggagaggagaaataatgctgaggaaaaaatctgcagaagaagataaggctcggagaggatgcacacgtagaagaagatattctaccggtaactcacttaagcggcgacggagacaaggaaaaaatgcatcgaatacgattgctggcaaagaaaatattgatgacggccaatgatattctagaaagtttacgtacatgagaagaaaacaacgatagagagatattttctatagtgaaaaatcaaaatacattgaaaatcataccaaggaacgatggaaatatttagagaaggattttccctattttccttctttttttaaaaacaacaaaatacgcatattttagggtatgaaattagagtctaaaaatatacaaaaggatcaaacaaaaatgagaccgacaacaatatttagataggatttgatttggtgaatactctcggaattagatgaattttcacccgttatttatatccgaagttttggatctggccgagaaactcaaggaccaaaacactatccgtatacggtacttgagactctattaatttagttgaactgagataaaaatttatctgttttccgaatcgatttgatttctctacctagaatagcacactaatgaataatcccaattgttaatattgtgcacggtttcttggtaacgcaagcaatccggagtattctttcgaacccagtattatctgctataaaatcaaacattaatctctttgtctcggataatatcgggttcagataggatgcaaataggatgaacccaaacgagatcgagactgatattttaaactatatttgatatgacttgaaatcagataacttcgtctgccactcgaacacctgatcactctgccatagatgatttattggagaagaaaatctcaattataattccttggttagcaatcttgcgcatgatttttctcagacaatgcgtgattcagattattttgccccgaacattttagtcgtcgagttcaaattaatttgttcgggataaaatcatccgagtgggtcaagcttccaattcgtattcgcgcgagcgatgagttttaaataatcactagacgcaccgattttcggaacaactatgttccgaacatcacataaatttaggaagagcctggatagataaaaacgaagtcgaactcgcgacagacgaaacagatgtgatattaaaatcgcgataggtgaagatgattaaaatttagcatctgttttatccactgatattacgtgcttaattccacactcgttgtcgagcggaatataaacaccaggggtgttaca

SEQ ID NO: 164 - DNA, 3281 bp, Zea mays
tataaaatgaaaatggtagaggtgtttccctcaccgctttattcactaatcagccattgaaggtacattaccatgagaaatcataataccctaaacatgtgcaggggtgtaataaacatcaataataatatgaatactaaaagctcatgcttgaccggatcaagcgtgcgatacacctatattgaaacaccaaaatcagtaagcaagcaacataacaagtctccttagccatcacaagagccatagcacacaaatctacctctacacatgaatgagaaaccgcttcttagtcttccaagcaagcaataatagtatcaccaaaaacacaataggtagaaagagtgacaattagaggaaccactaccccaagtagcatgacaatatatctaaatccttaagtgctaggtgggggaaaatcaagcaacaaacaacatgacacagtctcacaaagataatgtaagaaatattacaccaacacacgaaaatattgcataaagtataaatagatatttgtctatgcaagaatatattttatttgagaccaaaataattttatttgagttaaaattgttttgttattgattttatttcatttcgaacatccaagtttaaatttcaaataactatatattggagtggattacatgtttatttcaataaaatagaggggctttcatgcaaaactagaactattagcgttggatgacttaggctctaaccaatatcggcttgttttagccatcagatcacatgtgtgcgtctatgattaaaagagtaattgtgagggtggtgcttagagagcgacgtccttccccatgatagacatcagatctctctcttttaatttattatcaagtgttttctaccttgactaattcatccaccatgcttcttcattgacttctgggtagtgtacaatataaaaaagtgcatgttttgatggcacaaagaaggcatataaaaagttcaaacatttcatagctgaaatcagcagtcagagatgtaggacgacaaccaccaacaactgttgtttcacgggaccactccctccaaattcttctaagttcaactttgaatgcgagtagaacaaggggaacactgacaataaggaatccaccgtgaacttagatcatgaggttaaaaagcttgcatgcatgcatttgttaattgctgaatttagcagtaataatatggattaaattagtaatttctatgtggaattatatgcaacaggaatgcacaattgcttttgtatttttcaaaactcgctatgacgcagttactacatcaaatatggtgcaggcatctaacccaatgaaatgggttactagtctggctccagaaccagaagacttgtatttgtccaatctttggcaatccaacaagtggcgtaaagcaacactaattccaggcaatattatttttgcattcttacttttgctgctgatggtgtgtatacaagcattatttgacccagagcagctgcaacagttgattcctgcttcgttaaaagaaaggttggagaattaagtactaaaacttcagttgggctatctcgatagatgtgtgttcttatgtcactacaaatatatatactatccatttgacctgtctgcatgttgcacctattaaatatatattacccgtcctatttgcaggaaaaactacatgactaacctagtaacgggataccttcctaatgtgatccaacaaattattctatatattgttgggacattgatgatgaaagtttctaaattggaaggtgccacatctcacagtgcaaggaagaggagtgcttgctttaaactgttgtgcttcatagtttggaacatattctttgttaatgtactatccggtacattcatgagtcaattgaatttgttattaagcccaaaggacattcctgtcaagcttgctagagctttaactagacaggtttaacacaccttcccttttctttatggaaagataatatattggttttgtgtatttaattttcatctaccatttctgtttcttttctgtgattttattttttattgcaggctaccttcttcatcacctatgttatgacctcgggatgggctagtttatcatccgaacttttgcagttctataatctgataatgagctttataaggaaatatattttgagaaagggagaatatagagaagatacagaatctgttcccacattcccctatcagcaggaagtgccaaaagttctattgtttggactattgggcttcacatgctctgtggtggctcctatgattttacctttcctgctagtatacttttaccttggtcgtgttgtataccgcaatcaagtgagaacctagatactatattttattttcttacttaccctgaaatttgtccattcatgctaatgtaccatgtgttctttttcagtttctcaatgtttatcgaacaaggtctgatacaggaggattgtattggccaattgcacacaacacaatcatattctctctcgtgctcacccagatcatctgtgctggtgtatttgaaattaaagaatcgcgagtggctgtatgcttgaccatacctcttatcatctgtactctttcatttcacctttactataaaaggagtcttctgttattcaagactattccaacacaggtaatattagttccttaatataatgtgaaatgttcctttccaaaacgataatgtggagatgtgactaggtttactagagcatagaataataattgatggctagagtttgtcatgagagtgagtatctctcttctcgtatggcatttattgttgccttgtgattttgcaggatttagttgacatggatatggaagatgaacgattaggaagaagggaggaaattcaccacatgctccattcttattattcccagttccctaatattgaagaagtacccttagaggaaattaagattgttggtggtgccgaggagcaatgttctagcttgagtacgtccactagtaaagaaacctttgaaaatcctcaaaaggacatgtctcgcccgttaactatatctgtgatgtcgtaatatcgattacatcaaattcttttctcttaacatgtcccactcattaactatatctgtgatgtcgtagagtcgaaattcttaagtatgatttctccacaaggcaaacatttgtcattcaccaacctcactctgttacaatgcccatagaggattgtggactagtagtccataaaggatggcagactaggagtcgagatactggacgagacagccagactttcgg

SEQ ID NO: 165 - DNA, 3280 bp, Zea mays
gaatacatgtggtcaaagcaggatgtggtcctatagattaaatatgaggcaataggaaccataatacatatgggcactaggaaccagaagtctggctgtcacgtccagtatcacgactcctagtatgccatcctctatgtactcctagtccaccatcctctatgggcattgtaacatagtgaggttggtgaatgacaaatgtgttgttgtgtggagaaatcatacttaagaattttgactctacgacatcacagatatagttaatgggtgggacatgttataagagagaagaatttgaggtaatcgatattacgacatcacagatatggttaacgggtgagacatgtccttttgaggattttcagaggtttctttgctagtggacgtactcgatctagaacattgctcctcggtgccaccaacaattttaatttcctctaagggtacttcttcaatattagggaacatggaataagaagaattgagtatgtggtgaatttcttccttcctaatcgttaatcttccatatccatgtcaactaaatcctgcaaaatcacaaggcaacaataaatgccaaaagagaagagagctactcactctcaagacaaactctagccatcaattattattctatgttcgaacattcacattttattaaggaactaatattacatgtgttggaataatcttgaataacggaagactctttctattataaaggtgaaatgaaagagtagagatgataagaggtatggtcaagcatacaactacccactattccttagtgtcaaatacaccagcacggatgatctgggtgagcatgagagagaatatgattgtgttgtgtgcaattggccaatacaatcctcctgtgtcagaccttgttcgataaacattgagaaactgaaaaagaacacatggtacattagcatgaatggacaaatttcagggtaagtaagaaaataaaatatagtatctaggttctcacttgattgcggtatacaacacgaccaaggtaaaagtatactagcaggaaaggtaaaatcataggagccaccacagagcatgtgaagcccaatagtccaaacaatagaacttttggcacttcatgctgataggggaatgtgggaacaaattctgtatcttctctatattctccctttctcaaaatatatttccttataaagctcattatcagattaaagaactgcaaaggtttggatgataaactagcccatcccgaggtcataacataggtgatgaagaaggtagcctgcaataaaaataaaatcacagaaaagaaacataaatgttagatgaaaaataaatacacaaaaccaatatattatctttccatatagaaaagggaaggtgtgctaaacatatctagttaaagcgatagcaagcttgacatgaatgtcctttgagcttaataacaaatccaattgacacatgaatgtaccagatagtacattaacaaagagtatgttccaaactatgaagcacaacaatttaaagcaagtactcctcttccttgcactgtgagaagtggaatcttccagtttagaaacttttatcatcaatgtcccaacaatatacagaataatttgtgtgattacactaggaaggtatcccattactaggttactcatgtagtttttcctgcaaataggccaggtaatatatattcaataggtgcaatatggagacatgtcaaatggatagtatatatatttgtagcgacataagatcacacatctatagagatagcccaactgaagtttcagtacttacttctccaacctttcttttaaggaagcaggaatcaactgttgcaactgctctaggtcagataatgcttgtatacacaccatcagcatcaaaagtaagaatgcaaaaataatacagcctagaactagtgttgatttacgccacttattagattgccaaagattggaccaatacatgtcttctggttctggagccggactagtaacccatttcattaggttagatgtctggaccatattcgatgcagtaactacatcatagcgagttttgaaaaatacaaaagcagttgtgcattcctgctgtatataattccacatagaaattactaatttaatccatattattattgttaaattaagcaattaacaaatgcatgcatgcaagaattttaacctcatgatctaagtttagggtggattcttcattgtcagggttcctcttgttttgctcgcatttagagttgaacttcgaagaatttggagagcgtggtcccgcaaaacaacaacttttggtagttgtcgtcctacatccccgactgccgatttcagctatgaaatgtttaaacttcttatgtgccttctttgcgccagtctgtcagataagttaaatacaccataaccaagaggtgaaaaacaaacacgcataaataaagaaaaaccattcaataatgaaggaactggacatttgttcacatgttcatgtcaaaaagacaaaaaaaattatgagaaaactagcttttcataagatgaagaagtcttaattatacttcctttagaatatataatagtaaatgttcttcgtttgtaaaatagaaatgcatgcattgagtactaggtagatatcattatctggtggacatgcccaactttgaagacaatttgatggaagagataactacacgagtggtactttgtgaagaaatttccaacatcatcactgtatgattctaaatgcatgcattgagtactaggtagataccattatcttgtggacatgcccaactttgaagacaatttgatggaagagataactagacgagtgatactttgtgaagaaatttccaactacatcattgtatgattctgtagatgtctttggtatttcacgaacaaggagtgcaaatttgcttggatttagctttgctcttctgagatgaagggacatcaacgtggcaatgtgcttcccctcctgcattgaaggaaaaaacagatcagcagaaaaccttccaactacaaggagatggagcctttcagaattcaaatgcaaaacaaacttacaatgtacagaagtaagcatgttactccagaaattatgtacaacaccgcacaatggatcaagaggctgcatgcaaggaatcataaaaacatgcactatgttatattcttcactgctcattcttcctcaagttctaaagaagtgaatgaagaagcatggtggatgaattaatcaaggtagaaaacacttgtaagatgtcggtaactatcacaac

SEQ ID NO: 166 - DNA, 3279 bp, Zea mays
tttaacacccctggtgtttatattctgctcgacaacgattatggaattaagcacataatatcagtggataaaacagatgctaaattttaatcatcttcgcctatcgcgattttaatatcgcatctgtttcgtttgtcgcgagttcgacatcgtttttatctatccgagctcttcctaaattgtcgtgatgttcggacatagttgttccgaaaatcggtgcgtccggtgattatttcaaactcatcgctcgcgcgaatacgaattggaagcccgacccactcggatgattttatcccgaacaaattaatttgaactcgacaactaaaatgttcggggcaaaataatctgaatcgtgcattgtctgagaaaaatcatgcgcgagattgctaaccaaggaattataattgagatttgattctccaataaatcatctatggcagagtgatcacgtgtttgagtggtagacgaagttatctgatttcaagtcatttcaaatatagtttaaaatatcagtctcgatctcgtttgggttcattgtatttgcatcctatccgaacccaatattatccgagacaaagagattaatgtttgattttatagcagataatactgggtccgaaagaatactccggatcgcttgcgttaccaagaaaccgtgcacaagaataacaattgggattattcattagtgtgctattctaggtagagaaatcaaatcgattcggaaaacagataaatttttatctgagttcaactaaattaatagagtctcaagtaccgtatccggatagtgttttggtccttgtgtttcttggacagatccaaaacttcggaaataaataacgggtgaaaattcatctaattccgagagtattcaccaaatcaaatcctatctaaatattgttgttggtctcatttttgtttgatccttttgtatatttttagactctaatttcataccctaaaatatgtgtattttgttgttttaaaaaagaaggaaaatattgaaaatccttctctaaatatttccaccgttccttggtttgattatcaacgtatttggatttttcactatagaaaatatctctatcgttgttttcttctcatgtacgtaaacttcctagaatatcattggccgtcatcgatattttctttgccaccaatcgtattcgatgcatttttttccttgtctccatcgccgcttaagtgggtaaccgatagaatatcttcttctacgtgcgcatcctcccccagccttatcttcttctgtagatttttttcctcagcattatctctcctctccatacggcagcacgcgctcgttctcacatcttcctcctgcagccgcgccctggtcccagacatcccagcgccgtcccatctcctccctcccagtcgactctctgctcttccatggctgcttgctccactgcgcagcagctcagctcctcgacctcccctcgactttctccagcctccggtgctcgccaagtcgatctcccatggcagccggtcagccctgctctccatcacaagccgcgctcctccatcgcgtcgttcctccgctcacccacctcgtccatggctatcgtgccgagttcgccctgcgcgcagccggcgtttctccctgacgtggtcgcacaaccatctcccatgcgcgcgcctcccctgcacgtccgtctccctgctccaccttcctgtcgtgcctctctccgtcgaagctccctgctgctcaccatggcgtcttccagtctctggctcgccctgctccctgttgccgcgagatccagcttggatcttttccatggtcgctgcgcactggccctgctcgaattctcgtcgtgcgtgcctgggcgctgccttagtggccgcctgctccaatcgccgcgcccagccgagtttacccctgcgcgtaactgtgggttttgccgcgcagcgttcctgctccctagcctccgtcgtgctcggcagcaagtaattcatgtcgaagcagtagatgtgatcccttgcgtcgtgcttgccagatcgagtctcgcgtcgtcgatctgcgtagttcctgttcggctatcggttccgcctacgtcgatctcctaattgccatggatcgtgtattgacgtcccattataacagcctgtcgtaaaactctagtgcttgttgttgatatccgatcgtctccaacatttatcttgtcgtcgtcattcggtcaccccgtctcgatgttggttcctacgtgatgcctccgagtacgttggagtcgtgctgacaaaagaagccccaagagaagatgtccaaaggttggatggtggggtgcgtgaagttcgaatagtatctgccaagcgctcgacaaattgcctaaatcagagaatcattaccgatctagcagattcgagtcagctattggaacggtgagctgatttactatttttactattgatttcatgatcgtgaaataagacgcttagtttgcgtataaagtttaagttaaagatgccagcaatgcgaggtgtgcttcgaggagtttagttgccaagtatattcgaactagttatattttgcagagtgtagtatttcggtgatgcgtaggtcaaattcagtattttatatgattgtcgataaatctgtcgatggtaattgtgttcagtgcgcgtaagatgaagtcgatgtcctgcgctagtagttagtatcatctatgtttgtgatcgataatgttggagtaggatacgatcgacgattttcttatctagagagtgttgtgatgatgctctacttgataaattaagtatagtgtgatgttttattagttaggatattttaaggattaattcaaaagagtggtttaaatagttagttgagttgttttggtccatacttcgaattttgtgttccaaaataatgagtctaagtaattagtctttcggtattatgctttagtcaaataaaaaggtggaactcgtatggtctattgttttcctaataaaaaatctaggtttgatagtcttctggtgttggactttagctaaggaaaatagacgtgcgtataatttattattttatgactattgcgcttagtcgtgtatcgtatgaagtagtacaacgcctcgctgttatgtgattaattcgcggacatgtagtaatatttagtctcgcactattcttgtttatctgcattcatgtgcattacgcaaatcatttaggtacgtttgttgatcatgtgatgcggaagacgaccccaggataatcctgagagtgaacatctccgcaagacgacgtcgtcagtc

SEQ ID NO: 167 - DNA, 3279 bp, Zea mays
tatacggaaaccatctcaccggttatattccttcaaacatagactttctaacaaagctagcttatatcaaccttcacagtaataatctcactgggttcatccctccaaccctgggaaacatctccgcactaatggtactggatatttcaaataatcaactaaacggaagcattcctaatgaagtttggcaaataaagaacatagaatttttaaatctagcaggaaataacctatcagatggaatcccagatactctccctcacttagcttctcttaggacattatcattggacaccaatatgttgggtggcacattgccatcaaacattggcgatgtgctccctaatctgcaagaactatacgtaggaagcaacatttttttgggtacaattccaacttccctaggcaatgcttcaaatctagaagtcatagacctaccaaacaacctttttagtggcacaatcccaagttcttttggaaacctttcaaagttctaaaccttgaggtaaacatgcttgaagcaagggatagtgagggctggcaattctttgatgccctgtcaaaatgtagatatctcattacactttcagtgtctcaaaatcatctacacggacctataccaaattcgattgctaatctgtccactagtcttcaacaactattcatggattggaacaacctatcaggaatagttcccccaactattggaaaacttagtggcttaactgatttatcactacaaaacaacaatcttacatgtaccattgaggaatgggtcggaaagatgacaaatctaacaattttaacactacaatggaacaacttcacagggaaaattccaccttcaattggcaaacttacaaagttgacaaatttctctgtagctgaaaacaatttcttcgggtctgtaccatctaacttgtggaatctgaaatcaatgttgcatttagaccttagccataacaatttccaagggagcatacttgtttagtttggtaacttaggactcgtctcgctaaaaatttcatcgaacaaattcattggagaaaatcctgaaactttaggacaacttgaaaatatacaaaccattcaaatggaccaaaacattctcactggaaacattccgtacacattcaaaagtctatatagcttgagcttgctcaatctatcccataacaatttatccggcctcatgccaacttttctaagtggtctaaatctcactaaactggacctatcctacaataatttccaagggaaaataccaagcattggtctattcgataatcctacaattgtttcactagatggcaatccaggattgtgtggaggagacatggatttgcacatgcctccatgccatgtcgcttcgagaagagtaggcagaacaagcttattgatcaaaatattgatcccaatatttgggttcatgtcactcgtattgctgtgtactttttattcctagagaagaggacgtcaagaagagcatatagatcagagctatcttatggtgagcattttgagaaagttacttataacgatttagctcaagcaacacgggacttcttagaatccaacctgattgggagaggaagctatggttcggtgtatcgagggaagctgaaggaaagcaaaatggaagtggcagtaaaggtttttgaccttgagatgagaggagcagaaagaagcttcttgttagagtgtgtgtgaagcattgtgaagcattcaacaccggaatcttcttcccatcataactgcttcctcaactgtagataatataggaaatgttttcaaagctttaatttatgagttcatgcctaatgggagcctggacacatggctacatcacaaaaaagatgtggaggctgcaaaaaatcttggcttgactcagaataagcatagtggttaatatagctgatgcattggattatttgcaccatgattgtggatggccaactgttcactgcgacttgaaacccaacattatccttaagcttctagatgatgatatgaatgctcttctgggagattttggaattgcacgcctctatcttgattatcagtcaaaatgggcaggttcaattagttcaattggtgtaaagggaacaattggatatattcctccaggtacctatagttattttagctccttttttgatcatttatgtcaatattttttataggtagaaaataagttataacacaattaaattgttaatttgtgtgagcattttccaatttagagtatggagaaggtggccatgcatcaatgtctggggatgtttatagttttgggattgtgttgctagagattttgacgagcaaaaggccaacatatcctatgtttaaggatggcatggacatcattagctttgtggagaataactttcccgatcaagtatttgaagtcattgatgctcacctcctcgaggaatgcaggaactcaactcaaggaaataccttggtacaagaaaatgagatctatcaattcttggttgatctgctgcaagtagcactttcatgccttcattcgttaccatctgaacgatcaaacatgaagcaagtagctagcagaatgcatgcaatcaaaacatcacataatgaaatcacaagtaataagaacaagggtgttccatgaattgtacaataacatattgttggtacctaatttgaactaggtctaggatacctttttggccaaagggctacacaaaggaagtgttcggccgcatggaaaatagacatgtaaaacagaaataagcatttgtactgtaaagaagtaatagatcagatggaaatgtaagttaggaagcacttattgtgtaaggcccaaaatctgtataagaaaaaaaagtaaatatactactatgtataattttgaggatttcttgatcctcttttctttgagcaaattcaactaaaggaattaaagtagtcgaatgacttccaataacaattttattcctttatagaatatacctctataaactaaacacataatgataactaagaatttggtattcaagatttatatccaaaacttaaaactaaaaggttggagcaacaaataaaagagagactttcatactacttatttcctttaaaaactatatagccccttaaaatatagttgaaataaaataattcatgaggatattatgtactcctaagtagatatgtaatgaagattaccttttctaagtgtgcattcaaaataatgttttctaaataaataaataaataccgggtgaatatctcattattgaagtatttgtctaa

SEQ ID NO: 168 - DNA, 3274 bp, Zea mays
tcagtgcattgcgaaaactttgatgacaaatcttgttgggacatttttgtaaaaactaccgttctaaacattacatcatttagggctttgaacgtcttcaaacttacattaatgtccgtagccataaaacatttgaaatctttccacatatcttatgagataacatgcccaaacaagtgatgtttatagtttggcatcgagcaaattgtaatgtaattttgcttgcttaaactgttttgtgataaatgtcatgagtcccatacttgttttttgagtggtctcaaaacatgcatttttgtccataaccaagaatcatttaaaataacactacatatggtttaatatagcatgcctaaactagtattgtttatagtctcgcataaagcaaattgtaattaaaattggaatgaatttttttctatatttaattcttttgttataaatatcattggaataactgtaatagaataataacaaagtatcttaaaacatggaccaaaataaaagcatgattgcataaatatagctctgaactccggaaaattaccgatccaaaaaaatatacatgttgcactttaaacatttccaaagttacctcattcttcatatctacaaactctagtgccagcattcgaacatctaatatcttgggccccaaactcatgctataggttgtcttgcaaatggattgatgatgaagcatgtgaaacaacatgttggatagctcacgcaaataataaattgatgatctgaaaataatctacatgttttgcttcaatcgcttctagagtgatctcatctttcatatgaccaaatctagtgctagcatgcgaaaatctatggtctcatactcatgttatggttgtctttagcatggattaattatggtgcatgcgaaacaacaagttgggtccatccgcaaaaactgtctttctaaacaatacaatatttagggcatcaaaatgcttcgaagttgacgcacatcagaaattgatatatcatgcattaaacttgcacaaaattaatacccattagtcccatactcatgttttgatgtgccctaaacttggattgatgtgccctatatatgttttaaggtaacatgcctaaacaagtatgtattacaatacgacatttagaaaagagtaatgaaagtggaaatatagtttttcttccattgactattttctattaatagaggtcgtaactctgcaaaatagtttatcttgaaaaatttgcatattgcaattcaaatacttttaaaattacatcattctttaagacactgaactttaatcgacatgcgaccatctaattatgtgggtcccatactcatcttttgattgtgttgaattttagttgctggtggagcatgtgaaacaacatgttggatcattctataaatctaccacataatttagggcttcgaaaagtttcaaagttttcgcatggttcatgacataatcttttcgagaaaacatgcacgaaatcatgacccttcactcccaaatcagtgtattgcgaaaactttgatgagaaaccttgttgggtcgttttgtaaaaactaccattctaaacattacatcatttagggctttgaaccgcttcaaacttacattaatgtccataaccatgaaacatttgaaatctttccacatatcttatgagataacatgcccaaacaagtgatgtttacagtttggcaaagagcaaattgtaatattattttccttggttaaattgttttgtaataaatatcatgagtcccatacttgttttttgagtggcctcaaaacatgcactgttgtccataaccaagaaatatataaaatagcactacatattaagatagcatgcctaaactagtattgtttatagtctcgcatagagcaaattgtaattaaaattggaatgaaattttttctatatttaattcttttattataaattgatataaatgtaatagaataataacaaagaatcttaaaacatggatcaaaataaaagcagaattgcataaatattgctctcaattccagaaaattacaaactctagtgccatcattcgaacatccaatatcttgggcaccaaactcatgcgataggttgtctatgttttaaggtaacatgcctaaacaagtatgtcttacagtacgacatttggaaaagactaatgaaagtggaaatataatttttcttccattaactatttttcctttaatagaggtcgtaactctgcaaaatcgtttatcttgaaaaaactgcatattacaattcaaatacttttaaagttacctcattcttcaaaacactaaactttaatcggcatgcgaccatctaattatgtgggtcccacactcaagttttgattgtgttgaattttagttgctggtggagcgtgtgaaacaacattttggatcattctataaatctaccacattatttagggcttcgaaaagcttcaaagttttcgcatggttcatgccacaatctgttcaagaaaacatgcatgaaatcatgaccatttactcccaaatcattgtattgcaaaaactttgatgacaaaccttgttgggtcgtttttgtaaaaactttcattctaaacattacattatttagggctttgaacgtcttcaaacttacattaatgtccataaccatgaaacatttgaaatctttccacatatcttatgacataacatgcccaaacaagtaatgtttacaatttggcaaagagcaaattgtaatgtaattttcattggttaaattgttttgtagtaaatatcatgagtcccatacttgttttttgagtggcctcaaaacatgcaccattgtccataaccaagatatatataaaatagcactacatatggtttaagatagcatgcctaaactagtattgtttatagtctcgcatagagcaaattgtaattaaaaatggaatgaaaatttttctatatttaattcttttgttataaatatcattgatataactataatagaataataacaaagtatcttaaaacatggatcaaaataaaagcagaattgcaaaaatatagctctcaactccggtaaattaccgatctaaaaaatatacataatgcactttaaacatttctaaagttaactcattctccacatctgtaaactctagtgctagcattcgaacatctaatatcttgggcccaaactcatgctataggttgtcttgcacttgggttgatgatgaagtatgtgaaataacatgttgggtagctcacgtctatagtaa

SEQ ID NO: 169 - DNA, 3164 bp, Zea mays
tatttctacctattaatctaaatgtgcagcaaatttagatttctgacgtcctttcagttgaccttgtttgcagttccattatgacaagttctcctgtcgtatactgttttcctttcgcttttgtatacccacggtattgatattgtttatcagtattttgtgtataggaatctcaacttctttgccgaggtttatcgacagttgtatttgttgggaaaagtagcagtttgactctatataatagagagtgccatggacggacctgagtctagtagaggtcgcagtaagcaggaggttgatgataatgttaatgcaaggaatacttggaaggaggagcaagaaaatcaggagaatgtggatagcagaaattattcggatatatccagaaaacatggatatgaacatgaaactgggcatcaggatgataatagaatgattacaccttcaaatgataggaatgaatcaaggaggaatccagatagaagctcaggcctggctcgaggtgccgacgatgacgtctataatctgagaagggactcacgatctcctaaagttcaaaggagaagccctgatgattccaaggatcgagactatgatagaaggaggggaagaggggacaataatgattgggaaccttcaagaagatttagccctgatgcttctgctaggagttcagagagaagagagggtagtagggagaagcaaggacaacgggatcaagatgaaagggcatcagtcaggagggtagatgaagtttatgttgatgaaactggtggttctcttagagttgacacaagagaagcttatagagatgataaatctgacagagggagggataggaattggaatgagaaaacccgagacattgaaggttctaaggactatgggaggaacactcaattacgagatactaaggagccaaatgattttgaatggaggaatgcacaggaaaggctagatggcgggaatttccatggccgaactggatatcggagagattctaggggtagatctgaaagtattagaggtccctcaaactatgggaaccgatacgacaattcagactcaatagagattcgacctaatagtaatcttaactttggaagagagggctctgtttctggtagaagatttgaaaccggagcacaccgagattcagtacctggaggaactgatgataaatcctctgatcatcttgaaccagatccaagtggtagcacaagcatggtttcttcgtttcctcaacaaggtccaaaaggcgataggtcatctagaggaggaaggggtagaccaaatggaagggattctcaaagaattggagttccaatgccaatcatgcctcctccatttggtcctcttggacttccaccaggaccaatgcagcatatggggccaaatattccccattctcctggtcctcctctcctacctggcgttttcatgccgccatttccagggcctctagtgtggcctggagctcgaggtgttgatgtgaatatgctttctgttcctcccaaccttaccattcctccagttgctccagaacataggtttgcaccaaatgtgggagctgggtctagtcataatatccacttaaatcaaatggacactgggttaggtggtccagcagatatatcaggtttgggttacaataatatgggtcctcaaagccgtgaaatgctccatgataaacctggttggatgccacataggaacagtggaccaaacagaaaagctccttcaaggggcgaacaaaatgattactcacagaactttgtggacactggcatgaggcctcaaaatttcattagagaactggatcttacaagcgtagcagaggactatccaaagttgagagaactcatacagaggaaagatgaaattgttgctaagtcagcttcaccgccaatgtattacaagtgtgacctgcgggaacatgttctttctccagagttttttggtaccaagttcgatgttattcttgtggatcctccatgggaggagtatactcaccgtgcgccaggaatcacagatcacatagaatattggactgctgaggagattatgaatttgaagattgaggttttccccttttctttatcctttctattttgtgatttcatttatgctgcagaattaatatttagaagtgtattttttgaatcaacaggctattgcagatacaccctcctttgtgttcctttgggttggtgatggtgtaggccttgaacagggtcgtcagtgtttaaagaaggtagagcctgctatttccgtacttaaatgactgcgctctatattattattgtaatgccattcgttttgggggatggggtgggatcttgaaatcattttttaggaggtcacccaggttcccgcagcttcaaatcaatttttgccctctgatggaatgtcgtagcaacataaacattgtttcatacttccacagttttatttcatgtatgtgtgttttaattttcagttgttgatgagctgcaataacaagtagatgaggctgactgaaatttttctatgatcagtggggattccgtaggtgtgaagatgtttgctgggtgaaaacgaacaagaaaaatgcagctccaagtctgcggcatgactcacatacattgttgcagcactcaaaggtagtgttgtacttgattagtatgtgatgtatcattttctgccatgcctacatgtctttttcttcttctgtttttctctggttctcatgcgaagtatctaccctttccatgtgcaggagcattgcttgatgggcataaaaggaactgtgcggcgtagcacggatggccatgtcatccatgcgaatattgacacagatataataatagctgaagaaccaattgatggtatttttcctttggtttattagttttgttcctattcttgatgcaatctatactattggcttatgaccaacggcaatcattttcaatgatgaggtgcatacactgagtaaacttgttttctcgaaattttcttctttgctttctttctgttgaaaatggagttccctgatctgtttttattgctgccatggtatgaatattccaattttgtccaccaaaatgtgttactgtgttgtaaatttggcttggttggcaaaaacatctgtcttggatttataggaatttgggattataaac

SEQ ID NO: 170 - DNA, 3254 bp, Zea mays
gtcatcgacaagattgaacgctacaaagtgagtctggttgatgggagttgtaacagaaccatcagtgaccagtggaggctgaggtgtgccactacgggtaccagtagcctattattcgtggtaactctacggttcaaggggaaaggtgaggggaggggtcgacgacgacaacgcgaaggagccggtgaccacggcggcacaagtgatggggagacatggtgttactatttgtgtgactggtgagggtgaaatgatggtctaaataacattggctattggatttgagtaagtaagagagaggaagattatctaacgatctgaaccgttggtcttgagagtatcgctcgatggatttagagagggttatggatgtaggagtgatttggtcatatggattttataagaatttgagagtgttgtttgatggatttaggaaatgttatgggtgtaggagtgatttgacaggatgggttttattataaagttaaagctggtgggttatacaaggagtatagtcgtatagacttggtgagactctgtctcctgcttgcttttctgtttgagttctgatgggcctcggcctcttttaatattcagagacctggtttgaagcaagatactactgattttgcctggtgggccggacgggcggtggacggtctccatttgccaagctgcttgtacagttgtactcgcagaacttgcttcatgaccatgagcacaagctagcaacatgcaacattgcagttgcagatatatagtacatatttttttttggaaagggcggttgcaggttgtagctactgagataaaggatttttttataatgaccgctattagcaaaaacagttgaccgaacgaagtggtcgacgtccccttccggtcgacaacatttctgaagcatgcatgaatctgcttgttaaattattgggtgcgaccaagtagctcgtgtgtacatgcgcgtttacgggtatatgtaaggtgcatgcgtttctttgtccttttgacacagtccttagttctgcgccgaaacttttacgctatcatcactgtcatggtctctataagaagtcataaaaatagataaagctactatacaatcaagttttccgtatagtatagtcacgccgtatataattaaactatcagaaattataaaaaagaactcaaaaaacccatagatatgcagtattattcactctatttttctttaatatatgttttgatttacgatgaattagaatctaaaaaagacatggttattttacgaagcatgattggatccggacccccatgcattcacattcacttacgcgccgatgtggcatcatccgatcatcggtggcggcggcgatcaggtctggagctcggagtcggacgcggtcctggtcgtcccaactccaactccatgcagcgcttacgtgaaaggcgaagccgacaagaaagagacgagagctcgaatcaccgggctccacctccatgacacgtgagcagctgaaccggtccggtcccgcccggtcccggccccagcagcttcgccacccacccaccacgacaccacacctcagtcctcctcacacaaaaacgccaaacattttaaagcccccgcctccttccccgcggaaccaattcatcccccctcttctgtccagtccattcccccattctcttctcttcacgattccgcgggcgcggaagcccgaagcggcggagagatgtgggtgttctacatgatatcgctgccgctgacggtggggatggtggcggcgacgctgcgctacttcgcgggccccgccgtgccggcccacgtcctcgccgtcgtcggctacgcatggctctcctccctctccttcgttgtcctcgtccctactgacatctggacggtgcgcctccctcccgccgtgctgctagagtgcagagtgtgctaatgctgtgcctgtgcgtcgccgcgacctctccgccgctccgcttagtgcgcgcgctatcactattcactaattaacagagatcatttgcgcgtacagccgggttaccagtaaactgtgctggttgcgttgcgcggtcgtgcgactgcgggagatgggagccgttttggttaggacactggtaatgtagcgtcagaatcggagtttggatgaaccatatccatttctgaacctgttgctagtttactaagaaatgatttaaactggattaacttatgaataatggtggttcgatagcgtacccagtagtctggtaggtaatagtctcgatgccaaggtactgaaggtaggaattcgtggaaactgtcacaatcaagaaagtgattggggttagatggcgatctgaaatcgtcaaattggcattgggctggttctatgactcgtcaacggagtttgttgttgaaatttaagcacaccatcaacatcgataaagcaagtaggttttttatcgtcgctgtttggaaatggtctttagtaatataataataataattgcagatgaaaagaccatcaagatcaaggtgttgttacttgttacgctatgagcgcgatgtgcgctgggtctgcggcgtagtctgctttcattccgttggcctgacccgttatgccatttttctgactcgcaggcaatttctggcaacggcaatcagaagagtgacgtcgggttcttttggagctggtcgtattggagcacgtttatcctagcatggtatgccagtgaccgaccacaaaggctcgtgttctgttaatcgtccttctggttgcagatttgcagcgctgcaagatttcgaacggcattagtgatgttctctgtgtttctaataatgagctcaaaacatgacatgtcctttgcataatgttaatgcagtgtgaaacttctgcataagcattgaacttttaactgaccagttggtcagcgttcttttcttgagaaaaaattggtcaacgtctactgaatatttttttctctcaactagataaattggatcctttgagatggtcgcttgtcctgcattctacaagtagtactatctatgaacaatatgatcaaatcctgacatccagatcggcattgctgttttcattatcaggataccatatttatgatgagctctcactgacataagagcagttcttactggccttcctagttgctttcttcttatgaattgcttactttttttcagttctctaggttcacagttattaggtcgtttattaacatgtgcatttttgcagtactgtcatttgaaaagtggacaagttgtc

SEQ ID NO: 171 - DNA, 3254 bp, Zea mays
tagcgaaaactttgaagcttttcaaagccctaaattatgtggtagatttacataatgatccaacatgttgtttcacgcgctccaccatcaactaaaattcaacaaaatgaataacttgagtatgggaccaacataattagatggtcgcaagccgattaaagttaagtgttttaaagagtgagataactttaaaagtatttgaatttctatatgcagatttttcaagataaactattttgcagagttacgacctctttcaatggaaaaatagttaatggaagaaaaattatatttccactttcattactcttttctaaatgtcgtactgcaagacatacttgtttaggcatgttaccttaaaacatatataatgatatttgcaatgttcctcagttgtgaacacatcaacccaagtttaaggccaatcaaaacatgagtatgggactaatgagtattaatttcatataagtttactgcatgatatatcgatttctagtgtgtgtcaacttcgatgcattttgaagccctaaatgttgtattgtttagacatacagtttttacggatggacccaacttattgtttcgcatgcaccatcattaaccaatgttcaagacaaccataacatgagtatgcgaccctagattgcagcatgcttgcactagatttggtcatatgaaggatgaggtgactctagaagcgcttgaagcataacatgtagattttattcagatcatcactttactatagacgtgagctatccaacatgttgtttcacatgcttcatcatcaacccaagtgcaagacaacctatagcatgagtttgggcccaagatattggatgttcgaatgctggcactagagtttgtttgatatgaagaatgaggtaacttcagaaatgtttaaagtgcaacatgtatatttttaagatcggtaattttccagagttgagagctatatttatgcaatttttcttttatttcgatccatgttttaagatactttgttattattctattacaattatatcaatgatatttataacaaaagaattaaatatagaaaaaaatttcattccaattttaattacaatttgctttatgccagactataaataacattagtttaggcatgctgttttaaaccatttgtagtgctattttgaatgattcttggttatgaacaatagtgcatgttttgaggccactcaaaaaacaaatatgggactcatgatatttatcaaaatacaatttaaccaaggaaaattacattacaattttttattgccaaactgtaaacataacttgtttaggcatgttatctcataagatatgtggaaagatttaaatgtttcattgttatggacattaatgtaagttcgtagcagttcaaagcccttaatgacgtaatgtttggaacggtagtatttacaaaaatgacccaacaagatttgtcatcaatgttttcgcaatacactgattgggagtaaagtgtcatgattttgtgcatgttttttcgaaaagattgtggcatgaaccgtacgaaaactttgtagctttttgaagccctaaattatttggtagatttacagaatgatccaacatgttgtcttacacgctccaccaacaactaaaattcaacacactcaataacttcagtatgggacccacataattagatggtcgcatgccgattaaggtttagtgttttaaaggatgaggtaactttagaagtatttgaattgcaatatgcagatttttcaagataaactattttgtagagttacggtgtctattaatggaaaaatagttaatggaagaaaatttatatttatactttcattactcttttctaaatgtcgtactataagacatacttgtttaagcatgttaccttaaaaacatatatagtgctatttgcaatgttcctcagttgtgaacacatcaacccaagtttaaggccgatcaaaacatgtgtatgggacaaatgggtattatattcgtacaagtttgctgcatgatatatcgatttctgatgtgtgtcaacttcgaagcattttgaagccctaaatgttgtattgtttagacagacagtttttacagattgacccaacgtgttgtttcgcatgcaccatcattaacccatgttcaagacaaccgtaacatgagtatgcgaccctagattgtcgcatgctagcagtagatttggtcatataaaggatgaggtgactctaaaagcgcttgagcagtagattgtcgcatgctaaccgtaacatgtagatttttttttcaaatcatcaatttactacaggcatgagctatgcaacatgttgtttcacatgcttcatcatcaacctaagtgcaagacaacctatagcatgagtttggggcccaagatattggatgttcgaatgctgccactatagtttgtagatatgaagaatgaggtaactttagaaatgtttaaagtgcaacatgtatattttttagatcggtaattttccagagttcagagctatatttatgcaattctgcttttattttgatccatgttttaagattccttgttattattctattacagttatatcaatgatatttataacaaaagaattaagtaaagaaaaaatttcattccaattttaattacaatttgctatgctagactataaacaataacagtttaggcatgctatcttaaaccatatgtagcgctatttttaatgattcttggttatggacaacaacgcatattttggggccactcaaaaaacaagtatgggactcatgatatttatcacaaaagaatttaaccaaggaaaattacattacaattttttcattgccaaaccataaacatcacttgtttgggcatgttatctcataagatatgtggaaaattttcaaatgtttcatggtgatggacattaatgtaagtttgaagcggttcaaagccctaaatgatgtaatgtttagaacagtagtttttacaaaaatgactcaacaagttttgtgagtaaagggtcattatttcgtgcatgttttttcgaaaagattgtggcatgaaccatgcaaaaactttgaagcttttcgaaaccctaaattatgaggtagatttaaagaatgatccaacatgttgtttcacacgctccaccatcaactaaaattcaacgcactcaataacttgagtttgggacccacatttttagatggtcgcatgctgattcaatttcagtgtttttaagaatgaggtaact

SEQ ID NO: 172 - DNA, 3253 bp, Zea mays
acctcatcctttatatgaccaaatctactgctagcatgcgacaatctagggtcgcatactcatgttacggttgtcttgaacatgggttaatgatggtgcatgcgaaacaacacgttgggtcaatctgtaaaaactgtctgtctaaacaatacaacatttagggcttcaaaatgcttcgaagttgacacacatcagaaatcgatatatcatgcagcaaacttgtacgaatataatacccatttgtcccatacacatgttttgatcggccttaaacttgggttgatgtgttcacaactgaggaacattgcaaatagcactatatatgtttttaaggtaacatgcttaaacaagtatgtcttatagtacgacatttagaaaagagtaatgaaagtataaatataaattttcttccattaactatttttccattaatagacaccgtaactctacaaaatagtttatcttgaaaaatctgcatattgcaattcaaatacttctaaagttacctcatcctttaaaacactaaaccttaatcggcatgcgaccatctaattatgtgggtcccatactgaagttattgagtgtgttgaattttagttgttggtggagcgtgtaagacaacatgttggatcattctgtaaatctaccaaataatttagggcttcaaaaagctacaaagttttcgtagggttcatgccacaatcttttcgaaaaaacatgcacaaaatcatgacactttactcccaatcagtgtattgcgaaaacattgatgacaaatcttgttgggtcatttttgtaaatactaccgttccaaacattacgtcattaagggctttgaactgctacgaacttacattaatgtccataacaatgaaacatttaaatctttccacatatcttatgagataacatgcctaaacaagttatgtttacagtttggcaataaaaaattgtaatgtaattttccttggttaaattgtattttgataaatatcatgagtcccatatttgttttttgagtggcctcaaaacatgcactattgttcataaccaagaatcattcaaaatagcactacaaatggtttaaaacagcatgcctaaactaatgttatttatagtctggcataaagcaaattgtaattaaaattggaatgaaatttttttctatatttaattcttttgttataaatatcattgatataattgtaatagaataataacaaagtatcttaaaacatggatcgaaataaaagaaaaattgcataaatatagctctcaactctggaaaattaccgatcttaaaaatatacatgttgcactttaaacatttctgaagttacctcattcttcatatcaaacaaactctagtgccagcattcgaacatccaatatcttgggcccaaactcatgctataggttgtcttgcacttgggttgatgatgaagcatgtgaaacaacatgttggatagctcacgtctatagtaaagtgatgatctgaaaaaaatctacatgttatgctttaagcgcttctagagtcacctcctccttcatatgaccaaatctagtgcaagcatgctgcaatctagggtcgcatactcatgttatggttgtcttgaacattgtttaatgatggtgcatgcgaaacaataagttgggtccatccataaaatttgtctatctaaacaatacaacatttagggcttcaaaatacattgaagttgacgcacaccagaaatcaatatatcatgcagtaaacttatatgaaattaatactcattagtcccatactcatgttctggttggccttaaacttgggttgatgtgttcacaactgaggaacattgcaaatgtcttaccgtacgacatttagaaaaagagtaatgaaagtgcaaatataaaatttcttccattacatatttttccattaatagaggtcgtaactctgcaaaatagtttattttgaaaaatctgcatatagcaattcaaatacttttaaagttatctcattctttaaaacacggaactttaactggcatgcgaccatctaactatgtgggtcccacaatcacgttattgattgttttcaatattagttgatggtggagcgtgtgaaacaacatgttggatcattctataaatctaccacataatttagggcttcgaaaagcttcaaagttttcgcatggttcatgccacaatcttttcgagaaaatatgcacgaaatcatgagcctttactcccaaatcagtgcatgtgaaacaagttgggtccatccgtaaaaactgtctgtctaaacaatacaatatttagggcttcaaaatgcatcgaagttgacacacatcagaaatcaatatatcatgcaacaaacttgtatgaaattaatacccattagtcccatactcatgttttgatcggccttaaacttgggttgttgtgttcacaactgaggaacattgcacattgcactatatatgttttaaggtaacatgtctaaagaagtatgtcttacagtacgacaattagaaaagagtaatgaaagtgcaaatataatttttctttcattaactattttccattaatagaggtcgtaactctggaaaatagtttatcttgaaaaatcttcatattgcaattcaaatacttttaaagttatctcattatttaaaacactgaactttaatcggcatgcaaccatctaactatgtgggtcccacaaacacgttattggttgttttcaatattagttgatagtggagagtgtgaaacaatatgttggatcattctgtaaatctaccacataatttagggcttcgaaaagcttcaaagctttcgcatgattcatgccacaagcttttcgagaaaacatgcatgaaatcatgaccctttactcccaaatcagtgtattgcaaaaactttgatgacaaaccttgttgggtgctttttgtaaacactaccattctaaacattacatcatttagggctttgaactgcttcaaacttacattaatgtttataaccatgaaacatttgaactctttccacatatttgattagataacatgcccaaacaagtgatgtttacagtttggcaatgtgcaaattgtaatataattttccttggttaaattgttttatgataaatatcatgagtcccatacttgttttttgagtggcctcaaaacatgcaatattgtccataaccaagaatcatttaaaatagcactacatatattttaacataacatgcctaaac

SEQ ID NO: 173 - DNA, 3252 bp, Zea mays
acatatggtttaatatagcatgcctaaactagtattgtttatagtctcgcataaagcaaattgtaattaaaattggaatgaaattttttatatatttaattcttttgttataaatatcattgatataactctaatagaataataacaaagtatcttaaaacatggaccgaaataaaaagcatgattgcatcaatatagctctcaactccggaaaattatcgatctaaaaaatatacatgttgcactttaaacatttccaaagttacctcattcttcatatctacaaactctagtgctagcattcaaacatctaatatcttgggccccaaactcgtgctataggttgtcttgcaattgggttgatgatgaagcatgtgaaacaacatgttggatagatcacgcaaatagtaaattgatgatctgataaaaaatctacatattatgcttcaagcgcttctagagtgacctcatccttcatatgaccaaatctagtgctagcatgcgacaatctagggtcgcatactcatgttatggttgtcttgaacatgggttaattatggtgcatgcgaaacaacaagttgggtccatccgtaaaaattgtctgtctaaacaatacaatatttagggcatcaaaatgcatcaaagttgacgcacatcagaaatcgatatatcatgcattaaacttgcacaaaattaatacccattagtcccatactcatgttttgatctgccatacacatggatagatgtgttcacaactaaggaacatagcaaatagcattatatatgttttaaggtaacatgcctaaacaagtatgtcttacagtacgacatttggaaaagagtaatgaaagtggaaatatattttttcttccattaactatttttccattaatagatgtcgtaactctgcaaaatagtttatcttaaaaaatctgcatattgcaattcaaatacttttaaagttacctcattctttaaaacactgaacttcaatcggcatgcgaccatctaattatgtgggtcccatactcatgttttgattgtgttaaattttagttgctggtggagcatgtgaaacaacatggttgatcattctataaatctaccacataatttagggcttcgaaaagcttcaaagttttcgcatggttcatgacacaatcttttcaagaaaacaagcacgaaatcatgacccttcactcccaaatcagtgtattgtgaaaactttgatgagaaaccttgttgggtcgttttgtaaaaactaccattctaaacattacatcatttagggctttgaaccgcttcaaacttacattaatgtccataaccatgaaacatttgaaatctttccacatatcttatgagataacatgcccaaacaagtgatgtttacagtttggcaaagagcaaattgtaatattattttccttggttaaattgttttgtaataaatatcatgagtcccatacttgttttttgagtggcctcaaaacatgcactgttgtccataaccaagaaatatataaaatagcactacatattaagatagcatgcctaaactagtattgtttatagtctcgcatagagcaaattgtaattaaaattggaatgaaattttttctatatttaattcttttattataaattgatataaatgtaatagaataataacaaagaatcttaaaacatggatcaaaataaaagcagaattgcataaatattgctctcaattccagaaaattacaaactctagtgccatcattcgaacatccaatatcttgggcaccaaactcatgcgataggttgtctatgttttaaggtaacatgcctaaacaagtatgtcttacagtacgacatttggaaaagactaatgaaagtggaaatataatttttcttccattaactatttttcctttaatagaggtcgtaactctgcaaaatcgtttatcttgaaaaaactgcatattacaattcaaatacttttaaagttacctcattcttcaaaacactaaactttaatcggcatgcgaccatctaattatgtgggtcccacactcaagttttgattgtgttgaattttagttgctggtggagcgtgtgaaacaacattttggatcattctataaatctaccacattatttagggcttcgaaaagcttcaaagttttcgcatggttcatgccacaatctgttcaagaaaacatgcatgaaatcatgaccatttactcccaaatcattgtattgcaaaaactttgatgacaaaccttgttgggtcgtttttgtaaaaactttcattctaaacattacattatttagggctttgaacgtcttcaaacttacattaatgtccataaccatgaaacatttgaaatctttccacatatcttatgacataacatgcccaaacaagtaatgtttacaatttggcaaagagcaaattgtaatgtaattttcattggttaaattgttttgtagtaaatatcatgagtcccatacttgttttttgagtggcctcaaaacatgcaccattgtccataaccaagatatatataaaatagcactacatatggtttaagatagcatgcctaaactagtattgtttatagtctcgcatagagcaaattgtaattaaaaatggaatgaaaatttttctatatttaattcttttgttataaatatcattgatataactataatagaataataacaaagtatcttaaaacatggatcaaaataaaagcagaattgcaaaaatatagctctcaactccggtaaattaccgatctaaaaaatatacataatgcactttaaacatttctaaagttaactcattctccacatctgtaaactctagtgctagcattcgaacatctaatatcttgggcccaaactcatgctataggttgtcttgcacttgggttgatgatgaagtatgtgaaataacatgttgggtagctcacgtctatagtaaagtgatgatctgaaaaaaatctacatgttatgctttaagcacttctagagtcacctcatccttcatatgaccaaatctagtgcaagcatgctgcaatctagggtcgcatactcatgttatggttgtcttgaacattggttaatgatggtgcatgcgaaacaataagttgggtccatccataaaaactatctatctaaacaatacaacatttagggcttcaaaatacatcgaagttgacgcacaccagaaatcaatatatcatgcagtaaacttatatg

SEQ ID NO: 174 - DNA, 3251 bp, Zea mays
cccgattttattaaccccaatctgatcttatttgtcacttgaagatccaacgaccctagccaaatcgcgtgctgatcacatctgagcccttgcattcaaagtccacggctccgatcaataacccgaaatgacatcccatgttttaatcatagtcgtagccacgagatcggacgacggcgagcctatctcctctcctacctggttaccagcccggcagtggtcacagccaccaccacggatgggatcgacggagtaccgtatgccgagagtcactacttgaggtaggggacaaggcgaagctaggagaggatccttaccacaaattagggcacagagaggaccgcccatggtgcagcgcggccctaaagcgaagatcggacatcagcgaccaatcaaaggtcccccaaccctagtttcgcccgctgaagccccatgcaggttcacggcgaccaggtgaagctccaaaaccagctacgccccccaattttacgcacaggtggatatcccccaatcactgatccgacgaaaggctcacggcggcacgggtggaggaatcacggccgcgctagagctttatacgccacgaatagggtgacaaggccgaagttcgcatcataacaacctagcgacaacccctccccaagaatcccgatgctacaccactcttttgtgtcatacacgtatgccctagtattatactgtcagtgggccaggctaccacacatgttcttttatattagactgacatgtggggccatcttttggggaaagaggaaagctacaaaaggagatcatgcagtagagtaaggaagggggagagaaaatcagaaaagactcttgttctcgttgtcttcctcacgaagacacggtccagatgagcttctcgatcgcctcacgtctcggtcttcaccgccggcggccacggggcatgacaagtggtatcaaagcctcggtgatcctcgccaagggtgcatcagcggtggttgggtgctacgatcggaagcggaggagcggctgcgacttcgtcgattcggagccttcaaacttcggcggcgacgcgacgctactcgggaggcgagacggtggcgctggtggcggtgatttgcatttggtgatgagtggcggcggtggaagtgtgaccagtttcctgcggtgatgtttgaggtggctgcccatgaggtgttcgatggcatgcctcgttgggataatgatacaatacgagttcagcaagttgcattcgaggcttcaatggtgtcgacaacacccgcacatgagctgttcgacgaaaatcctctcgtgaaggtgatatgggatgaggaatcgcatcatggttttgatccatatcgtctagagcagcagtgcaagctgacagtgttcaaggcaccaatgatgtcttagagtgatatgcacaaagtgtttgatccactttctagccagattgtgtggggtgatgagttgctgcaaagttatgagccccacgacagtttacttaagctggtggctcacggagactttatggttggtgaggccacaatgcatgctgagccatatgacatagtggtgcgggatgagaggaggcctcagaactttgtctcgcatcaaggtataatgcagcagctagcaaatggtgaagagtatatgactgatgaaaagacacataatattgttgagcttgctaccaatgatggatctactcatgccagggactctccattatttttagacctagctatggatattacaaaccaggtacttgttgtagatcctaattcagacaccaaggaaggcacaacatatgagcctgagcagttgtaccatgaatcacaagtaagaaattcggaatagaaggccatccatatgtgtcttccgtcatggacaggtggcttgagaccatggagaacagtcactcaccaggtgcttgaggacatgtcagtagggaggcaaattaattttagttgtggaagcaatgaacacctatataagctatactgtgactttccagactgcagctttactaggttgctcagtgatagaagtctgaactctgttttatatctctattatgcctcttattggttggatgtatatgagttgcgctctcttacatttgttggtgcatggtccactatcaactacagctctaatacaaagaagatgtgtgatgcagcaaagttggagtctttgctttattttgatgtcaacatgtttacacttctcttagatttctccacaagtccatcagatcctcgtattaccatggaggattccacaactgaaatgtatgaggcagtgcggctgtttgaggctactgtaatgttgacattctgttcaggaggtaaagcacttggaataatgggcatacagtatttggatgcatatagagaaaagcaggttgccaagttgaacactgataacttggttgccaatgtcaaaaaaccatatctcctacttgagctcggaatggttcatacagaccaggtgatcgataacctacacaacaagggtcaggaagcaaaaattttagaagccttagtagcatacatatacaggtccaattttcatgtcaccaatgggcaaaaacagcaacaacaaggaggcaatccgatggagattacgtctttaagtgatgaagttcttggatctctttgtcttgccaacaaagactatggccgataggtcgaccgagatcatatggtcatgtttcttacttaccatggtccttctgatagtcacgagctaaatcaagatggtgagatattaatcgttgttggcaaacttccaccgtggagtgctgcatgtcaaatgttagatggactactatcctggaggcaccatcccttatgtctagggatatttggaaaatatgtgggcaagcttaattattccagcataggaagaagtgaggtatcaaaaattcaaatccagaattacccaaagctttatctcgcattatttggacatgagattctgcatattcagatttctgtaaattcagtgatggtgcaactgaggttcggttttccttggacctgccaacttttgatattgcaaatcttcactacacagtgtctgtttggaaattttgttgctagtcagtgcttcagctcatttgatcttggagtacaaacgtacagtcatctgacactcccatactattcacgtgttggtcacactatagtgagtgtcaaagccctgcaagttccatgggatccaggtggttcgagttgcaagctacacacaaaattacaaaa

SEQ ID NO: 175 - DNA, 3245 bp, Zea mays
gatacattgtgggtgtccacacagttgcaccatgcccccgcctcgagaatcccgccctcgactaccaccgaccccgcggtaccgtagcgaccccgttcatcccgccgcccaccacgcacggactgcctccctccctccaccccggctgctgccgacagcgcgctaccctcgtgaccccgttcatcccgccacccccacgcacggactgcctccaggatgctcggccctaacagcgccctacctccctcccccacctcgttcatcccgcccccattcatcccgtgaacccatccccgcgctcccctcctctaccccatccatctcgccgtcgtcctcgcccgccctgcctccaacgatggggagccccatccgcaacctcccgcagtccccggtcacgccagcaacgcctcccagattcttccccgttcatcccgccgcccaccacacacgtactgcctccctccatccaccccggctgccaccgaccgcgcgctaccctcgcaaccccattcatcccgctgccccacacacggattgcctccaggatgctcggccctaaccgcgccctacctccctcccccaccctgttcatcccgtgaacccatccctacgctcccctcccctaccccatccatctcgcctgccctgcctcccacgatggggagccccatccgcgacctccctcaatccccggtcacgccagcagcgcctcccagattcttccccgttcatcccgcccccgcccgtgatccctccccgcgctcccctccgtgaccatcggactcccttcgatggtgcggcccttccatcgacgccgacccgtactgctatttaaaaaatccaaagcgatgatgccaccccacccccatcctcctcggatgtgcagaaatatcaaacatcactaaggtgcgtcaactctattcttgatacttctgtttctgttgttctcaaggatttggattcaacattgtactagcagtttggaatcaccaggcagtgatgctttccatctagccttgtttagtagtgaagacaaaaacagtagtgaatcaggttatgtaatttttttcttttagattatgtgtaatatatttttgcttgaacgtctcggatttaactaatgttgtttctgttgtaatcaacatggtatcactgtttagggtttagggtgctccttactggcattgggcttcagttgaaacccatttaacatccgaactgttcggcattacaattcattgtatagtatcatgtggttgaagctccttactggcactgggcttgtttacaaactattttactaaacagttgaatccaattttaatttgaactcatagtatacatgattctatataaatcatgtctcattcacaagctttccggttcttcatttcagagctctaaagccgattacgtacacctcttcttaccacgtacgcactttaatctgctttctggtttagagcgcagtctcctcggcaacttcttctactgctaactcgggtgcaaggcaaggtacacatatatttcatatatagtagttgtattcaacatgatggtagctgcgaggaggattctattcagtatttatttggaaatgtagttctgaggcaatcccttggtgttggttgatttgtaaacctacaagttagacttaacacgcatcccacatctctaggctttccttattgcattgggcatgaactgattgctggtatgagttgatctttggagtgttttctaaaaggtttaagcacaatgggcatgggtacaaactaattggccaagggtttacactgttttttcatgataacacttgatacatagaaaatagacatatggtttttatgtttgaccatatttcggtaaaagcctcatgatggtagctgcgagcaggattctattcaggatttatttggaaatgtagttctaaggcaatcccttggtgttgtttgatttgtaaacctacaagttagacttaacacacatctcactgttggttgattttgtaacggtggatttaaacttaacgctatgagtagtactgatggtgtctcccattgtgggaaaagccctttcggtatcaacttttgacaacaaaaaatgacatttggtttacacatgatctagaatgccgattgcttcacatctagatgtccttgttagtggtgttatatgcttcacccatgatggtattgactaaaattgtgatgttgaacaatagtggctcttagttgtttctagtctagctacttggaatactgccaatagaaatcataatagtgccagtcagttattttggcaaaccattatccaacaattgttgcaggggtacggtcgatagtcatatgttttttgtgtttatcatttgtgcttgaaggtggtctgtttacagacaacgctcaactgccatataaatattcacactatgttccaaataaaactgacataaatatctgcactgttaggagatgaatcactaaacaccgtctatgatctgaccatacctatgctctgtttagccagtgcttgtcactgcgggcgaggttttcattatcataagagaattgcatcttcttttcattatcataagcatgtacctcggaaaacttgtatttaagaaacccaaatcaacgctgtctcaccactacgacgcaccctctagattttatctcccctgaagtttgtgttcctatagtttgtgttcctcgataactgtactactaaaaacagaccatatttctgatagtaatttgttctgtgacctgtgacacttgagggccatcttttgtgtcattcatgtctgttttgggtttggggtttttgtgtgggggataatagaaatacaaccagtcaagtgattccccatttgtttttgtttggagataatagaatacagttattctctagcttttttgtgttaatagaaataatagtttgcagtgggaaaagtgccacaacatgtcttttttttatgcaatggaatcaatctcgcttttttaataatagattgttgtgcggcaatagctgtgtaaaccagtcttagtctcttgtactaaaaacacatcttactaaaaaaggtactggatggagttcaaaaacagcagggaagataaaatatacagagtttagttccttttgtcacaacactatgaattattctttttgttaggtgtgttcatatgccatggacaatctaaaatgaacaatcttaatctcgttgtttctgaatgtgatgtgctctt

SEQ ID NO: 176 - DNA, 3244 bp, Zea mays
cataatatcagtggataaaacagatgctaaattttaatcatcttcgcctatcgcgattttaatatcgcatctgtttcgtttgtcgcgagttcgacatcgtttttatctatccgagctcttcctaaattgtcgtgatgttcggacatagttgttccgaaaatcggtgcgtccggtgattatttcaaactcatcgctcgcgcgaatacgaattggaagcccgacccactcggatgattttatcccgaacaaattaatttgaactcgacaactaaaatgttcggggcaaaataatctgaatcgtgcattgtctgagaaaaatcatgcgcgagattgctaaccaaggaattataattgagatttgattctccaataaatcatctatggcagagtgatcacgtgtttgagtggtagacgaagttatctgatttcaagtcatttcaaatatagtttaaaatatcagtctcgatctcgtttgggttcattgtatttgcatcctatccgaacccaatattatccgagacaaagagattaatgtttgattttatagcagataatactgggtccgaaagaatactccggatcgcttgcgttaccaagaaaccgtgcacaagattaacaattgggattattcattagtgtgctattctaggtagagaaatcaaatcgattcggaaaacagataaatttttatctgagttcaactaaattaatagagtctcaagtaccgtatccggatagtgttttggtccttgtgtttcttggacagatccaaaacttcggaaataaataacgggtgaaaattcatctaattccgagagtattcaccaaatcaaatcctatctaaatattgttgtcggtctcatttttgtttgatccttttgtatattttttagactctaatttcataccctaaaatatgcgtattttgttgttttaaaaaaaagaaggaaaaatagggaaaatccttctctaaatatttccaccgttcctaggtatgattttcaacgtatttggatttttcactatagaaaatatctctctatcgttgttttcttctcatgtacgtaaacttcctagaatatcattggccgtcatcgatatttttttgccagcaatcgtattcaatgcatttttttccttgtctccgtcgccgcttaagtgggtaaccggtagaatatcttcttctacgtgcgcatcctctcccagccttatcttcttctgcagatttttttcctcagcattatctctcctctccacacggcagcaggcgctcgttctcacatcttcctcctgcagtcgcgccttggtcccggacatcccagcgtcgtcccatctcctccctcctagtcgactctctgctcttccatggctgcttgctccactgcgcagccgctcagctcctcgacctccccttgactttctcaagccgccggtgctcgccaagtcgatctcccatggcagccggtcagcccagctgtccatcgcaagccacgctcctccatcgcgtcgttcctccactcgcccacctcgtccatgtctgtcgtgccgagttcgccctgcacgtagccggcgtttctccctgatgcgctcgcacaaccatctcccatggcgcgcacctcccctgcgcgtccgtctccctggtccaccttcctgtcgtgcctctctccatcgaagctccctgctgctcaccatggcgtcttccagtctctggctcgccctgctccctgttgccacgagctccagcttggattcagcccagctcggatcttttccatggtcgctgcgcactggccctgctcgaattctcgtcgtgcgtacctgggcgctacccaagtggtcgcctgctccaatcgccgcgcccagccgtgttcacccctgcgcgcaatagtgggtttcgctgcgcagcgttcctgctccccgacctccgtcgtgctcggcagcaagtaattcatgtcgaagcagcagctgcgatccctagcgtcgtgctcgccagatcgaacctcgcgttgtcgatctgcgcagttcctgttcggctatcagttccgcctacgtcgatctcctaattgccttggatcgtgtatcgacgtcccattacaacagcccatcgtaaaactctagtgcttgtcgttgatatccggtcgtctccaacctttgtcttgccgtcgtcattcggtcacccgtctcgatgtcggtccctacgtgatgcctccgagttggagtcgtgctgacaaaaaaagccccaagagaagatgtccaaaggttggatggtgcggtgcgtgaagttcggatagtatctgccaagcgctcgagaaattgcctaaatcagagaatcattaccgatctcgcggattcgagtcagctattggaacggtgagccgatttactatttttactattgattttatgatcgtgaaataagacgcttagtttgcgtacaaagtttaagttaaagatgccagcaatgtgaggtgtgcttcaaggagtttagttgccaagtatattcgaactagttctattttgcagagtgtagtatttcggtgacacataggttaaattcagtattttatacgattgtcgataaatctgtcgatggtaattgtgttcagtgcgcgtaagatgaagtcgatgtcctgcgctagtagttagtatcatctatgtttgtgatcgataatgttggagtaggatatgatcgacgattttcttatctagagagtggtgtgatgatgctctacttgataaattaagtatagtgtgatgttttattagttaggatattttaaggattaattcaaaagagtggtttaaatagttagttgagttgtttcggtccatacttcgaatttcgtgttccaaaataatgagtctaagtaattagtctttcggtattatgctttagtcaaataaaaaggtggaactcatatggtctattgttttcctaataaataaatctaggtttgatagtcttctggtgttggaccttagctaagtaaaatagacgtgcgtataatttattattttatgactattgcgcttagtcatatatcgtatgaagtagtacaacgcctcgctgctaggtgtttaattcgcggacatgtagtaatatttagtctcacactattcttgtttatctgcattcatgtgcattatgcaaatcatttaggtacgtttgttgatcacgtgatgcggaggacgatcccaggataatacagagagtgaacatctccgcaagacgacgtcgtcagtc

SEQ ID NO: 177 - DNA, 3239 bp, Zea mays
attcgggcggttccgccacacaccaaacaagtgatgtttacagtttggcaacaggcaaattataatgtaattttccttggttaaattgttttatgataaatatcatgagtcccatacttgttttttgagtggcctcaaaacatgcaatattgtccataaccaagaatcatttaaaatagcactacgtatggtttaacataacatgcctaaactagttttgtttatagtctggcatagagcaaattgtacttaaaattggaatcaaattttttctatatttaattcttttgttacaaatatcattgttataactgtaatagaacaataacaaagtattttaaaacatggatcaaaataaaaacacaattgcataaatatagctctcaactccagaaaattatagatctaaaaaatatacatgttgcactttaaacatttctaagttacctcgttcttcgtatctacaaactctagtgcctgcatttgaacttctaatatcttgggccccaaactcatgctataagttgtcttgcacttggcttgatgatgaagcatgtgaaacaacatgttggatagctcacgcctatagtaaattgatgatctaaaaaatctatttgttatgcttcaagcgcttctagagtcccctcgtccttcatatgattaaatctagtgctagcatgcaacaatctagggtcgaatactcatgttatggttgtcttgaaaatgggttaatgatggtgcacgcgaaacaacaagttgggtccatccataaaaactatctgtctaaacaatacaatattagggctttaaaatgcatgaaagttgatgcacatcaaaaatcgatatatcatgcagtaaacttgcacgaaattaatacacattagtcccatactcaagttttgatcggccttaaacttgggttgatgtgttcacaactgaggaacattgcaaatagcactatatatgttttacggtaacatgcctaaataagtatgtcttacagtacgacatttagaaaagagtaatgaaagtgcaaatataatatttcttccattaactatttttccgttaaaagatgtcgtaattctgcaaaatagtttatcttgaaaaatctgcatattgcaattcaaatacttttaaagttacctcattctttaaaacattgaactttaatcgtcatgcgaccatctaattatgtgggtcccatactcaagttattgattgtgttaaattttagttgatggtggagcgtgtgaaacaacatgttggatcattttgtaaatctaccacataatttaaggcttcgaaaagcttcaaagtttttgtatggttcatgccacaatcttttcgacaaaacatgcacgaaatcatgactcttttactcacaaatcagtgtattgcgaaaactttgatgacaaaccttgttgggtcctttttgtaaaaactaccattctaaacattacatcatttagggctttgaaccaattcagacttacattaatgtccataaccatgaaacatttgaaaattttccacttatcttacgagataacatgccaaagaagtgatgtttacattttggcaatgagcaaattgtaatgtaattttccttggttaaattattttgtgataaatatcatgagtcccatactttttttagtggcctcaaaacatgcattgttaatcataaccaagaatcatgtaaaatagcactacataaagttaaagatagcatgcctaaaccattattgtttatagtctggcatagagcaaattgaaattaaaattggaatgaacttttttctatatttaattattttgttacaaatatcattgatataactgtaaaagaataataacaaagaatcttaaaacatggatcaaaataaaagcagaattgcataaatatagctctcaactctggaaattaccgatctaaaaaatatacatgttgcactataaacatttctaaagttacctcattcttcatatcttcaaactatagtgccagcattcgaacatccaatatcttgggccccaaactcatgctataggttgtcttgcacttgggttgatgatgaagaattgaaacaacatgttgcatagcacacgcttatagtaaattgatgatctgaaaaaatctacatgttgtgcttcaatcacttttagagtctcctcatccttcatatgaccaaaactagtgctaacatgcgacaatctaaggtcgcatactcatgttatggttgtcttgaacatgggttaatgatggtgtatgtgaaacaacacgttgggtccatacataaaaactgtctgtctaaacaatacaacatttagggcttcaaaatgcatcgaagttgacgcacattagaaatcaatatatcatgcagcaaacttgtacaaatataatacccattagacccatactcatgatcggccttaaacttgggttgcagtgttcacaactgaggaacgtttcaaatagcacaatatatgttacaaggtaacatgcctaaacaagtatgtcttttagaaaagagtaatgaatgcagaaatataaattttcttccattaactatttttccattaatagaggtcgtaactctgcaaaatagtttatcttgaaaaatctgcaaattgcaattcaaatacttttaaagttacctctttctttaaaacactgaactttaattggcatgcgaccatctaattatgtgggtctcatactcaagttattgattgtgttgaattttagttcatggtggagcgtgtgaaacaacatgttggatcattctgtaaatctaccacataatttatggctttgaaaagcttcaaagttttcgcatggttcatgccacaatcttttcgagataacatgcacgaaatcatgaccctttactcacaaatcagtgtattgcgaaaactttcatgtcaaaccttgttgggtcctttttgcgaaaactaccgttctaaacattacatcatttagggctttgaaccgcttcaaacatacattaatgtccataaccatgaaacatttaaaaaatttccacatattttatgagataacatgcccaaacaagtgatgtttacagtttggcaatgagcaaattgtaatgtatttttccttggttaaattgttttgtgataaatatcatgagtcacataattgttttttgagtggcctcaaaacatgcattgttgttcaaaaccaagaatcatttaaaataacacttcatatg

SEQ ID NO: 178 - DNA, 3238 bp, Zea mays
aagtggccacaagccacgctagaaggaggctcccgtgtcgaatgcagatgggaacctagggtcgggacctagagagatgtgattagtctgacccagagagatgcgatttctttcaatggcatcatccggtttttcctcaatatatcacgaatttgttgggggacttgcgagacatagtggatgaactgacgaaggagattgatgcattacaaaataaggaacaagaacttaaggactctttggaaggtatgatgcagctattgaatttggagtgaaggtgtagtcgtgttcatgcagccttagcagtaagcccttattttgttttctgcctatttctcttttgtagccatgtcagttatttatactttgttctttttatgctgagaagggcttggggtgctagtgaccaatgtgctggtggttacctccattgtggcaactacgcacaagtagtagcacggaggaagtaaccatcagcatattgggcacacctccaccatccgccgtgacgctctcctggccaaaaggttggtcattgctgcaaggaggactagtcggctcagatgacaggctgcctcagctgctaccaagtcaggctacttagagtttgtagggtgatgtcatttggacctcgacgagatccaccactcgattatattgtactggatgctcacttatttatgttccaaattcagttattctatgatgaacgctcagttgttttatgtgccactcagttattttattctgaatagttattctaatatgtgcaactcagttattgtaatatgtgcaagttatttatgtgccactcagttattctaatggacgcactcagttagtctggtgtcagaactcagttattccattctaatacctcagttattcttgtgggccgactcatttattttcttctcgtgactcagttattctactccaatccctcaattattccgttataataactcagttattgtaacgtacccactcggttattctctgttcacaagtcaattattccgttccagtaactcagttattctagtgtggcgactcagttattcttgtgtcagtactcagttattctggtgacggaactcagttattacgttctactacctcagttattctaatgtgcacactcagttattctgttctaataactcagttattctactgattacttagttattccgttctaatacctcagttattctactgttccgactcagttattctggagtcagcactcagttattctagtgggcgcacttagttattccatgttcatttctcagttattctcggttcagtactcggttattctgtgttcatcactcagttattctggtgacgaaactcagctattctctgctcgtgcctcagttcttgtgggccaactcagttattctactccaatccctcagttattccgttataatacctcagttattctaaaccctcagttattatgttataataccgcagttattccatgttcctaactcagttattctaatgtcggtactcagttattctaatgcgcgccttgagttattccatgttcaccactcagttattcaagtgacagaactcagttattctactccaatccctcagttatcccgtgtcatacctcagttattgtaatgtgcctactcagttattatatgttcatgactcagttattccgttccaacaactcagttcttctaatggacgcactcagttattctggtgccagaactcagtaattctgttccaatacctcagttattcttgtcggctaactcagtgattatgatgtgcagactcagttattctggtgtcggcactcagttgttcggttctgatccctcagttattctactccaatccctcagttatcctgtatcatacctcagttattgtaatgtgcccactcagttatgcggtgtttattactcagttattctctattcacattcagttattgcgttcaagtaactcagttatgctattgttcattactcagttattctgttgtgcacactcagttattctattgttcactattcagttattatctgttcattactcagttattctgttccaacaactcagttcttctaatgcacgcactcagttattatggtgacagaactcagttattccgttccaataccttagttattcttgtgggctaactcagttattctcctccgatgcctcagttatcatcatacctcagttattggaatgtgcccactcagttattattgtgtacagactcagttattctggtgtcggcactcagttgttcggttctgatccctcagttattatgttataatacctcagttattgagatgtgccgactcagttattccatgttcgtcacttagttattcttttgtcggaactcagttattctaatgggcgcacatagttattctggtgtgatgactcagttattctcgtgtgcctactcacttattctctgctcattactcagttattctctttgtaatcactcggtagtggggactccgttattctctattcacagtcagttattgcgttctattaactcagttattccatgttcgccactcagttatttcattccaacaactcagttattctaatggacgtactcaattattctggactaatacctcagttattcttgtgggccaactcagttattctactccgatcccttagttattccgttctaatacctcagttattctctgctcatgactcagttattctagtgggcgcactcagttattccatgttcatgtctcagttattctggagtcggtactcagtaattctagtgggcgcacttagttattccatgttcatttctcagttattctcggttcagtactcggttattctgtgttcatcacctagttattctagtgatggaactcagttattctctgctcatgcctcagttcttgtgggccaactcagttctactccaatccctcagttatttcgttataataccttagttattccatgttcttaactcagttattctaaaccctcagttattatgttataataccgcagttattccatgttcctaactcagttattctaatgtcggtactcagttattctaatgcgcgccctcagttattccatgttcaacactcagttattctttgtacgttactcaggtattgtgcgttcattactcagttattctagacgacgcactcagttattcgagtgacag

SEQ ID NO: 179 - DNA, 3231 bp, Zea mays
gaaacccttctggattccccacgggtccaggctaccgacaggtacatgcggaagtggccacaagccacgctagaaggagggctcccgtgtcgaatgcagatgggaacctagggtcgggacctagagagatgtgattagtctgacctagagagatgcgatttctttcaatggcatcatccggtttttcctcaatatatcacgaatttgttgggggacttgcgagacatagtggatgaactgacgaaggagattgatgcattacaaaataaggaacaagaacttaaggactctttggaaggtatgatgcagctattgaatttggagtgaaggtgtagtcgtgttcatgcagccttagcagtaagcccttattttgttttctgcctatttctcttttgtagccatgtcagttatttatactttgttctttttatgctgagaagggcttggggtgctagtgaccaatgtgctggtggttacctccattgtggcaactacgcacaagtagtagcacggaggaagtaaccatcagcatattgggcacacctccaccatccgccgtgacgctctcctggccaaaaggttggtcattgctgcaaggaggactagtcggctcagatgacaggctgcctcagctgctaccaagtcaggctacttagagtttgtagggtgatgtcatttggacctcgacgagatccaccactcgattatattgtactggatgctcacttatttatgttccaaattcagttattctatgatgaacgctcagttgttttatgtgccactcagttattttattctgaatagttattctaatatgtgcaactcagttattgtaatatgtgcaagttatttatgtgccactcagttattctaatggacgcactcagttagtctggtgtcagaactcagttattccattctaatacctcagttattcttgtgggccgactcatttattttcttctcgtgactcagttattctactccaatccctcaattattccgttataataactcagttattgtaacgtacccactcggttattctctgttcacaagtcaattattccgttccagtaactcagttattctagtgtggcgactcagttattcttgtgtcagtactcagttattctggtgacggaactcagttattacgttctactacctcagttattctaatgtgcacactcagttattctctactcattactcagttattccattctaataactcagttattctggtgtcagtactaagttattctggtgacggaactcggttattacgttctactacctcagttattctaatgtgcacactcagttattctgttctaataactcagttattctactaattacttagttattccgttctaatacctcagttattctactgttccgactcagttattctggagtcagcactcagttattctagtgggcgcacttagttattccatgttcatttctcagttattctcggttcagtactcggttattctgtgttcatcactcagttattctggtgacgaaactcagctattctctgctcgtgcctcagttcttgtgggccaactcagttattctactccaatccctcagttattccgttataatacctcagttattctaaaccctcagttattatgttataataccgcagttattccatgttcctaactcagttattctaatgtcggtactcagttattctaatgcgcgccttgagttattccatgttcaccactcagttattcaagtgacagaactcagttattctactccaatccctcagttatcccgtgtcatacctcagttattgtaatgtgcctactcagttattatatgttcatgacttagttattccgttccaacaactcagtacttctaatggacgcactcagttattctggtgccagaactcagtaattctgttccaatacctcagttattcttgtcggctaactcagtgattatgatgtgcagactcagttattctggtgtcggcactcagttgttcggttctgatccctcagttattctactccaatccctcagttatcctgtatcatacctcagttattgtaatgtgcccactcagttatgcggtgtttattactcagttattctctattcacattcagttattgcgttcaagtaactcagttatgctattgttcattactcagttattctgttgtgcacactcagttattctattgttcactactcagttattatctgttcattactcagttattctgttccaacaactcagttcttctaatgcacgcactcagttattatggtgacagaactcagtaattccgttccaataccttagttattcttgtgggctaactcagttattctcctccgatgcctcagttatcatcatacctcagttattggaatgtgcccactcagttattattgtgtacagactcagttattctggtgtcggcactcagttgttcggttctgatccctcagttattatgttataatacctcagttattgagatgtgccgactcagttattccatgttcgtcactcagttattcttttgtcagaactcagttattctaatgggcgcacatagttattctggtgtgatgactcagttattctcgtgtgcctactcacttattctctgctcattactcagttattctctttgtaatcactcggtagtggggactccgttattctctattcacagtcagttattgcgttctattaactcagttattccatgttcgccactcagttatttcattccaacaactcagttattctaatggacgtactcaattattctggactaatacctcagttattcttgtgggccaactcagttattctactccgatcccttagttattccgttctaatacctcagttattctctgctcatgactcagttattctagtgggcgcactcagttattccatgttcatgtctcagttattctggagtcggtactcagtaattctagtgggcgcacttagttattccatgttcatttctcagttattctcggttcagtactcggttattctgtgttcatcacctagttattctagtgatggaactcagttattctctgctcatgcctcagttcttgtgggccaactcagttctactccaatccctcagttatttcgttataataccttagttattccatgttcttaactcagttattctaaaccctcag

SEQ ID NO: 180 - DNA, 3224 bp, Zea mays
cattatgttggcaggtggcgagcagcgagcatagtagcgtcttcacggcttactgtggacacggtgtgacgtagtagaatacttggcaccgagcagagaaacagtgtgttggggctgcaggtccgggcgggatcgacgacgcgaccatcctggccgagcagggaactgcgtgcgaccacgacagactagtcggccagcacgaggaggcgacggcgagcgatggcaaccgggaggagcgcgcaatatccaggacggcctggctgggtgccgaaggagctgggcagcagggatcgaccaccatggctgggaaggggaacgcgacgcggcatggtcagagctagagggagctgcgcgcggcgtgctggaaaaagcaacagaacgagcgcgcgggggagcagagaaccgcgcgcgcataggagcagggagaagcacgcgcagagggcgagcagggacagaggaccgcgcgcgcaggggaacttggagaaccgcggccatgggcgagggaggagctcggccgggcgtcgagagggaaaggaaaggcggctgggcgcgcggcaacaggaagaagaagcagcgcttgagagaggagaccggaggggaggtgtccagcgcgacgaccaccagtggaaactcgcgcacgttcatggcgatggggcacgagcagggaggaatccgaggggaaatcgccatgggagcagctcgatctggacgaaatccaagcaggaggattgggcgcgagctggggcggtcgagcgctgggaataggaagcgccgagcagggaggaagaagctttggggagatgggacgagcagaggaacttcgacgcgcgcagggaggagccatggcgagtggctgggctgggcgcgcagagaaatcggctggggagtgagggggaagcagctgcgtgcagcgaggaggttccaggggcgcgcccgcgcggcaccagggggaagacgagggcgtagggagccatggagaggacgccgggaatctgagttgaggctggacaccgcgaggaagaagacgtgggcgcttggcttcggaacttctgccggcgagtaggatttttaacagcgcggcggctgagatcttttccagagataagatcggctggaaaaatccaagctgcgggcggctggaggataggatcgcgctggatttttccacggatccagaacggcggccggatgaagatgagcagaaaaatcacggcagaaaaaatcaaagggagggaggagagcgactgtagatagagatgaacgaggatatttttcccttttttttagaaattacagatatttcggatcacgattcttttagcgatgtatacggggtagacagtaattatgacgcggttttatttagttgaacctaaacgaatttcgcaaatgcttttaggtttccgatttttagcgctatacactgggtcgatacactagttatctacgcatcccattccccgaatctcgaaatggaaatccgaggactaatgatttgatttggcgaattctctaaactcggacggaatcgtgctgttaattcacttttgagatttaaatcgaggcgagaaacaaatggaccgaaccactatagttttggcttcgaggatttgctctgcgtaaattgaatgaagttagacgaaaccatatctgcgaaagcacacatgatttcgtcgctaaaacaacgtgcagacggataaactgaatcatattcgcacagacgatttcacttagacgacgcgcgatacagattattttgcctcgaacactttagtcgtggaagtctgattaatttgttcgggataaaatcatctagtgggtcgagcttccgaattcgtgttcgcgcgagcgatgtattttaaataatcatcggacgcaccgattttcggaacaacgatgttccgaacatcacgaaaatttcggaagagcccagatagataaaaataaaaatgatgtcgcactcgcgacagatggaacagatgcgatataaaaatcgcgatagtcgaagatgattaaaatttaaaatctgttttatccactgatattacgcgcttaaatccatactcgttgtcgagcggaatataaacaccaagggtgttacaccgtggccgagcgaattttatggcacggattggggaaggactaggcgaaatggtaacatcacggcgatgcatagctggggcgcatggaactcgcagggccagatcttggcgaggacgagcacacacgacgcgacgacaacgacgacaactggcgaggtcgacgatgcgatggggattaaggccgagagggcacgctgacaagcaggaaactccggtcgacgcaacaacagaaaaatggccgcgcgcggggaatagctagcgaccaagcgaaatccgagcagagggcactgccgcgcacagggaacaaggtacgacgcggacggacgagctcaacgagcagaggggcgagcagggcgcgagctgcgcgcaggcactcgacgaccacggccagggagctctgggctgggatggcggggaaactccatggcgggagtcgcggtttggatagagcagagggaaaagcggctaggcactagaggaccgagcagatgaacgcgactgcgcgcagggagcttcgcgagctggagcaggcgatgccgagttggagatgttgcaggcgtacaacaggaagaaagagcagcgtccatggcgagggaagaacgcgagcgcagggcttgcggatgtccgggcggacaaggccatgggggatgggcgcgcagccatggacaagctcgggcacagggagatggacggccgagcaggaagccatcgcgtgcagggaatttggtgcggccatggaagaacagggagaagtgaccggcgtagagaaagaccgatagtcatgccaagccgagagggagagaagcacggctgggcgttggggccaagcaccggcaggggaaggccgccgcaagggagctcggggagagggacacacagcacggggagcttcgatggcgcggagagcttggcgagcgcgaccgagctggagagagctccgtgtgggcgccgagctaaagaggaaagggtggcgcgacgctgggaggagaggagatgggcacacggcgcaggataaaatcgatccccacgggcggcggcggaaaaatctgaaggtgagggcggcggtagagattatcaggggtaggggcggcggagataaggaggaagatgactggtagtttg

SEQ ID NO: 181 - DNA, 3219 bp, Zea mays
tggaccgaaggtccatgacagcaaccacccgtccacctgtgccgtcgctcctgcaggcgccgaaacggttgcagaagaaggcgctggattcgcagtcagatgggatggtccggcgggccacccagcagccaccagaacgtgaccagctccataggctcacttgccccaggtggagcagcagatgctccgctatgcctgcgcctgcagccggacggttagtctgcagtaccagcgagctgttgtgtctctggccacgatagaagagaagctaaggaaccaagaggaaatgggcctgcagaccaagactagaattgaggacgaccttaatatgtgctgaatgaatatacgagtggccccgagcgcacactaccggacggaggaagaaggaaatgacaggtaggccaaggaagaagactgaaaaacctgctaccggatttgtttcgaaccgttttggacctaacagagacccgaacagcgattaagactttaagagacacattttaaaactttatggaccgggctgacacaccggcgcaagttaagggaccggaaatgcactttactcaaaaaactatatatttggcttatggtttcatgctttagccctttttggatcttgtgtgataatttggttttggaaataatgtgttcgggtgtaacaaacctggtagatcctaaaaccattgtgttactaaaattttagtcatttgggagttttcgaaactgcactctagagcacatttatttaaattgtggtgttgcacttctcttggttctagaacaacaatttcttcataccaagatccctcaaaactacaacatccaaacatgcccttacattttttttcagtgctaataacatgacatttgttgtgtgttcattgcgctaactgcggtgttggtaactttttgtgctttagtgaggatttgtctatgttcttgggtccagcttgtttggttccgggtaatataaatttacgtgaaattggctattgggaatatctgagataacctctgcatcagtgagataacctgtcttttaacagggacttgttgtgcaatcattgtttctggtctcaaatttgaatagcacaataagataccttagagttatttgttttgttttcattctgttttagctagcatgttgcattatatctataccgaggaagatggtaactgtgttgttagcgataattgaaaatttaacattaagtttgttgcaatttcttatccccttgagtcatatgtgttggcaaactgttgtttatgtaatactgatgtattaccactgtttgatattttccattttgttctttcataggtgactttctccttactaagttccatttatttgcttcgttgttgaaataggttcgaatatggagtatggaatctgtgcataaggacaataccaacaatgattcgaagcaaaggttgcttgctacactgcgtgatcattttggatcagtgaactgtgtgagatgggccaagcatggccgctaccttgcttcaggatcagatgatcaggttatcctaattcacgagagaaaagctggctcaggtacatctgagtttggtagtggagaaccaccagatgcagagaactggaaggtcattatgaccttgagagggcatactgccgatgtggtaattatcttctaaaattccactgtgctgtgtttatgtttgtgataattattttgtaactatagaacaccttttccatttcttgtgcataaggtaggtagatcttagttggtcccctgatgattcaacgttggccagcggtagcttggataataccattcacatatggaacatgaacaacggcatttgcactgctgtcttgcgagggcacaccagcttagtgaaaggggttacctgggaccctattggttcctttattgcaagccaatcagatgataagactgttatgatatggcgtacaagtgactggagtcttgctcacaagacagaaggccattggacaaaatctgtatgtcgtatttttttatttctctgttagatctagctgtgatcaacctgtcttactgaatgcctttctcattttgtttgttcctgcagcttggttcaacattttttagacgacttgcttggtcaccttgtggccacttcataactaccactcatggtttccagaaacctaggcattcagcacctgtgcttgaaagaggcgagtgggctgcaacttttgactttctagggcataatgcgcctattgtggtagttaagtttaataactcaacgttccgtaagaatttctcaaatgaccaagacccaaaggctgcaccagttggatgggccaatggagcatcaaagacaccaacaaaagagcagcaaccatataatgttattgctattggaagtcaagatagaactattactgtttggacgacagcgagtgcccgtccactatttgttgctaggcattttttctctcaaagtgtggttgatttatcttggtatgagatgtcaattatttctctacaaccattattaacttgtatgctcaaactcatgttgatattgtttgtttcccttgcaggagccctgatggttattcactttttgcctgctccttggatggatcagctgcaaactttcactttgaagtgaaggagcttggacacaggttaagtgactctgaaatggatgaatggaagaggaacaggtatggtgatgttggaggacgacagtcaaatctagctgaaagccctgcacagttgctgctagagcaagcatcagcaaagcaatcagctggagaaaaggtgacttcaattgtcgagcaaggtaaagcacccccaaaagtttctgcaggtgtgcctaacccaggtcttgttgtgctaagtctcgaagttcctgaagtgtcacatgaagactctaagaagacagcaggtccaactgctgatgatgtaaaaaaaggcaaccagttatctagtccagtgaaacagagagaataccggcgccctgatggccggaaaagaataatcccagaggcagttggatttgcttccaaccaggataacatacccaaccattctcagaatcatcctgtgaatttttcatccctggatcaacgaatgaatggaacaaaaccatcttatggcagtaacagcaactctaataactgtggagttaaggatcgcactagtgtcacagcaagggcaaacataactgagagtcttgttattcaaa

SEQ ID NO: 182 - DNA, 3220 bp, Zea mays
tccgatcgaggcaaagcttacccatgacgaggcatgtcaccagttaaagggtcctcggtcatcaagcctacatcgacacggtctttaatcgactcagacggagacaatacaccaagacttccttctcgtgcaagtcacccacccggtcttagctttattatttaaaacccaaagtttggtacctggcagtggtacatcttttcagatgttgaacccatcaaggccctgatggatccataatcacaagtttttctttgtaaaaattcccatccaatctgaagcatcaccttttgttgtaaaacaaaatattttgtttttctaaagcaaggctaagcatcataaaaatcttttttataaaagggagtcaaggaatgttgatcaattttccaaggaaggaaatgcatcaattgtttaagacacaactcctatcacctaatgcatcatataaggtgataaagattttaaaacacaaggaaagggataatgcaccagggcttgcctcgaataaaactaggttagtgtttgttagacgtcgatcacttgacgatcatcctttgtcttgacactcgttcagattatccatcttcaggttcgtccactagcatcatcttatggagaagctcacgcgtaacgacatcttgtggtcgactcagctctagtcctccacatcacgtgatcacttatcgtacctaaattatatgcataatgcacatggatgaggatatagaggaataccatactataacataatactatatggaagtggattaaacacttaaagcaagacatcgcaactcttgtaagtaaatcctatatacctatgactcgctagcataataatcacgttcgcccggtttaaccgggctagctcaaatctcaagaaaacaataaccatagacatgacctataaacgcctaagctaggtaatcatcaacagactaacgaaacataggcttagcccttccggacacctaaattcaagatacgaatagaagcaacctaaccagctccttttttgggttaacctgcataacacactaaccgaataaaacatcaagaaaatgctaaactacatgaacaaaaaattttgcaagcacttaatatcaccacctatcacgcacataaaatctagttaaatatactcgacatatatacccaccaaagcactcttcgcataaatggaatcttaaacctatatttcatacgacgcaaatatgtcacaaatgtgaactcccataccttgaaaaccttaaaattagaatatctgaaatacttaaacacatcttttaatacgtagatctcgggttttaattagagtagatctatagatgctactcgattctaaatacttggaaaaacaacaagaaataaccaaccatgacacttgatcggccactggtagaaaatatgacgactactaaaacaatctatcgatgtcgtcacatatatacagtgagtctactacagacatgtgaacacaatcgtactacataaataggatcacaacaaatctaatagaccgatatttcgaccagagtactttgttatcaaacaatctatcttcttttcaatcgcacatgccaacatataatggcaagcgatcaagacatttcctcatgacacaggcctactaatattctacttagtccaccaattaagctaattgactggaatagcgaaataactcaccataactgaatctggctcgataatcgcaagaacagcgaagtcggtgagggttccgtgattcacgtaatttatcgagcacctagtgagcatcacgctgaacctcgcattcttcttcatttaattccattctttcacatcgagtgcttgcgaccatcacataatatcgacaacttgtaattcaactcaaaattcacaaaaacaatggcacttactggttcacttattttacggagcaaggagctgtagggacgcacgagtgcacgaccagcgagcacggcgaagcgacgacaacggggatcgagctcgcgatagaaggtgatgatggcgcagcacgacgtggaggagctcgtagggagaaggcgcagccatggcaacgatgaagtccggaggccgaacacacggccagagcacgatatggagagcgaccagcgtgtgcgccatggctgggtcgccgatgaacggtggaacttgctgtccaaacaagaagacaatgatgagctggataatatcctattttaggctttacgtctagcacttggcaggcgtcccagttggatttcgctgtcttcaacgcccacacctggaacttctctcccaaaaacaagcaagcaagggaccacaccacaggtagtcgacgagatcaacataggactgcagcaaagcttctggaataggaagatggcaacaaggtcgacgatcggacggcttgccgacaccagagaacggcgctactgcaggaacgcagaggcctaggtgccatggcgtaggatcgcgcgggatccagcgtccaaggctgagcagcaggaggcgttcgtgagctccatggcggggtcgggctcggagacggcgaccagaggaggagcagggccgcgcgcaggatgagcttgttgtcgagcggagcagggaagcagggaggagcgcgcgccatggagacgagggaggagctcggctgggcgctcgtccatgggagacaacaggagtagagacggcgcgggcctgggcgagcgcatgcaagcgtcaaaaaatctgtatgcgtgaaaaaatccctagcagctgaacagttagcgacgggataaggactcaaggcatgcgcccatatgaagtgttattttaaatgattcttggttttgaacaacaatgcatgttttgaggccactcaaaaaacaattatgtgactcatgatatttatcacaaaacaatttaaccaaggaaaaatacattacaatttgctcattgccaaactgtaaacatcacttgtttgggcatgttatctcataaaatatgtggaaattttttaaatgtttcatggttatggacattaatgtatgtttgaagcggttcaaagccctaaatgatgtaatgtttagaacggtagtttttacaaaaaggacccaacaaggtttgtcatcaaagttttcgaatacactgatttgtgagtaaagggtcatgatttcgtgcatgttttctcgaaaagattgtggcatgaaccatgcgaaaactttgaagcttttcaaagccctaaattatgtgg

SEQ ID NO: 183 - DNA, 3210 bp, Zea mays
taacacttctatagaaaacatgatttacttccctaaactagctgcataattaaaattggacatgcagtccaaacaacaataagtaatttagttcctatttagcttctataatttttagcttctacaattatcatgttcttgacatttagaatactctaacgccttatgattaattagagcaaacccttcaacataaccacatatatagacaagtctacgtcatactcaggtacaaaattacattagtgcatgaaacgaggcatctcaacaatacctagtagtctacccatacctctcgcataactagtatcttgacttatgtaacaccccaggtgtttgtcttgtgtttcacaacagatgtggacttaagcatgagatagctgtcaataatggtctccatgtcctaatcatctttgcttatcctgatttcgatatggccttcatctttgtctatctggactattccaaatgtttaacaaagttcaatgtttaataatctccagagacatcgagttctgtactgtgtgaattgctcaagtagacaaatgcaaatttgggagcacttgactttttgtaatccggatcgcgcaagtaatccgtgaaattcgtgtgtgggttaatacccatattgtcctctagtgaagtgtctaaagcagagaaatcaagtgtcgaatatcgggtaaaaattatcgggatttttctcagcacgttatcctgacagagaaataaaagctattcagatataagatgatttttgtctgatttcgaataaattaagcattgtttaatatattggagccaaattcggtttaatctggtcagtttacatcatgctcgaacaaatccattcgaattccttaataaagtctaaatactgacgtcgattatgttgattcggtccgtgtgtttctcacccagatctacatctttagataataataactggtaaaaaatcatttgactccagaagtatttaccaaatcaaatcatgtccaaatatcggaaaaacttttgtctgatttcaactgagtcaagtactgactgaaatatcgatgtcagtatcattttgattcgttccatccaatctatctaaaactttagcccttgaaaccgactccggttccgttgacttcatctcaaaatccttcacatctgcgaagcacacgactctatgtggcctggcttcatgacacgtggtaggtgcaaatctatgtgtggaccgcgcacatcttctcgcccacgtggacgatgcatgacatcgcctccgaaggggttacgattgcgatgcgaagcacatgactctcttgtggcctggtttcatgacgtgtggcaagtgcaaacctatgtgtggacagcgcacatcttctcgcccacgtggacgatgcatgacgtcgcctccgaaggggttacgattgcgatgttgcgtccgtctggcatacttcagaatttgtttcttccacgaaatatcgagtctcttgcccgcttaggattaattggtgtaagcaacaccgaatttggaggctcaaacctcgtcatatgattttgtcttaagcaaatattgttagaactcggtggtaaaaattattggtgcaaaatatgttggaccaaggtaaatagatccaaaatcgactaattgttaattgatttagtttcgtcgagaatctatcacagattaaaatgtcaaagccagccatttacatcacgttcaaaccctgattctagatataggatatttttgtatccattgtgttaaaaagagagaaaagaggaaataatagaaaaattagagtggacaaattcccttttcctttatcctgcggcgccctccatctggatatttcttcgtcatttctcctcctttgttcaaacagtcaacatacttcttctacacgcctcctactctctctttctggcgctcgtatctagtgctgggaatatgggccaggctttttgggcagtacgagcacgacccaaaaactagagcccatagtacaacccggcacaaaataatatggactaggctagcactgtccgaaggcgggtatgggccgggcctcaaattccggcccttcagaccccagcatggctcacacagatgggcctggcttgggccagcacggcccaataaagcccaagttgtttaatgtctttaattgattaagctaccgactttatattgttgtggtatatggagtttatgtggtcaaatgatgttaggattgtttaatatatttaagttattaaacaatggactttatgtggttgttatattttgattttatgtggccaaatatatggactgcgcttgggctggtaaggcccaatgaaggaacgatgtgatttagggctgggctgggccactgtttttacacttcgggctggcacgacatgacctaaaagttttttgggctttcctggcccgaactcgtttggcacgaagcacaataaactaggtcgggccggcccggcccaattccctgcactactcgtatcggttgttggacatattatccgagagctgttggtcgtgcttggctcccaaccgcccgcctccctcaagcacgcatgttctctgctcctgccagcgccgtgtgctcgccagctcctgcttgccctgcaccaccaggccggtgcctgcatctccgagccacaccctcacatcgcctctcctccctgctgttagggctcgacgaccacaggtgctcccctattccagctcgcccagccccaacatcccatgttcgacatctggccttggcagcccactgcccacctccatggtcaccgatgaagatcccttgtgtcgtcgtggtgccatgatccatggtcgtctggccctgcttccttgtgtgcgctcttgtagctccaccaatctcaccgccgatctggcacaccgttcctcgcgcactgctccaaccaagtccggtcgttcggtccccgagcacgtgctctgcggcgccccaattcaagccatcggtggtgcttctccttgcgcttggcttgatctccctagccacgccgagcttgccaagaactagccctcgttggccatggtacccctgctcctcgccgtcatagggtactgttgcaatgacaccaaaccccgtcgtcgacagctttggttctatgtcgtcgggtccatgtttcgggtattaggtatggtattcaaaagttaacttgtgatcgacgttgttttcatccatgtgtagt

SEQ ID NO: 184 - DNA, 3209 bp, Zea mays
catatgtagtgctattttaaatgattcttggttatggacaataatgcatgttttgaggccactcaaaaaacaagtatgggactcatgatatttatcacaaaacaacttaaccaaggaaaatttcattacgatttgctcattgccaaactgtaaacatcacttgtctgggcatgttatcttagaaactatgtggaaagatttcaaatgtttcatggttatgaacattagtgtaagtttgaagcggttcaaagccctaaatgatgcaatgtttagaacggtattttttacaaaaaggacccaaaaatgtttgtcatcaaagttttcacaatacactgatttgggagtaaagggtcataattttgtgcatgttttctcgaaaagattgtggcataaactatgcgaaaactttgaagattttcgaagccctaaattatgtggtagatttgtagaatgatccaacatgttgtttcacaagcttcaccatcaactaatattgaaaacaatcaataacgtgattgtgggacccacatagttagatggtcgcatgccgattaatgttcagtgttttaaataatgagataactttaaaagtatttgaattgcaatatgcagatttttcaagataaactattttgcagagttacgacctatattaatggaaaatagttaatggaataaaatttatattttcactttcattactcttttctaaatgtcatactgtaagacatacttctttaggcatgttacattaacacatatatagtgctatgtgcaatgttcctcagttgtgaacacatcaacccaagtttaaggccgatcaaaacatgagtatgtgactaatgggtattaatttcatacaagtttgctgcatgatatatcgatttctgatgtgtgtcaacttcgatgcattttgaagccctaaatgttgtattgtttagattgacagtttttacggatagacccaacttgtttcgcatgcaccatcattaacccatgttcaagacaaccataatatgagtatgcgaccctagattgtcgcatgctagcactagatttggtcatatgaaggatgaggtgactctataagcgcttgaaatataacatgtatattttttcgtatcctcaatttacaataggcatgagctatccaacatgttgtttcacatgcttcatcatcatcccaagtgcaagacaacctatagcatgagtttggggcctaagatattgcatgttcgaatgctggcactagagtttgtagatatgaagaatgaggtaactttagaaatgtttaaagtgcaacatgtatattttttagatcggtaatttctcagagttgagagctatatttatgcaattctacttttatctcgatccatgtttcaagattctttgttattattctattgcagttatatcaatgatatttacaacaaaagaattaaatatagaaaaattttcattccaattttagttacaatgttctctatgcgagactataaacaatacaagtttagccatgctatcttaaaccatatgtagtgctattttaaatgattcttggttatggacaacaatgcatgttttgagcccactcaaaaacaagtataggactcataatatttatcacaaaacaatttaacctaggaaaaattacattacaatttgctcattgtcaaactgtaaacatcacttctttaagcatgtaatctcataagatatgtgggaaatttttaaatgtttcatggttatggacattaatgtaagtttgatgtgcttcaaatccctaaatgatgtaatgtttagaacggtagtttttacaaaaaggacccaacaagatttgtcatcaaagttttcacagtacactgatttgggagtaaagggtcatgatttcgtgcatgttttctcgaaaagattgtggcatgaaccatgcaaaaactttgaagatttttgaagccctaaattatgtggtagatttacagaacaatccaacatgttgtttcacacgctccaccatcaactaaaattcaacaaaatgaacaacttgagtatgggacccacataattagatggtcgcatgccgactaaagttcagtgttttaaagagtgagataactttaaaagtatttgaattgctatatgtagattttcaagataaactattttgcagagttacgacctcttttaatggaaaaatagttaatggaagaaaaattatatttccactttcattactcttttctaaatgtcgtactgtaagacatacttgtttaggcatgttaccttaaacatatataatgatatttgcaatgttcctcagttgtgaacacttcaacccaagtttaaggccaatcaaaacatgagtatgggactaatgagtattaatttcatataagtttactgcatgatatatcgatttctggtgtgcgtcaacttcgatgcattttgaagccctaaatgttgtattgtttagacatacagtttttacggatggacccaacttattgtttcgcatgcaccatcattaaccaatgttcaagacaaacataacatgagtatgcgaccctagattgcagcatgcttgcactagatttggtcatatgaaggatgaggtgactctagaagcgcttaaagcataacatgtagatttttttcagatcatcactttactatagatgtgagctatcgaacatgttgtttcacatacttcatcatcaacccaactgcaagacaacctatagcatgagtttgggcccaagatattagatgttcgaatgctggcactagagtttatagatatgaagaatgagttaattttagaaatgtttaaagtgcaacatgtatattttttagatcggtaattttccaaagttgagagctatatttttgcaatttcgcttttattttgatccatgttttaagatactttgttattattctattatagttatatcaatgatatttataacaaaagaattaaatatagaaaaaatttcattccaattttaattacaattttctctatgcgagactataaacaatactagtttaggcatgctatcttaaaccatatgtagtgctattttatatatttcttggttatggacaacaatgcatgttttgaggccactcaaaaaacaagtatgggactcatgatatttactacaaaataatttaaccatgaaaaattatattacaatttgctcttt

SEQ ID NO: 185 - DNA, 3207 bp, Zea mays
gaaccctcctggcggcggccccgcgcgtgcaggcgcgcgacatcctatcgggaggcgagggggctccgatgaccaccagcgccaacctgatgaaccatccgcctcgctccccgtcgtgatgctctccgccgaccaccatgagcaccggtcccccgccgcgacacccgtgtctccctctcgcccaaccacccccgcccccgccctagccccgaaccctcctggcggcggcccctctgtttgttgttaggaggtgagggtttgtgttgggttttttttttggcttgcactcctatgcggctggttctgtcataaatgtgctcgatttgtccaggaattctgagtcccgctttcagttcattgtcatgaatacgcgcaacactggtacatgcatcggcgatcactgctcggatcggtcacccgcggcgcccagacagggattcaaatcaccactaacagaaacacatacgtgcatcgtcggctccacactcacttgacgagggcacgataataagttcaactggacttcctaactaacaaagaaaatacaatgttctgtctcacataaacacgacatcctcctccatttacgcaatatatggcgacatatatatagctcggcaacttcgcatcgcctgcgcgagcaaacactatctgcatgcatgcatgttgtacacatacagcactcggttaaaagtattactgattgaatgacgtaaataaatcactagcttgtagccgaggttgagttatattagggccagtactacttactcttcattagcctcaaagttctccctccagtgaatcagagtcgggtaatagtgtggtacccaatattctcaacgtggtgtatgctgcagtgcagaggatcgagtactcaataaataactgataaatcatggcggaggcctagctagcttattagtactgcatcccactaaaaattctttcacctttctcttacgtgcgtacatgtgatggtgtttgcttttccaattaattaatgctacctaatatttagggaataaatgtaattaactgacctctaatccaaattctttcacctttctctttccatatttcagttgctcctccgataataatgtaattcctgtgcacttgcagccagttctcttcacagccaatgtcaaggacatgatgccccggaatccggggatccaccttagccttcaacacagtggttaatatggaaattatctaataaatcagcaaattatgatggcagagttcaacccatgcatattatatattacgatgaatttaccttactaattaattagattgtcaagtttacgtagctgcgctgcttctaaactctcatcttccgcctacaaatatcaaacggtatctacgtgattggttgctggctcctgaagagcaaggctcgcggggaacctggtgctgtttggttcaaaaaatgtaacgcaaatggtaatggtaacggtttactatcgattactatggtattatcaatttttagtatagtatctgattacggttggactaaaacaaacatgatttaacgttatcagttacccattgtgttacaaatatgtgaaccaaacgacaccctggatctgtagaaacgcgctccgctcacttctctgtggatgcagctaggtgatgtaaaaaataattatattgtctccgtgaggatatactatacaatcaatacactggagcgtagtcaacgcgcgcgcgagcggcctagacgtgggcggcctagtaaccaatcacgtggtatatgtttagggatgtacatgtacgttcatgagtgaagagctagctacataacatactacgccacaataattaattccataccttagcttgaaaataccacaagagtaagtcatcgtcggatccagaaaaagagcaaagaaatcattacaaatactagttatgtttcaaaataagacagtactttgttcatttacactagaaacgtgtacaactgatttaattgtagcatgtggacggacagaacaaatttagagatatttatgatattgattccatcacataagtagaatagtaacagaaaattccaaccagagatgtcaataatattttttttttcagacaaaaaataaataactaaatccactgaccaggtcatagtgtgcagagatatttttacgagcttttgatatagtgtttctccttaagacttcatgcaaaacatattttgccaaaactaagagaagtgcccccatcttcgagcatgctgtgcagaagagagaagactgacgtgagtgagaatcatgcattctcagggattttaatttgtagtatatatacgatcgagttcatagaattgaagcagcctcacctgaagttaccaatggttatgaatttgcctagattttttgccaccatatatcgtacgccggcctcagtccatgatgggacgatcatgggcttcgggttcaccaaaaggtcacatttcttgccaagcaaccctaaagttactgctttcccagcctaaactaatttcagtttgatctcaagagtagctcttcccttgtatgctattgagctcaagagtagcccttgcagcagccatgcatggaaggaatcgggtggctagtgtgccattttagcaatacatgatcgggaacacgaggagggttaagtgttggaaggaaaggtccggcagattcaatgttctagcattttccaaaggacaatgttccacggttagttttagtatccttccatgtcatgacaaaaataacataaatacgttcattaattgatcgtccatcataatcaaactaatggcacctgaagtatatttaaccagtaggtaacacaaacaccactgcttgtagtccacaagaagttcatcgcactccatgcagaagaatactaacccgcgcgcgcgcatctgtcggggtcagccatatttcttgggtactgctcacccgcgcgcgcgcatctgtcggggtcagccggcggacccgctcggatcaggccaggcctgtgggattggacccggaatctaattaaaattagagaccatcaatccaacacaaacgaacaaggtctaacagatcttgccgtgatttgttgaagttctcagccctggaatataaatccccaacctctgcaccccgcaacaataattatcctaccgcagagtgccatagccgctgagcagagcaaaaccattggtgtggagac

SEQ ID NO: 186 - DNA, 3188 bp, Zea mays
gttaggtgcagtttagtttaactgatccaaatgaggcccaactatatgaactttgtgacatatggttagcaggttattggggtcttattgggtgagaaacatcttaggctggtaaattttttacgtgtgtaaaacctcaatcatgtcacatccactcgtaagaagactcggttgtattcctgttaacagaaatggttgtttcctctctaaaaatatgttgactaacttggtctctatagacaagtttagtgacctcgtgggcaatttagtctagcaggcccaaaagtgacacaaaaagttacctacttctccataagaatgtagcaatcaataacatgcatgtttgtcaaactgacaactaagacccaattgcagcaagagcgcgtgacagttcctaacccatgagacccaatttgcagtagaaaagcatgcataagattttgttgacacctacaggagacggttcctacattgttcgactccagtgcacctaattgggcctataaataaaccaacaatacaccttaagggagaaaattaagttgggtatatgatcacatgtaaatgcgacattaatttccaggcctgctccgacggtgtaaacaagcgaaactatatttttcagacctgctaaccacctgacacaaagttgatatagttagtcctcatttggatcagctaaactcgactacagctaactcttgcgttttagtcttttgttgatcttcatttttattagtttcaagatcttcatgcttaacaaaagagaacaaatttcccagcacatcctctagaaatagcatattatctttggcatttgtcgccactacatgtcatctaacaatttcaacacctttatttgtgctcccacttgcagctcctcaacattatgcaaaagcttttgagctgcttcagtagcccgctttacctgtaagttcttcctcttaatggtcccaccgtaacattcttccattgtcttaagttgtttccacacataattctttttcgtttgttatgctgaaatttcattgtgcttctctcatcttaggatatagtaagctttctttagtttttaatctcttccctaatctcttctccaattttttgggatccgaattgtcaacactaatatgaagtaaagtttagtcccaacaattcagatcaccaaaaagtgaggaagatattaggtaagagataagaaaactaaagtaagcttccaagatcatgagattagaggacagtgaaaattcagcacaacaggcaaaaagaattttgtgtggaaccagcttaagaaaatggaagaagattacactgggaccattaagaggaagaaaatagaggtagagcaggctactgaagccgctaaaaagtttttgcataatgttgatgagttgcaattgggtgcccaaaagaaggatgatgaaattgttagactacaaatagtgatgacaagtgacaaaaagaggatgttgtttcttgaggatgagttgcaaaaattgttgtctttggtcaaggataaagatcttgaaactttataaaaataaaatcaaccagagactaaaatgcaagatttagttgctgtccagattaactaatccaaacgaggcctaactatatgaataggtcgttagcaggttactaggttcttattgggtgagaaacttttgatgctggtggattttgctatgtgggtaaaccctgaatcatgtcacatccactcttctcaagactaaacacaagagttaggtgcaaattagtttaactatggcctatataaaataatgtggactaacttgttctctatagacaattttttagtgatctcgtgggccaaaagttagacgaaaagttacctacttatccacgagaaagttgcaattgataacatgcatgttggtcaaactgaccactcagacccaattgcatcaagatttggcacacggacgaactacaaacataaatgaacagtcaggactcacaaaataaataggcttgtcctattgctctctctctctcactcaccgagaagacatgtagacaactctttatcttgtgagtatcaggagcttcgtcttgctagctttctcctaccagagcaccacactttctcatagcactagatggcatatcattgatggatccctacatacagcgctagcacccattaaataaatagaagtagacgacgacatgcctagaaactacaccactcgtctcgtctgggccacatgatgcacacatcttaccatgagaagcggtcactactgtaggccaaccgtatgtgtctctccaaacataggccgcactagagagcgttcttcaactagtggacgcaagactcgcactaaatgcaggcatggtctgcatgcacaaggcgccagcccacacgcctcctccgttgctccatgcatatggggcgtgtcctttggctctgcgatccacctgaactgctccactttttcatgtactcatcgttaaactccagcaggtttcatataaactcatgcatagtactagtatatggcatggcactccggtcgaaatccaggactgatggtctgatgtgctgcacgcatgttaggtaggcttcacacatcagtcgtgcttgcttgttcgtggagctagcttgcaagcctttccctttctgttgttcttgcacctagctacagcagatcacgagagctttcaagcccgttgtacgtgctagaggccagaggctctccctagctccatctgaaaaaggctgcagcaggaaatgacttttgatcgagccgctactgctggtgcttcatctcttaggctctctattgatccatatccatgtttggtactagtacagcgcgatcgtcagcaccacacacaacattgttcggtcctagtgcaatgatggcaccttgatcatctttctacgtctccgtcaaaaatgaactaataataatattcaagaaaaacaaactttatatacggtcggtcgtacttacttaaagctaatagttaatgtaataaataaagcaacaaattcaaaaaagggattacattatttgagtatttagttcgtgaataagttggtccccatcaagtcggccttgatcttgttatcaatggcgactgtctaaacaataatggactccaacgtggtcgagtatgtcattttatttcacgaaatttgacacctttttcgggcgcca

SEQ ID NO: 187 - DNA, 3186 bp, Zea mays
gttaggtgcagtttagtttagctgatccaaatgaggcccaactatatgaactttgtgacatatggttagcaggttactggggtcttattgggtgagaaacatctttggctggtcaattttttacgtgtgtaaaacctcaatcatgtcacatccactcgtaagaagactcggttgtattcctgttaatagaaatggttgtttcctctctaaaaatatgttgactaacttggtctctatagacaagtttagtgacctcgtgggcaatttactctagcaggccccaaaagtcaaacaacaagttacctacttctccataagaatgtagcaaccaataacatgcatgtttgacaaactaacaactaagacccaattgcagcaagagcgtgtgatagttcctaacccacgagacccaatttgcagtagaaaagcatgcataagattttgttgacacctagaggagacggttcctacattgttcgactccagtgcacctaattgggcctataaataaaccaacaatacaccttaagggagaaaattaagttgggtatatgatcgcatgtaaatgcgacattaattttcaggcctgctccgacggtgtaaacaagcgaaactatattttttagacctgctaaccacctgacacaaagttgacatagttaggcctcatttggatcagctaaactcgactacaactaactcttgcggtttagtcttttgttgatcttcatttttattagtttcaagatcttcatgcttaacaaaagagaacaaatttcccaacgcatcctcaagaaatagcatactatctttggcatttatcgccaatacatgtcatctaacaatttcaacacctttatttgtgctcccacttgcagctcctcgacattatgcaaaagcttttgagctatttcagtagcccgctttacctgtcagttcttcctcttaatggtcccaccataacattcttccattgtcttaagttgtttctacacataattctttttcgtttgttatgctgaaatttcattgtgcttctatcatcttaggatctagtaagctttctttagtttttaatctcttccctaatctcttctccaattttttgggatccgaattgtcaatacaaatatatgaagtaaagtttagtcccaacaatttggatcaccaaaaaagtgaggaagatattaggtaagagataagaaaactaaagtaagcttccaagatcatgagattagaggacagtgaaaattcagcacaacaggcaaaaaagaattttgtgtggaaccaacttaagacaatggaagaagattacactgggaccattaagaggaagaaaatagaggtaaagcaggctactgaagccgctaaaaagtttttgcataatgttgatgagttgcaattgggtgcccaaaagaaggatgatgaaattgttagaatacaaatagtggcgacaaatgccaaaaagaggatgttgtttcttgaggatgagctgcaaaaattgttgtctttggtcaaggataaagatcttgaaactttataaaaataaaatcaaccagagactaaaatgcaagatttagttgctgtccagattaactaatccaaacgaggcctaactatatgaataggtggttagcaggttactaggttcttattgggtgagaaacttttgatgccggtggattttgctatgtgggtaaaccctaaatcatgtcacatccactcttctcaagactaaacacaagagttaggtgcagattagtttaactatggcctatataaaataatgtggactaacttgttctctatagacatttttttgtgatctcgtgggccaaaagttagacgaaaagttacctacttctccacgagaaagttgcaattaataacatgcatgttggtcaaactgaccactcagacccaattgcagcaagatttggcacacagacgaactgcaaacataaatgaacagtcaggactcacaaaatcaataggctggtggtattgctctccctctctctcactcactcaccaataagacatgtacacaactctctatcttgtgagtatcaggagcatcatcttgatagctttctcctaccagagcaccacactttctcatagcactagatggcacatcattgatggatccctacatacagcgctggcacccattaaataaatagaagtagacgacgacatgcctagaaactacacctctcgtctcgtctgggccacatgatgcacgcgtattaccatgagaagcagtcactactccaggccaaccgtacgtgtctctccaaacataggccgcactagagcgcgttcttcaactaatggacgcaagactcgcactaaatgcaggcatggtctgcatgcataaggcgccagcccgcacgcctcctccgttgctccatgcatatggggcgcgtcctttggctctgtgatccacctgaaccgctccactttttcatgtactcatcgttaaactccagcaggtttcatataaactcatgcatagtactatatatggcatggtactccggtcgaaatccaggactgatggtctgatgtgctgcacgcatgtttggtaggcttcacacatcagtcgtgcttgcttgttcgtggagctagcttgctagcctttccctttctggtgttcttgcacctagctacagcagatcacgagagctttcaagcccgttgtacgtgctagaggcaaaaggctctccctagccccatctaaaaaaggctgcagcaggaaatgacttttgatcgagccgctactgctggtgcttcctctcttaggctctctattgatccatatccatgtttggtactagtacagcgcagtcgtcagcaccacacacaacactgtttggtcctagtgcaatgatggcaccttgatcgtcttttacgtctccgtcaaaaatgaactaataataatattcaagaaaaacaaactttatatacggtcggtcgtacttacttaaagctaaaagttaatgtaataaataaagcaacaaattcaaaaaagggattaagttatttgagtatttagtttgtgaataagttggtccccatcaagtcggccttgatcttgttatcaatgacgactgtctaaacgataatggactccaacgtggtcgagtatgtcattttatttcacggaatttattaggggac

SEQ ID NO: 188 - DNA, 3185 bp, Zea mays
gtcccctaataaattccgtgaaatataatgacatactcgaccatgttggagtccattatcgtttagacagtcgtcattgataacaagatcaaggctgacttgatggggaccaacttgttcacgaactaaatactaaaataatgtaatcccttttttgaatttgttgctttatttattacattaactattagctttaagtaagtacgaccggccttatataaagtttgtttttcttgaatattattattagttcatttttgacggagacgtagaaagacgatcaaggtgccatcattgcactaggaccgaacagcgttgtgtgtagtgctgacgaccgcgccgtactagcaccaaacatggatatggatcaatagagagcctaagagatgaagcaccagcagtagcggctcgagcaaaagtgatttcctgctacagcctttttcagatggagctagggagagcctctggcctctagcacgtacaacgggcttgaaagctctcgtgatctgatgtagctaggtgcaagaacaccagaaagagaaaggctagcaagctagctccacgaacaagtaagcacgactgatgtgtgaagcctacctaacatgcgtgcatcacatcagaccatccgtcctagatttcgatcggagtgccatgccatatacaagtactatgcatgattttatatgaaacctactggagtttaacgatgagtacatgaaaaagtggaacggttcaggtggatcgcagagccaaaggatgcgccccatatgcatggagcaatggaggaggcgtgcgggctagcgccttatgcatgcagaccatgcctgcatttagtgcgagtcttgcgtccactagttgaagaatgcgctgtagtgcggcctatgtttggagagacacgtacggttggcctgcagtagtgaccgcttctcatggtaagacgcgtgcatcatgtggcccagacgagatgagaggtgtagtttctaggcatgtcgtcgtctacttctatttatttaatgggtgctagcgttatatgtaggggtccatcaatgatgtgccatctagtgctatgagaaagtgtggtgctctggtaggagaaagctagcaaaacgatgctcctgatactcacaagatagagagttgtgtacatgtcttctcggtgagtgagagagagagagagcaatagcacaagcctattgattttgtgagtcctgactgttcatttatgtttgcagttcgtccgtgtgccaaatcttgctgcaattgggtcagagtggtcagtttgaccaacatgcatgttattaattgcaactttctcgtggagaagtaggtaactttcatctaacttttggcccacgagatcactaaaaaattgtctatagagaacaagttagtccacattattttatataggccacagttaaactaatctgcacttaactcttgtgtttagtcttgagaagagtggatgtgacatgattcagggtttacccacatagcaaaatccaccgacatcaaaagtttctcacctaataagaacctagtaacctgctaaccacctattcatatagttaggcctcgtttggattagttaatttgaacagcaactaaatcttgcattttagtctctggttgattttatttttataaagtttcaagatctttatcattgaccaaagacaacaatttttgcagctcatcctcaagaaacaacatcctctttttggcatttgtcgccattatttgtagtctaacaatttcatcatccttcttttgggcacccaattgcaactcatcaacattatgcaaaaactttttagcggcttcagtagcctgctttacctctattttcttcctcttaaatggtcctagtgtaatcttcttccattgtcttaagctggttccacacaaaattctttttttcttgttgtgctgaattttcactatcctctaatctcatgatcttggaagcatactttagttttcttatctcttacctaatatcttcctcacttttttggtgatccgaattgttgggactaaactttatttcatatattagtattgacaattcggatcccaaaaaattggagaagagattagggaagagattaaaaactaaagaaagcttactagatcctaagatgagagaagcacaatgaaatttcagcataacaaacgaaaaagaattatgtgtggaaacaacttaagacaatggaagaatgttacggtgggaccattaagaggaagaacttacaggtaaagcgggctactgaagcagctcaaaagcttttgcatattgttgaggagctgcaagtgggagcacaaataaaggtgttgaaattgttagatgacatgtagtggcgataaatgccaaagatagtatgctatttcttgaggatgagctaggaaattcgttctcttttgttaagcatgaagatcttgaaactaataaaaatgaagatcaacaaaagactaaaacgcaagagttagttgtagtcgagtttagctgatcgaaatgaggcctaactatattaactttgtgtcaggtggttagcaggtctgaaaaatatagttttgcttgtttacactgtcggagcaggcctgaaaattaatgtcgcatttacatgcgatcatataccaaacttaattttctcccttatggtgtattgttggtttatttataggcccaattaggtgcattggagtcgaacaatgtaggaaccatctcctctaggtgtcaacaaaaacttatgcatgcttttctactgcaaattgggtctcgtgggttaggaactgtcacgcgctcttgctgcaattgggtcttagttgtcagtttgacaaacatgcatgttattgattgctacattcttatggagaagtacgtaacttgttgtttgacttttggggcctgctagagtaaattgcccacgaagtcacaaaacttgtctatagagaccaagttagtcaacatatttttagagaagaaacaaccatttctattaataggaatacaaccgagtcttcttacgagtggatgtgacatgattgaggttttacacatgtaaaaaattgaccagcctaagatgtttctcacccaataagaccctagtaacctgctaaccatatgtcagaaagttcatatagttgggcctcatttggatcagttaaactaaactgcacctaac

SEQ ID NO: 189 - DNA, 3185 bp, Zea mays
gtcccctaataaattctgtggaataaaatgacatactcgaccacgttggagtccattatcgtttagacagtcgtcattgataacaagatcacggccgacttgatggcgaccaacttattcatgaactaaatactcaaataatgtaatcccttttttgaatttgttgctttatttattacattaactattagatttaattaagtacgaccgaccgtatataaagtttgtttttcttgaatattattattagttcatttttgacggagacgaagaaagacgatcaaggtgccatcattgcactaggaccgaacaatgttgtgtgtggtgctgacgaccacgctgttctagtaccaaacatggatatggatcaatagagagcctaagagatgaagcaccagcagtagcggctcgatcaaaagtcattacctgttgcagcctttttcagatggagctagggagagcctctggcctctagcacgtacaacgggcttgaaagctctcatgatttgctgtagctaggtgcaagaacaccagaaagggaaaggctagcaagctagctccacgaacaagcaagcacgactgatgtgtgaagcctaccaaacatgcgtgcagcacatcagaccatcagtcctggatttcgaccggagtaccatgccatatatagtactatgcatgagtttatatgaaacctgctggagtttaacgatgagtacatgaaaaagtggagcggttcaggtggatcacagagccaaaggacgcgccccatatgcatggagcaacggaggaggcgtgcgggctggcgccttatgcatgcagaccatgcctgcatttagtgcgagtcttgcgtccattagttgaagaacgcgctctagtgcggcctatgtttggagagacacgtacggttggcctggagtagtgactgcttctcatggtaatacgcgtgcatcatgtggcccagacgagacgagaggtgtagtttctaggcatgtcgtcgtctacttctatttatttaatgggtgccagcgctgtatgtagggatccatcaatgatgtgccatctagtgctatgagaaagtgtggtgctctggtaggagaaagctatcaagatgatgctcctgatactcacaagatagagagttgtgtacatgtcttattggtgagtgagtgagagagagggagagcaataccaccagcctattgattttgtgagtcctgactgttcatttatgtttgcagttcgtctgtgtgccaaatcttgctgcaattgggtctgagtggtcagtttgaccaacatgcatgttattaattgcaactttctcgtggagaagtaggtaacttttcgtctaacttttggcccacgagatcacaaaaaaatgtctatagagaacaagttagtccacattattttatataggccatagttaaactaatctgcacctaactcttgtgtttagtcttgagaagagtggatgtgacatgattcagggtttacccacatagcaaaatccaccggcatcaaaagtttctcacccaataagaacctagtaacctgctaaccacctattcatatagttaggcctcgtttggattagttaatctgaacagcaactaaatcttgcattttagtctctggttgattttatttttataaatttcaagatctttatccttgaccaaagacaacaatttttgcagctcatcctcaagaaacaacatcctctttttggcatttgtcgccactatttgtagtctaacaatttcatcatccttcttttgggaacccaatttcaactcatcaacattatgcaaaaactttttagcggcttcagtagcctgctttacctctattttcttcctcttaatggtcccagtgtaatcttcttccattgtcttaagctggttccacacaaaattctttttttcctattttgctaaattttcactgtcctctaatctcatgatcttggaagcttactttagttttcttatctcttacctaatatcttcctgaattttttggtgatccgaattgttgggactaactttatttcatatattagtattgacaattcggatcccaaaaaattggtgaagagattagggaagagattaaaaactaaagaaagcttactagatcctaagatgagagaagcacaatgaaatttcagcataacaaacgaaaaagaattatgtgtggaaacaacttaagacaatggaagaatgttacggtgggaccattaagaggaagaacttactggtaaagcaggctactgaagcagctcaaaagcttttgcataatgttgaggagctgcaagtgggagcacaaataaaggtgttgaaattgttagatgacatgtagtggcgataaatgccaaagatagtatgctatttcttgaggatgcgctgggaaatttgttctcttttgttaagcatgaagatcttgaaactaataaaaatgaagatcaacaaaagactaaaacgcatgagttagctgtagtcgagtttagctgatccaaatgaggcctaactatatcaactttgtgtcaggtggttagcaggtctgaaaaatatagtttcgcttgtttacaccgtcggagcagacctgaaaattaatgttgcatttacatgcgatcatataccctacttaattttctcccttatagtatattgttggtttatttataggcccaattaggtgcaatggagtcgaacaatgtaggaaccgtctcgtctaggtgtcaacaaaatcttatgcatgcttttctacagcaaattgggtctcgtgggttaggaactgtcacgcgctcttgctgcaattgggtcttagttgtcagtttgacaaacatgcatgttattgatcgctacattcttatggagaagtaggtaacttgttgtttgacttttggggcctgctagagtaaattgcccacgaggtcactaaacttgtctatagagaccaagttagtcaacatatttttagagaggaaacaaccatttctattaacaggaataaaatcgagtcttcttacgagtggatgtgacatgattgaggttttacacacgtaaaaaattgaccagcctaagatgtttctcacccaataagaccccagtaacctgctaaccatatgtcataaagttcatatagttgggcatcatttggatcagttaaactaaaatgcacctaac

SEQ ID NO: 190 - DNA, 3183 bp, Zea mays
gagttaggtgcagtttagtttaactgatccaaatgatgcccaactatatgaactttgtgacatatggttagcaggttactggggtcttattgggtgagaaacatcttaggctggttaattttttacgtgtgtaaaacctcaatcatgtcacatccactcgtaagaagactcagttgtattcctgttaatagaaatggttgtttcctctttaaaaatatgttgactaacttggtctctatagacaagtttagtgacctcgtgggcaatttactctagcaggccccaaaagtcaaacaacaagttacgtacttctccataagaatgtagcaatcaataacatgcatgtttgtcaaactgacaactaagacccaattgcagcaagagcgtgtgacagttcctaacccacgagacccaatttgcagtagaaaagcatgcataagattttgttgacacctagaggagacggttcctacattgttcgactccaatgcacctaattgggcctataaataaaccaacaatacaccttaagggagaaaattaagttgggtatatgatcgcatgtaaatgcgacattaattttcaggcctgctccgacggtgtaaacaagcgaaactatatttttcagacctactaaccacctgacacaaagttaatatagttaggcctcatttggatcagctaaactcgactacatctaactcttgcgttttagtcttttgttgatcttcatttttattagtttcaagatcttcatgcttaacaaaagaggacaaatttcccagcgcatcctcaagaaatagcatactatctttggcatttatcgccactacatgtcacctaacaatttcaacacctttatttgtgctcccacttgtagctcctcaatattatgcaaaagcttttgagctgcttcagtagcccgctttacctgtaagttctttctcttaatggtcccatcgtaacattcttccattgtcttaagctgtttccacacataattctttttcgtttgttatgctgaaattttattgtgcttctctcatcttaggatctagtaagctttctttagtttttaatctcttccctaatctcttctccaattttttgggatccgaattgtcaatactaatatatgaaataaagtttagtcccaacaatttggatcaccaaaaaagtcaggaagatattaggtaagagataagaaaactaaagtatgcttccaagatcatgagattagaggacagtgaaaatttagcacaacaggaaaaaaagaattttgtgtggaaccagcttaagacaatggaagaagattacactgggaccattaagaggaagaaaatagaggtaaagcaggctactgaagccgctaaaaagtttttgcataatgttgatgagttgcaattgggtgcccaaaagaaggatgatgaaattgttagaatacaaatagtggcgacaaattccaaaaagagaatgttgtttgttgaggatgagctgcaaaaattgttgtctttggtcaaggataaagatcttgaaactttataaaaataaaatcaaccagagactaaaatgcaagatttagttgctgttcagattaaataatccaaccgaggcctaactatatgaataggtggttagcaggttactaggttcttattaggtgagaaacttttgatgccggtgtattttgctatgtgggtaaaccctgaatcatgtcacatccactcttctcaagactaaacacaagagttaggtgcagattagtttaactgtggcctatataaaataatgtggactaacttgttctctatagacaattttttagtgatctcgtgggccaaaagttagacaaaaagttacctacttctccacgagaaagttgcaattaataacatgcatgttggtcaaactgaccactcagacccaattgcagcaagatttggcacacggacaaactgcaaacataaatgaacagtcaggattcacaaaatcaataggcttgtgctattgctctctctctcactcaccgagaagacatgtacacaactctctatcttgtgagtatcaggagcatcgtcttgctagctttctcctaccaaagcaccacactttctcatagcactagatggcacatcattgatggatccctacatacaacgctagcacccattaaataaatagaagtagacgacgacatgcctagaaactacacctctcgtctcgtctgtgccacatgatgcacgcgtcttaccatgagaagcggtcactactgcaggccaaccgtacgtgtgtctccaaacataggccgcactagagcgcgttcttcaactagtggacgcaagactcgcactaaatgtaggtatggtctgcatgcataaggcgccagcccgcactcctcctccgttgttccatgcatatggggcgcgtcctttggctctgtgatccacctgaaccgctccactttttcatgtactcatcgttaaactccagcaggtttcatataaactcatgcatagtactagtatatggcatggcactccagtcgaaatccaggactaatggtcagatgtgatgcacgcatgttaggtaggcttcacacatcagtcgtgcttacttgttcgtggagctagcttgctagactttccctttctggtgttcttgcacctagctacagcagatcacgagagctttcaagcccgttgtacgtgctagaggccagatgctctccctagctccatctgaaaaaggctgcagcaggaaatgacttttgatcgagccgctactgctggtgcttcatctcttaggctctctattgatccatatccatgtttggtgctagtacggcgcggtcgtcagcaccacacacaacactgttcggtcctagtgcaatgatggcaccttgatcgtctttctacgtctccgtcaaaaatgaactaataataatattcaagaaaaacaaactttatatacggtcggtcgtacttacttaaagctaatagtgaatgtaataaataaagcaacaaattcaaaaaagggattacattatttgagtatttagttcgtgaataagttggtccccatcaagtcggccttgatcttgttatcaatgatgactgtctaaacgataatggactccaacgtggtagagtatgtcatcttatttcacggaatttattaggggac

SEQ ID NO: 191 - DNA, 3183 bp, Zea mays
tacatgttgcgctttaaacatttataaagttacctcgttttgcatatgtccaaactcaagcgccagcattcatacatcaaatatgttgggcttcaaattcatgcgatagatagtcttgaacttgggttcatgatgaagcatatgaaacaaatgttgtatagagttgggtctacctgtaaaaattgtctgtctaaacaatacaatatttagggcttcaaaatgcttcgaagttgatgcataacaaaaatcaatatattatgcaaaaaacttgcatgttttgaagtaatatgcctcaagttattatttttgttgaactttggttgatagtggagagtgtgaaacaacatgttggatcatttctatataagtaccgattaaaaagtacatattttagggcttcgatacgcttcaaagtagtcacatgcttcattctacaatattctagagataacatgcacgaaatcatgatcctttactcccatactattttttcgagtggcttcaaatgtaggttgatgtgtccataataaagaaatagtacaatgtccactgcaaaccttctaacataacgggactaaactagcatggtttacaatccaagaatgtgcttagtgtaatgaaagttggggtcaaattttccttcatattaatgtttttgataaataaatgttattagtataattctgacaaaatattaatgaaaacctttaattttggatacagatcatagtcacatagtagaattacaacttgcttttgtagaaaacacataatctagaaaagtctacatgttagctttatacatttataaatttacatcgttcttcaaaactattttgtttcttcaaaacggtcgcatgttgtgggttgtcttgtacttacattgataatggagcgtgtgaaaaaacatgttggattctttttgtaaaaactacgattctaaacattacaccatttatggctaaacattacatcatttaggcttcgaaccgctttaaacttacgttgatctccataaccatgaaacatttgaaaaacactacaatattataagataacatgcccaaacaagtattgtttatgatttggcaatgagtaaattataacataattttccatggtttaattgttttgtgataaatatcctgactcccatgctcgtttttggagtgacctcaaaacatgcatttttgtccttaaccaagaaacattgaaaacaacatgcctaaaccagtattgtttatgttctgtcaatgagcaaattgtaattaaaattggaataaaatgttttatatttaattctatagtaatcaatatcattgatagaaccataatagaatagtaacaaagaatcttaaaacatggatggaaatgaaagtcgaatagcataaatatagctctcaactccagaaaattaccaatccaaataatataaatgttgtgctttaaacatttctaaagttacctcgttctacatatgtccaaactcaagtgccaccattcatacatccaatatgttgggcccgaaactcatggtatagatcatcttgaacttgggttgataaagcatgtgaaacaaatgttggatacggttgggtctatctgtaaaaactgttagtctaaacaatacaacatttagggcttcaaatgatccaaaattgatgcacatcagaaatcgatatattatgcaaaaaatttgcattaaattaatacccattagtctcatactcatgttttgagcggtctcaaacatgggttgatgtgtagataaccaagaaacattgcaaatagcactacatatgttttgaagtaatattcctcatgttattaattgtgttgaactttggttgatatggagcatgtgaaacaacatgtttgatcattctgtaaaaactatcgattaaaattatatattttattgattcgaaacactacaaagtagtcacatacttcataccacagtattctagagaaaacatgcatgaaatcaagatcctttattctatactatttttctagtgtcttgaaacataggtggatgtgtccctaatcaagaaacattacaatatccattgcataccttcggacattacgtgactaacctagcatgttttacaatccagcaatatgcaaagtgtaataaatgtatggatcaaattttacttcatcttaatgttttttataaataaatgttattagtataattgtgaaaaaatagtaatggaacctttagatttggataaagatcatagtcagatagtagaattacagctcacgtttgtagagaacccatgatctagaaaagtctacatgttggctttaaacatttataaatttacctcggtcttcaaaccatcaaattctaaggttcacatacagtgggttgtcttgtacttatattgataatggagtgtgtgaaacaacatgttggatccttcttgtaaaaactacgattctaaatattacatcatctagggctttgaaccgcttcaaacatacaatgatgtccataaccataatacatttttcttaacaatacacatcttatgaaataacatgcccaaaaaagtatgatttacagtttggcagcaagaaaattgtaatataattttccttggtttaatttataaatgtttttttgagtcccatactcgtttttttgagtggcctcaaaacatgcattgttgttcttaaccaaggagcatttaaaatagcactacatatgttttaagatagaatgtctaaactagtattgtttatggtcgaacaataagcaaattgtaattaaaattggaatgaaatttttctatatttaattcctttgttataaacatcattgatacaaccataatagaatagtaacaaagaatcttagaacatggatggaatgaagagtcgaaagcataaatatagctctcaactccgaaaaataaccgatctaaaaaaatacatgttgcgcattaagcatttctaaagtttcctcattcttgatatgtccaaactcaggtgccattattcatacatccatattctacagatttccttgaacttgggttgatgatgaagcatatgaaataaatgtcggatagagttgggtctatctgtaaaaactatccgtctaaataatacaacaattaaggcttcaaaatgcttcgaagttgatgcacatcagaaatctatata

SEQ ID NO: 192 - DNA, 3181 bp, Zea mays
gtcccctaataaatttcgtgaaataaaatgacatactcgaccacgttggagtccattatcgtttagaaagccgtcattgataacaagatcaaggccgacttgatggggaccaacttattcacgaactaaatactcaaataatgtaatcccttttttgaatttgttgctttatttattacattaactattagctttaagtaagtacgaatgaccgtatataaagtttgtttttcttgaatattattattagttcattttttacggagacgtagaaagacgatcaaggtgccatcattgcactaggaccgaacagtgttgtgtgtggtgctgacgaccgcgccatactagtaccaaacatggatatggatcaatagagagcctaagagatgaagcaccagcactagcggctcgatcaaaagtcatttcctgctgcagcctttttcagatggagctagggagagcctctggcctctagcacgtacaacgagcttgaaagctctcgtgatctgctgtggctaggtgcaagaacaccagaaaagggaaaggctagcaagctagctccacgaacaagcaagcacgactgatgtgtgaagcctacctaacatgcgtgcagcacatcagaccatcagtcctggatttcgactagagtgccatgccatatactagtactatgcatgagtttatataaaacctgctagagtttaacgatgagtacatgaaaaagtggagcggttcaggtggatcgcagagccaaaaaacgcgccccatatacatggagcaacggaggaggcgtgcgggctggcgccttgtgcatgcagaccatgcctgcatttagtgcgagtcttgcgtccactagttgaagaacgcgctctagtgcggcctatgtttggagagacacatacggttggcctgcagtagtgaccgcttctcatggtaagacgcgtgcatcatgtggcccaaatgacgagaggtgtagtttctaggcatgtcgtcgtctacttctatttatttaatgggtgctggcgctgtatgtagggatccatcaatgatgtgccatctagtgctatgagaaagtgtggtgctctggtaggagaaagctagcaagacgatgctcctgatactcacaagatagagttgtgtacatgtcttcttggtgagtgagagagagagagcaatagcacaagcctattgattttgtgagtcctgactattcatttatgtttgcagttcgtccgtgtgccaaatcttgctacaattgggtctgagtggtcagtttgaccaacatgcatgttattaattgcaactttctcgtggataagtaggtaacttttcgtctaacttttggcccacgagatcactaaaaaattgtctatagagaacaagttagtccacattattttatataggccatagttaaactaatctgcacctaactcttgtgtttactcttgagaagagtggatgtgacatgattcagggtttacccacatagcaaaatccaccggcatcaaaagtttctcacccaataagaacctagtaacctgttaaccacctattcatatagttaggcctcgtttggattagttaatctggacagcaactaaatcttgcattttagtctcttgttgattttatttttataaagtttcaagatctttatccttgaccaaatacaacaatttttgcaactcatcttcaagaaacaacatccactttttggcatttgtcgccactatttgtagtctaacaatttcatcatccttcttttgggcacccaattgcaactcatcaacattatgcaaaaactttttagcggctttagtaacctgctttacctctattttcttcctcttaatggtcccagtgtaatcttcttccattgtcttaagctggttccacacaaaattctttttttgcctgttgtgctgaattttcactgtcctctaatctcatgatcttggaagcttactttagttttcttatctcttacctaatatcttcctcacttttttggtgatctgaattgttgggactaaactttacttcatatattagtattgacaattcggatcccaaaaaattggagaagagattagggaagagattaaaaactaaagaaagcttactagatcctaagatgagagaagcacaatgaaatttcagcatgacaaacgaaaaagaattatgtgtggaaacaacttaagacaatggaagaatgttacggtgggaccattaagaggaagaacttacaggtaaagcgggctactgaagcaggtcaaaagcttttgcattatgttgaggagctgcaagtgggagaacaaataaaggtgttgaaattgttagatgacatgtagtggcgataaatgccaaagatagtatgctatctcttgaggatgctgtgggaaatttgttctcttttgttaagcatgaagatcttgaaactaataaaaatgaagatcaacgaaagactaaaacgcaagagttagctgtagtcgagtttagctgatccaaatgaggtctaactatatcaactttgtgtcaggtggttagcaggtctaaaaaatatagtttcgcttgtttacaccgttggagcaggcctgaaaattaatgtcgcatttacatgcgatcatatacccaacttaattttctcccttaaggtgtattgttggtttatttataggcccaattaggtgcactagagtcgaacaatgtaggaaccgtctcctctaggtgtcaacaaaatcttatgcaatcttttctactaaaaattgggtctcgtgggttaggaactgtcacgcgctcttgctgcaattgggtcttagttgtcagtttgacaaacatgcatgttattgattgctacattcttatggagaagtaggtaacttgttgtttgacttttggggcctgctagagtaaattgcccacgaggtcactaaacttgtctatagagaccaagttagtcaacatatttttagagaggaaacaaccatttctattaactggaatacaaccgagtcttcttacgagtggatgtgacatgattgaggttttacacacgtaaaaaattgaccagcctaagatgtttctcagccaataagaccccagtaacctgctaaccatatgtcacaaagttcatatagttgggcctcatttggatcagttaaactaaactgcacctaac

SEQ ID NO: 193 - DNA, 3220 bp, Zea mays
  misc_feature (1281)..(1282): n is a, c, g, or t
catatgaagtgttattttaaatgattcttggttttgaacaacaatgcatgttttgaggccactcaaaaaacaattatgtgactcatgatatttatcacaaaacaatttaaccaaggaaaaatacattacaatttgctcattgccaaactgtaaacatcacttgtttgggcatgttatctcataaaatatgtggaaattttttaaatgtttcatggttatggacattaatgtatgtttgaagcggttcaaagccctaaatgatgtaatgtttagaacggtagttttcgcaaaaaggacccaacaaggtttgacatgaaagttttcgcaatacactgatttgtgagtaaagggtcatgatttcgtgcatgttatctcgaaaagattgtggcatgaaccatgcgaaaactttgaagcttttcaaagccataaattatgtggtagatttacagaatgatccaacatgttgtttcacacgctccaccatgaactaaaattcaacacaatcaataacttgagtatgagacccacataattagatggtcgcatgccaattaaagttcagtgttttaaagaaagaggtaactttaaaagtatttgaattgcaatttgcagatttttcaagataaactattttgcagagttacgacctctattaatggaaaaatagttaatggaagaaaatttatatttctgcattcattactcttttctaaaagacatacttgtttaggcatgttaccttgtaacatatattgtgctatttgaaacgttcctcagttgtgaacactgcaacccaagtttaaggccgatcatgagtatgggtctaatgggtattatatttgtacaagtttgctgcatgatatattgatttctaatgtgcgtcaacttcgatgcattttgaagccctaaatgttgtattgtttagacagacagtttttatgtatggacccaacgtgttgtttcacatacaccatcattaacccatgttcaagacaaccataacatgagtatgcgaccttagattgtcgcatgttagcactagttttggtcatatgaaggatgaggagactctaaaagtgattgaagcacaacatgtagattttttcagatcatcaatttactataagcgtgtgctatgcaacatgttgtttcaattcttcatcatcaacccaagtgcaagacaacctatagcatgagtttggggcccaagatattggatgttcgaatgctggcactatagtttgaagatatgaagaatgaggtaactttagaaatgtttanngtgcaacatgtatattttttagatcggtaatttccagagttgagagctatatttatgcaattctgcttttattttgatccatgttttaagattctttgttattattcttttacagttatatcaatgatatttgtaacaaaataattaaatatagaaaaaagttcattccaattttaatttcaatttgctctatgccagactataaacaataatggtttaggcatgctatctttaactttatgtagtgctattttacatgattcttggttatgattaacaatgcatgttttgaggccactaaaaaaagtatgggactcatgatatttatcacaaaataatttaaccaaggaaaattacattacaatttgctcattgccaaaatgtaaacatcacttctttggcatgttatctcgtaagataagtggaaaattttcaaatgtttcatggttatggacattaatgtaagtctgaattggttcaaagccctaaatgatgtaatgtttagaatggtagtttttacaaaaaggacccaacaaggtttgtcatcaaagttttcgcaatacactgatttgtgagtaaaagagtcatgatttcgtgcatgttttctcgaaaagattgtggcatgaaccatacaaaaactttgaagcttttcgaagccttaaattatgtggtagatttacaaaatgatccaacatgttgtttcacacgctccaccatcaactaaaatttaacacaatcaataacttgagtatgggacccacataattagatggtcgcatgccgattaaagttcagtgttttcaagaatgagataactttaaaagtacttgaattgcattatgcagatttttcaagataaactattttgtagagttacgacctctattaatggaaaaatagttaatggaagaaaatttatatttccactttcattattcttgtctaaatgtcatactgtaagacatacttgtttacgcaagttaccttaaaacatatattgtgctatttgcaacgttcctcagttgtgaacacatcaacccaatttaaggccgatcaaaacatgagtatcggactaatgggtattatagtcccctaataaattccgtgaaataaaatgacatactcgaccatgttggcgtccattatcgtttagacaatcgtcattgataacaagttcaaggccgacttgatggggaccaacttattcacgaactaaatactcaaataatgtaatcccttttttgaatttgttgctttatttattacattaactattagctttaagtaagtacaaccgaccatatataaagtttgtttttcttgcatattattattagttcatttttgacggagacgtagaaagacgatcaaggtgccatcattgcactaggaccgaacagtgttgtatgtggtgctgacgaccgcgccatactagtaccaaacatggatatggatcaatagagagccttagagatgaagcaccattagtagcggctcgatcaaaagtcatttcctgctgcagcctttttcagatggagctagggagagcctatggcctctagcacgtacaacgggcttgcaagctctcgtgatctgttgtagctaggtgcaagaacaccagaaagggaaaggctagcaagttagctccacggacaagcaagcacgactgatgtgtgaagcctacctaacatgcgtgcagcacatcagaccatcagtcctggatttcgaccggagtgccattccatatactagtactatgcatgagttcatatgaaacctgctggagtttaatgatgagtacatgaaaaagtggagcggttcaggtggatcgcagagccaaaggacgcgccccatatgcatggagcaacggaggaggcgtgcgggctggcgccttgtccatgcagaccatgcctgtatttagtgcgagtcttgcgtcca

SEQ ID NO: 194 - DNA, 3067 bp, Zea mays
taagggagaaaattaagtcgggtgtattatcgcatgtaaatgcgagattaaatttcaagcatgcaacaacgatgtaaacaaccgacactatattttttagatctgctaaccacctgtcataaagttgatatagttaggcgtcatttggatcagctaaactcaactacatctaactcttacgtttttgtctcttgttgatcttcatttttattagttttaagatctttatgcttaacaaaatagaacaatttttgcagcgcatacacaataaatggcatactatatttggcatttgtcgtcattaattatagtctaatatagtctaacaatttcatcatcctttgtttggcctcacacttgcagcttatcaacattatgcaaaagttttagatcttattaaatagacagctttacctgtaagttgttccttttaatggtcccactgtaaaattcttacattgtgttaagttgttcccacacataattctttttcgtttgttaatttggaattttatggcctcccacttgtagcttatcaacatcatgcaaaagtttttgatctgcttaagtagacggctttacctataagttgttccttttaatggtcccactgtaacattcttacattgtgttaagttgtttccacacataattctttttcgtttgttttgttgaaattttatggtgcttctctaactttaggatcttgtaagctttatttagtttttaaccacttccctaatatcttctccaattttttgggtatctgaattgtcaatactaatttatgaaataaaatttagtcccgacaatttggatcgcaaaaaaagttggaagatattagataagagataataaaacaaaagaaagcttccaaggttatgagatcagataaggacaaagaaaattcagcataactgcggaaaagaattttgtgtggaaccaactaaagacaatggaagatgcttacactaggaccattaagaggaagaatatagaggcaaagcaggctactgaagccattaaaaagtttttgcataatgttgaagagtttatttgtttgcccaaaagaagaatgatgaaattgttagactaaaaatattgacgacaaatgccaaatagagaatgtcatttcttgaggatgaggtgcaaaaattgtcgtcattggtcaaggacaaagatcttgaaacttataaaaataaaatcaactagagactaaaatacaagatttagttgtagtccagactaactaatccaaatgagacctaactatatgaataggtggttagcaggttactggttcttattggttgagaaacttctaatgccgatggaatttgctatgtgggtaaaacctgaatcatgtcacatgcactcttctagagactaaacataagagttaggtgtagtttagtttaactgatccaaattaggcccaactatatgaaatttatgacatgtggttagccggttactggggtattattgggtgagaaacttctcaggctcgtcaagtttttatgtgtgtaaaacctctatcatgtcacatccactcgtaagaagactcggttgtattcctattaatagaaatgggtgtttcctctctaaaaaatttgaactaacttagtctctatagacaagtttagtgacctcatgggcaatttactctagcaggccccaaaagacaaacaacaagttacctacttctccataaggaagtagcaatcaataacatgcatgtttgtcaaactgaccactaagacctgattgtagcaaggtcgcacgatagttcctgaccgacgagacccaatttgcagtagaaaagcatgcataaggttttgttgacacctagaggagacagatcctactatcaggtcctaaggaagcccacggaggggctgcggcagcagcagccatgggccctccaagggggattagataaggatagttagagataagattagaagattagttgagattatctaaaagattagttgagattatctagtaaggttgtcagttagtatttgttgagagttttaaggagataaggatctctagctagataggggcggctagctggactatttatatgatcaatggatgagaaataaagtaggcaagaattagaagggagaaaccctcctcttgctcggccgtgggcagaggcccccggccagcgttcctgtccatcgatacccctcttcaatccctcacaaatctagcaaccataacatatggtattcggagccaattttttcccatcgccctttcaccgcgtatgttcctgcgctgttcgcccgcaacacacagccgccaccacatatctgtcgtgtgtccaccacatctacgtcgtcgctcaccaccacacctcaaccagcgcgcttacaaccgacccgccagcgccgacgcgcgatccctcgcgcgtagcccggcgacccactcagcgccccttgccaggccacttccatgccagaggccttaccgctctgggtccaccaccaccgcctccaccttcacaccggcaggttgcatcaccctctgcgccgttgggaaaccttcgccccgtgccaccgggacgccacctccgcaccatgctttgggcgccattgcgggttgcctagacccaaccggacccgatgtcgagtggtagtggctcgttcgggcgtgcagtcccgttgtacgcatcggaagacccatcgttgcccaagtcttggtgcggcctcttcgacggcattaccggctacctctactactagaacccctacaccaacgtcccgcagtacgagtggcccacggctgcgcttctgcttctcgtgggtccttgggttcccaaccaggcatactttgatgatctgtttgcgaagctcaatgcaatcaacatggcgctctacagcagcacgccagcaccagcggcctggccgtcgtcgctcgcttcggcacctacatcttcgtgggtggcaatgcctaccagttgtgttgcgctctcagggccgtcttcatcaccagttgcatggttgacgacgccaggggaaaccatatcaggaccggtgtaccagcccctagc

SEQ ID NO: 195 - DNA, 3220 bp, Zea mays
atttaacttcttcagaaaattgagatatcacaactctgcaaaatagttaatcttgaaaaatctgcatatagcaattcaaatacttttaaagatatctcattctttaaaaaactgaactttaatcggcatgcgaccatctaacaatagttaatcttcacgttattgactgttttcaatattagttgatggtggagcgtgtgaaacaacatgttggatcattctgtaaatctaccacataatttagggctttgaaaagcttcaaagttttcgcatggttcatgccacaatcttttcgagaaaacatgcacgaaatcatgaccctttactcacaaatcagtgtattgcgaaaacttttatgacaaaccttgttgggtcctttttgtgaaaactaccgttctaaacattacatcatttagggctttgaaccgcttcaaacttacattaatgtccataaccatgaaacatttaaaaaatttccacatatctcatgagataacatgcccaaacaagtgatgtttacagtttgtcaataagcaaattgtaatgtaattttccttggttaaattgttttgtgataaatgtcatgagtcacataattgttttttgagtggcctcaaaacatgcattgttgtccataaccaagaatcatttaaaatagcactacatatggtttaagatagcatgcctagactattgttgtttatagtctagcatagagcaaattgtaattaaaattggaatgaaatttttctatattaattctttcgttataaatatcattgatataactgtaatagaataataacaaagaatcgtaaaacatggatcaaaataaaagcttaattgcataaatatagctctcaactccggaaaattaccgatctaaaaaatatacatgttgcactttaaacatttctaaagttacctcattcttcatatctacaaactatagtggcagcattcgaacatccaatatcttgggccccaaactcatgctataggttgtcttgcacttaggttgatgatgaagcatgtgaaacaacatgttgcatagctcatgcctgtagtaaattgatgatttgaaaaaaaaatctacatgttacggttagcatgcgacaatctactgctcaagcgcttttagagtcacctcatcctttatatgaccaaatctactgctagcatgcgacaatctagggtcgcatactcatgttacggttgtcttgaacatgggttaatgatggtgcatgcgaaacaacacgttgggtcaatctgtaaaaactgtctgtctaaacaatacaacatttagggcttcaaaatgcttcgaagttgacacacatcagaaatcgatatatcatgcagcaaacttgtacgaatataatacccatttgtcccatacacatgttttgatcggccttaaacttgggttgatgtgttcacaactgaggaacattgcaaatagcactatatatgtttttaaggtaacatgcttaaacaagtatgtcttatagtacgacatttagaaaagagtaatgaaagtataaatataaattttcttccattaactatttttccattaatagacaccgtaactctacaaaatagtttatcttgaaaaatctgcatattgcaattcaaatacttctaaagttacctcatcctttaaaacactaaaccttaatcggcatgcgaccatctaattatgtgggtcccatactgaagttattgagtgtgttgaattttagttgttggtggagcgtgtaagacaacatgttggatcattctgtaaatctaccaaataatttagggcttcaaaaagctacaaagttttcgtacggttcatgccacaatcttttcgaaaaaacatgcacaaaatcatgacactttactcccaatcagtgtattgcgaaaacattgatgacaaatcttgttgggtcatttttgtaaatactaccgttccaaacattacgtcattaagggctttgaactgctacgaacttacattaatgtccataacaatgaaacatttaaatctttccacatatcttatgagataacatgcctaaacaagttatgtttacagtttggcaataaaaaattgtaatgtaattttccttggttaaattgtattttgataaatatcatgagtcccatatttgttttttgagtggcctcaaaacatgcactattgttcataaccaagaatcattcaaaatagcactacaaatggtttaaaacagcatgcctaaactaatgttatttatagtctggcataaagcaaattgtaattaaaattggaatgaaatttttttctatatttaattcttttgttataaatatcattgatataattgtaatagaataataacaaagtatcttaaaacatggatcgaaataaaagaaaaattgcataaatatagctctcaactctggaaaattaccgatcttaaaaatatacatgttgcactttaaacatttctgaagttacctcattcttcatatcaaacaaactctagtgccagcattcgaacatccaatatcttgggcccaaactcatgctataggttgtcttgcacttgggttgatgatgaagcatgtgaaacaacatgttggatagctcacgtctatagtaaagtgatgatctgaataaaatctacatgttatgcttcaagcgcttctagagttacctcatccttcatatgaccaaatctagtgcaagcatgctgcaatctagggtcgcatactcatgttatggttgtcttgaacattggttaatgatggtgcatgcgaaacaatacaataagttgggtccatccataaaaactatctatctaaacaatacaacatttagggcttcaaaatacatcgaagttgacgcacaccagaaatcaatatatcatgtagtcaacttatatgaaattaataatcattagtctcatactcatgttttgattgttcttaaacttgggttgatgtgttcacaactgaggaacattgccaataacactatatatgtttttaaggtaacatgcctaaagaagtatgtcttacagtacgacatttagaaaagagtaatgaaagtgcaaatataaatttgtcccctaataaattccttgaaataaaatgacatactcgaccacgttggagtccattatcgtttagacagtcgtcattgataacaagatcaaggccgacttgatgtggaccatcttattcacgaact

SEQ ID NO: 196 - DNA, 3175 bp, Zea mays
gttaggtgcagtttagtttaactgatccaaatgaggcccaactatatgaactttgtgacatatggttagcaggttactggggtcttattgggtgagaaacatcttaggctcgtcaattttttacgtgtgtaaaacctcaatcatgtcacatccactcgtaagaagactcggttgtattcctgttaatagaaatggttgtttcctctctaaaaatatgttgactaacttggtctctatagacaagtttagtgaccttgtgggcaatttactatagcaggccccaaaagtcaaacaacaagttacctacttctctataagaatgtagcaatcaataacatgcatgtttgtcaaactaacaactaagacccaattgcagcaagagcgtgtgacagttcctaacccacgagacccaatttgcagtagaaaaccatgcataagattttgttgacacctagaggagacagttcctacatttttctactctagtgcacctaattgggcctataaataaaccaacaatacaccttaagggagaaaattaagttgggtatatgatcgcatgtaaatgcgacattaattttcaggcctgctccgattgtgtaaacaagcgaaactatatttttcagacctgctaaccacctaacacaaagttgatatagttaggcctcatttggatcatctaaactcgactacagctaactcttgtgttttagtcttttgttgatcttcatttttattagtttcaagatcttcatgcttaacaaaagagaacaaatttcccagcgcatcctcaagaaatagcatactatctttggcatttatcgccactacatgtcatctaacaatttcaacacctttatttgtgctcccacttgtagctcctcaacattatgcaatagcttttgagctgcttcagtagcccgctttacctgtaagttcttcctcctaatggttccaccgtaacattcttccattgtcttaagttgtttccacacataattctttttcgtttgttatgctgaaatttcattgtgcttctctcatcttaggatctagtaagctttctttagtttttaatctcttccctattctcttctccaattttttgggatctgaattgtcaatactaatatatgaagtaaagtttagtcccaacaattcggatcaccaaaaaagtgaggaagatattaggtaacatataagaaaactaaagtaagcttccaagatcacgagattagaggacagtgaaaattcagcacaacaggcaaaaaagaattttgtgtggaaccagcttaagacaatggaagaagattacactgggaccattaagaggaagaaaatagaggcaaagcaggctactgaagccactaaaaagtttttgcataatgttgatgagttgcaattgggtgcccaaaagaaggatgatgaaattgttagactacaaatagtggcgacaaatgccaaaaggaggatgttgtttcttgaggatgagctgcaaaaattgttgtctttggtcaaggataaagatcttgaaactttataaaaataaaatcaactagagactaaaatgcaagatttagttgctgtccagattaactaatccaaacgaggcctaactatatgaataggtggttagcaggttactaggttcttattgggtgagaaacttttgatgccagtggattttgctatgtgggtaaaccctgaatcatgtcacatccactcttctcaagactaaacacaagagttaggtgcagattagattaactgtggcctatataaaataatgtggactaacttgttctctatagacaattttttagtgatctcgtgggccaaaagttagacaaaaagttacctacttctccatgaaaaagttgcaattaataacatgcatgttggtcaaactgaccactcagaccaaattgcagcaagatttggcaaacggacaaactgcaaacataaatgaacagtcaggactcacaaaatcaataggcttgtgctatttccctctctctctccctcaccgagaagacatgtacacaactctctatcttgtgagtatcaggagcatcgtcttgctagctttttcctaccagagcaccacactttctcatagcactagatggcacatcattgatggatacctacatagaacgctagcacccattaaataaatataagtagacgacgacatgcctagaaactacacctctcgtctcgtctgggccacatgatgcacgcgtcttactgtgagaagcggtcactacttcaggacaaccgtacgtgtctctccaaacataggccacactagagcgcgttcttcaactagtggacgcaagactcacactaaatggaggcatggtctgcatgcacaaggcgccagcccgcacgcctcctccgttgctccatgcatatggggcgcgtcctttggctctatgatccacctgaaccgctccacttttttatgcactcatcattaaactccagcaggtttcatataaactcatgcatagtactagtatatggcatggcactccggtcgaaatccaggactgatggtctgatgtgctgcacgcatgttaggtaggcttcacacatcagtcgtgcttgcttgttcgtggagctagcttgctagtctttccctttctggtgttcttgcacctagctacagcagatcacgagagctttcaagcccgttgtacgtgctagaggccagaggctctccctagctccatctgaaaaggctgcagcaggaaatgacttttgattcacccgctactaatggtgcttcatctcttaggctctctattgatccatatccatgtttggtactagtacggtgtggtcgtcagcaccacacacaccactgttcggtcctagtgcaatgatggcaccttgatcgtctttctacatctccatcaaaaatgaactaataataatattcaagaaaaacaaactttatatacgatcggtcgtacttacttaaagctaatagttaatgtaataaataaagcaacaaattcaaaaaagggattacattatttgagtatttagttcgtgaataagttggtccccatcaagtcggccttgatcttgttatcaatgacgactgtctaaacgataatggactccaacgtggtcaagtatgtcattttatttcacgaaatttatt

SEQ ID NO: 197 - DNA, 3173 bp, Zea mays
cccggttcttctcctctgcggcgaattagagcttgctggtgccgctgcgcgtcggtccaccgcacctacatggcgtccgaccgatgcggctctaccccttacccaagttgtggccctagatgtcccaaacccctcaccgaagctcccactgtcctcggtgcgcttgatcgctacccccgacccacccggttcttctcctttatggcgaattagagcttaccagtgccgctgcgcgtcggtccgccgcacctccatggcgtcctgccgatgcagctccaccccttgcccatgttgtggccctagatgtcccaaacccctcaccggagccctcgttatcctcggtgcgctcaatcgccccactccgtggctgggattgctcgctagaataccccgacccgcccggttcttctcctctgtggcgaattagggcttgccggtgccgctgcgcgttggtccaccgcacctccacggcgtccagacgatgcagctccaccccttgcccaagttgtggccctagatgtcccaaacccctcatcggagcccgtgctatcctcggtgcgctcgatcgccccactccatgtatgggattgcacgccagagtacccccgacccgccagttcttctcctctgcggcgaattagagcatgccggtgtcgctacgcttaggtttgccgcatatcaatgtcgtccggccgatgcagctcaaccccttgcccaagttgtggccctagatgtcccgaacccctcaccagagcctgcgctatcctcggtgcgctcgatcgccccactccatggctggcattgctctctagagtacccctgacccgctcgattcttctcctctgcggcgaattagagcttgctggtgccgctgcgcgtcggtccgccgcacctccacggcgttcggccaatgcagctccaccccttgcacaagttgtggccctaaatgtcccaaaccactcaacggagctcgcgctatcctcggtgcgctcgatcgccctactccgtggctgggattgctctccagagtacccccaacccacctggttcttctcctctgcggcgaattagagcttgccagtgccgctgcatgtaggtccgccgcacctccacggcgtccagccgatgcagctccaccccttgctcaagttgtggccctagatgtcccaatcccatcactggagcccgtgttgtcctcagtgcacttgatcgccccactccatggctgggattgctcgctagagtacccctgacccgcctggttcttctcctctgtggaaaattagagcttgccggtgccactgcgtgtcggtccgccgcacctccacggcgtctggccgatgcagctccacccctttcccaagttgtggccctagatttctgaaaccccacactggagcccgcactgtcctcggtgcgcacgatcgccccacttcgtggctgggattgctcgctagagtacccccgagccgctcggttcttctcctctatggcgaattagagcttgccggtgccactgcgtatcggtccgtcgcacctccacaacatccggccgatgcatctccacaccttgcccaagttgtggccctagatgtcccaaacccctcaccggagcctgcactgccctcagtgcactcgatcgccccacttcgtggctgggattgctcgccagagtaccctcgaccttaccgattcttctcctctgcggcaaaatagaggttgccaatgccgctgccgtcggtccgtcgcacctccacggcgtccgaccaatgtagctccacccttgcccaagttgtggccctagatgtaccaaacccctcactagagcccacactgtcttctgtgcgctcgatcgcaccactccatggctgggattgcttgctagagtacccccgacccacccggttcttctcctctgcagcgaattagagcttgccggtgccactgcacatcggtacaccgcacctcaacagcgtccggccggtgcaactccaccccttacccaagttgtggccctagatgtcccaaaccccacaccggagcccgcgctgtcctcggtgcgcttgatcgcccgactccgtggctaggattgctcggtagagtacccccgacccgcccggttcttctcctcttcagcgaattagagcttgttggtgcctctgcgcgtcggtccgccgctcctccacggcgtccggccgatgcagctcaccccttgcccaagttgtggccctagatatcccaaacctctcaccggagcccacgctgtcctcgatgcgctcgatcaccccactccatgcctagcattactcgctagagtacccctgacctgcctggttcttctcctctgcagcgaattagagcttgccggtgccgctgctagtccgtctgccacaccttcacattgttcggctgatgccgctctacctcttgcccaagtggtggccctagatgtcccaaaccactcaacggagcccgtgatgtccacgatgcgctcgatcgccccactccgtggctaggattgcttgctagagtacccccgacctgcccggttcttcaactctacggcgaattagagcttgccggtgccgctgcgcgtaggtccaccgcacctccacgacgtcggccgatgcagctccaccccttgcccaagttgtggccctagatgtcccaaacccctcaccggagcccgcgctgtcctcggtgcgctcgatcgccccactctgtggctaggattgctcgccagagtacccccgacccacccggttcttctcctctgtggcaaattagagcttgctagtgccgctgcgtgtcggtccatcgcacctccacggcgtccgaccgatgtagctccacccctttcccatgttgtggccctagatgtcccaaacccctcacaggagcccgcgctgtcctcggcgcgctcgatcgcccaactccatggatgggattgctcactagagtaccccgacccgcccggttcttctcctctgtggcgaattagagcttggcggtgccgctgcgcgtcggtccgccgcacctccatgacgtccggctaatgcaactccaccccttgcccaagttgtggccctagatgtcccaaacccctcatcagagcccgcattgtcctcagtgtgctcgatcgccccattctgtagctggtattgcgcaccaga

SEQ ID NO: 198 - DNA, 3172 bp, Zea mays
tccccccccggaaagattatacaccccctggggggaggagtggattacaactcacacttgtacactatgattaccaaaatcgacccaaagaggtccagccttaaggaccaagtcctggagggcagtagcccctgctaggcaccaaaactgaccttcagtcttaatagcaagcacgaccttttggacagcaggacttaaaagcatgtgattcttatctcttacttcccctaagcaatcgatccttatcccttatcaaccctaacattaatgggctatacaacctaggcccatgacatacgcctctaacactgattgatagaatccttgattctatagcggttgtgaagtgcgtaggaatttgagattgggggtcaaggtcagaatttccgacttcgagaagacgccgtggtggcttgggtgtagagcggggcgtgacgggagcgtgggtgagagagaacacgtaggggatgcctttgaggcccagcaagatgttttccttgcttccttcatctagttacatggctcctatatttatattccctaaaggaattagttcccgagcaaactaaaaaatgaatccttatagatttggactctcctttcctaacaagaaaaccttatagattggactctcatttcctgacaaactaattctatttcctaaatgggtactattcacattgagcgtagtttgcgggcccaacacctgtgtggcccattttctggcaacataggagataacggtcataacaagctaccacacaaataaatcaggtaaaaaactattattgcagatttaagactcatgccgtatgtcgaaaaagctacctacaatgcacaaagaaacacaatgaatcaaaacatctgtgaaaacatatttgccaaattccttgtgtccacattacacttacataggaaaatgtggagcttcctggaacatcttgccaacattggagtattttttcttttcatcatatgcaattcctttgcccaacccataaccaaagccaattcccacaccacatccagctccaactccaaagcctaatgtgagtccaggaaatccatagcctaaccctgcacctaaagtaatcatggagaaaaatataagtgtgcagacatatagtattcatgatgaaaaacaaattattctcaacatcttttctatacaaagtgtaagataatagcgcaggcacatgaccattaagtcctgtaactcctagtatcaacaatctagaaacatattaagttttgaaaaaaaatgtgcatattatataggctctaatgttaggtgtgaccgtgtgagcaacaagaaccagttgatatgtaaaaatcattttatacatttatgtctctggagtctggagttcatgattcttcataccatattttatctttcagacataaatcctgtgcttaagccaagtgcccaagtgcgcatttcagctcctcaaagttcaactacaggtctacagcaaagtcattgtatccttcagtcttctatatatttagatgtacactcacctggtgccatgtggggaattcctatgtatagtttatgccacagtgtacacatacaatcactgcctcagttcctaccctgggccttccatcccctcaaatataaaacaggatctttcatatatttagttggttaaagtggacatcagatccgtctgacactgtatcatatttttttttaaaatctgaagtggcaggtactaattcatccactcattttttttcagaatgctaacaatatcaacaatcactatgccactggcattaggcattgatatttttttgctgacaaccatgcacatgtataacttggtaataatgtatttcaattcaaaaatgatgttgtaagaacatatatgcttaggagtacatagtttctgaatacgcataacacagaaaaataagaaagtagtaaacccgaactccaggagttatacattttttttttgtttcgaggtgacacaacatttagtccacaaataatcagcaaataaccacagcttgtttgggaagaataactatcctaacatcattaaggattaagcagtgaaacacacattgtctcggatattcaataattattctatgagcaccatccagcgtcacccggactgccagctagtgcctaagtttttcagaacgctgcctataatgtgaaaaaattggagccaccagttggcaaaaacataaattgttaagcataatgccttgactgtcaagttcccaacctaggatgagacattttaacggaactagtgaatgttacaagaaaattgtgaaatatcttctgataagattcctgatttaggactgtgaatcttgtacaattgcaacaatctgtaatcgataaaccctccggtaaacctatgtcctgcaaggctgatactagaacacctgtaatttaatctactaataaaccaattgaagaaacaaaaataagaatcgctaccgatgcagaaaatgataaaatctctcaggaataaattaagcaatgccagatcagcagaccctgaaacaaatctgtttgaacaacttttaattgggaaaaccatatgcacgctaaccccccctaagaagacagattgtagaatagccaacaaaaggaactgtaagtaaagtacacaccaacctattgaagctcaatctcatttacggtaccctaatggactgaatcaatcgaggcgtgaaaagaagagagcaaagcggacggttcttttagacaagaactgaccagaaaccaacaaatgctaccatttcgaggaagagagtgagaagaaggccagggattttaccaccgaagaatccgatgcctgcgccggcgccgcagccgatgccgattccgagggcggggcctatcttgccgagctccttagaggtgacctccggcagcctccagaggaggaccttctggtctcctccgcctcctccctgtttcttagtccccatcggaatcttctccccttcccagttctgcttccgcctcggctcttccaaggctttctgttccggttttgctgtgtgtttcgtgtcgaactggctactggcaggaccggtctatcgtagccggtttgtttggatttactagagctagctagtagttagtgtctaaaattaagtaaagatattcaaacattctagctaatagtttagc

SEQ ID NO: 199 - DNA, 3169 bp, Zea mays
gactggccgtcgacggctggcgtgccgctttgctccgtttttcgtagcagcacaaactcgtctttcccgtgctgggcgtcccgtctcctctgcgtctaggcccagtttgctccgccggcattgcacagcgcgcacgtcgggtcctgtggcgcaacggataacgcgtctgactacggatcagaagattccaggttcgaatcctggcaggatcgtgtctcattttgcgcccgccaggccagtcacccctcgcggacgatggtttgggaccgctctcggcggcggtcgtccgtctcgcgccctcgcttccccgacaggctccatcacctgtcctccattcgggcaccggccgccgacacgacgctcgcgaatggcagcactctgcacagagtcgtctctcaccagcatcggtggttcagtggtagaatgctcgcctgccacgcgggcggcccgggttcgattcccggccgatgcaatttttgcctcgtgccaacgcgtcgcggaggggcggcccggctggcgctgcagcatgtgacctcgcagcggacggtgggcggacatcaggcctccgtggcgcaatggttagcgcgttcggctgttaaccgaaaggttggtggttcgaccccacccgggggcgtcacgttttgccagtcgtcatctgggacgacgcgcaggacgcgggccacgcctggagcaggaggacgaatcggggcgagcgggcagcagggccagcagccgagcctggcgtcgcgctgtgggcgagcggtgacgccactcgtccggcgctgcattgtccgcaactcggaccgtgtggcctaatggataaggcgtcggacttcggatccgaagattgcaggttcgagtcctgtcacggtcgtccttttgctaccctgccccgaccctcggcgccagcgtatgcgtgatgcgtgttttgcaaaatgtggcagcggtgggattcgaacccacgcctccgaggagactggtgccttaaaccagcgccttagaccgctcggccacgctacctcccatgggcgagtcgagagccgctcaaatgttgactgactgccaccgacgggcagctcggccgcagggcgacgagggcaaaaaagtgattccgcccaggatcgaactggggaccttctgcgtgttaggcagatgtgataaccgctacaccacggaatctcgatgagagcacagcccaccggcttcgtctcatgagcctacgcctcgtccctgtcgggcaggaccctcgccattccgggtcacctctagctagcgtcaccaccacacccttccgcggcccaccgcgccctccgcgctctcacgcgctctggcccgagcgacgcaaaacgaaccgctgcgacagccgggaatcgaacccggatcaactgcttggaaggcaactatgctaaccactacaccactgtcgcttggcggcgacatgagtgccgtctcgacgtcagagccctcgcacgagcaggatcaggcgcagacccggcacccggcctttggcgaaccgtggcgcgggccgaggcggtcgactgaatccagttggtttccgggcgcttccttcaaaccgtctgcaaggtggtgtagggcgtgtgcgattccgtggtgtagcggttatcacgtctgcttcacacgcagaaggtccccggttcgatcccgggcggaatcacgtctctttttgccgcgcgtggcttgggccgcctctagccgactggccaccgccgcgaccagcgcctgcatggcagggagtctttgcaggccggcggcactggccccagcgtcgactccgtggcgcaacggtagcgcgtctgactccagatcagaaggttgcgtgttcaaatcacgtcggggtcagggccctcttttcgttttgcttgccctggccatcgcacgtatctgtgttaggtcgtcgattgcagaaggggtgagggagcgcgtggagcgaccgccacggccaccagcagcggtctgcccgccgccgcctcggtagcgcagtaggcagcgcgtcagtctcataatctgaaggccgtgagttcgatcctcacccggggcacaaccttttttccagaaggtcccccccgatgctgaccagccccgcgtgctgctgcggcgggtccggcgtcactcacagcccctatggctcagtggttagagcaccggtcttgtaaaccgggggtcgggagttcgaatctccctgggggcatgcgttttgctcgagacgcgtgcgacccgtggacgcacgccacaggaggcgcagtgcgcgtcgctccttcatccgtccgatatggtctagtggttaggatacctggctttcacccaggtggctcgggttcgattcccggtatcggaacgtaccaaacttttatgatgccagcagaatcgcgagacgaacaacaaaaaaatgagtgactccttcgagccggatttgaaccagcgacctatggatgcccgcacggcgagtgactcgccaaccacctacagtccaccgctctaccaactgagctatcgaaggatcttgtgaacgggtgtcggtgcgtggcttggcatgcggagcgaggcggggcgatgcggcgccgagcggagccgcatgctgcggtggtcagccgcagggcagagacggtcgggagggggtagggaatggggggcgcagggggctggcgtgcacttttcaaagtgcttgtgaaagtgcttgctaaagtgcagcccttggcagccacttgtgcacttggggcactttcgggcacaaaagggcataagaatggcccatggggggatcgaacccacgaccttcgcgttattagcacgacgctctaaccaactgagctaatgggccagtgatgctagtctgtccgtcggcgatggcccaagagcgacggagcgacggagtgccgaggggagcgagagagagaaggagagggggcggtgggtgtgcgcggccggagaggcgacgtctcgttgtgatcgtcttggcggcagggatgcatcatccggccgaaatagctcagttgggagagcgttagactgaagatctaaatgtccccggttcaatcccgggtttcggcagttgcctcgccaacccttttccccttttttcgcgtctcgtcctctggtgcctcactcatgctcgtcgcgcctgacaccctattacccgtgtcgagcccag

SEQ ID NO: 200 - DNA, 3165 bp, Zea mays
  misc_feature (173)..(174): n is a, c, g, or t
aataaagttatctaccacttttctatagcacatatctacataaaataccatttagttcatcaaacatacagtacggggaaatcgctgcgtgcagtccaaaacagcaactaataaatttcagctctcatacaaatcaagaattgccgcgctctagagacttgaattattctaannctttaccatttgttagagttaacataaccaagggagaactaacaagtagacttactaaatttttattcgtgtcattttgagcactagaagtatcatacttaattaacaacgcattctctacgataatcaatatcgagacgcctttcacccaataatttgtatttcacttagacatcacacgagcactaatacttttcatctgcgaccgtaaccatacgcatttagaatacaacaagcaaatcatcgtgactacgatcttaaccaaatcatcgaacaatttggctaactagagcaacgacacggtccgctcgacagcatacacgtcggcttgcctattactatcgcaatctgagacacaacatatatatataacaatcacttaacgcaattgactcctacgtaacaggagttggctaacacagtataaaacttagcaaaccatttttgacattgcgactcaaaatatgggtgggagcggattaattagcttctcttaaccatttctcaacttaaattggataacacacaagtcacctaaaatagcacattgttggggtctaacatagaggtactaacacatggcgtaaaattccataagatcacatctgctaccgagggacataaagcacttatgtgcacatcttatcggattgttcttccatttttaacaaggactgacttatgaacgctactcgccgccaataattattgggctgcaataacgctcataaaagatttctaatcgatcaacaagacatttatttatcccatggccatggaatgtgatgattgacaaagtgaagcatcacattgccatacaacaaaaatcatgacaacaccgatagatactatccactacccgtttgaaaaactaaacttacttcttgcttgccactacatcactcctcaatcatacgaccatcatgagcatacttcacacgactatataatagcgatctaagcgtcgtgttgcacaatacatacatctttcctcattgcgagtataaccatattacggcgtatacccgcacacctcaaacaaatatcttactccaccatttaccaaaatacaccacggcacacacacgcacatacgtgtccccatattacgcacaagacatccaccgcacaagtgactccaaccggattactcatactctcatttgcatcgactatcacaatcaccgctcacatgcataaaacaaatacacttttcacgtagacacctatcgatgcattccccaacacataacccgccttttaaaaattatcctcacatcacatgtatttccaaatttactcatcacattaaacaacaccacacgttccttaccaaaacatgaatgcgacctggccacggcatataaccaaatcattttatacccacacatatttaaacacccatgtacaccacatcgaccaaaacataattagacaaactacaaatcgcacgcatcgaacaacctcttgttctctaaccgcaaatgtgatcctaccaaaatataaaaacatccgagttcttgttctacttcattttcttctatatacgtgttcattcatacaattataatttcacgcacatattcacacacgcacatcatcgaccaaatacgtaaataaaacaaatcgcgaatcattcaaggcgaacaacctggccgaaaactgatcggagttgcacatgcatgccatcagactgggctctttgccgacgagcgacgcgcgaggtgtgacgacgacacggctgcgagcacgacacagtttattacacgatttgttggtgcagccattcaatcgaacacgaaaagcgtaggacagctagtagctcaccgaggttgttgctcgctgcacagattgacaactagcagagctcggcgccgacgtgctgggaaacgatggcagccagggccgtgtatatcgatggggctcgctgctgtggaccggcatcgctgcgtagatcggttgacgccgcactgggagggccgagcacaggggtggatggcagccagatggggagctcacggccatgggggaaatggagctgcgcagggaggtgaagctgaaggggggtggcgccatgggagaaaaaggtggacgagctgctgctcgccatggggaagagaggcagcgccatgggagcttggagctcggctccctgctgccgagcgccatggatccgcggggaaatgaggggctgctgccctgcgcgcgcactggagcttgctcgaggaaggggagggagatgttgtcgcgcgagcgagtaagtgcagggggcgccgcgccattgctggtcgagaggaggaagggcgctgggaggtggggtgcgcgcccttggagcagaggaacagggagctcggccatggcgcccatggcaacagcggctaacaaggccggccatccgaaatggggaggcgagcgcctagggcagaggttgggcggccgtggaagggagggagctcgtccgcgccatggaggagagctcagcggcattggtgcctagaggaaggagctcgcagcagggaaggctggcggccatggaggaagaaggcgtgggctgctgccgtgtgggagaagacaggaaaaaaagaaagtggcggctagggggtagatgaataatagccaagtgcaagtgaggggtccttctatttatagaagagctcttgggctagggttttaaatgggccaaacgggctggactggattcagcccaaaaacacgtaatcgggctgcactaaatattttccagaaataaaatgctcctgcgaaattcgtttctacggagaaaagagtgaaatagagtttcgacgaatggaagattgagcgattaattcggccgagcgtctgatttgatctcgctcggaaataactcctcgcgcatgattcgaaaataaatcgtcttaagatttgatcggctttggatttttagtcggagaaggcgaatcgtgatattttaagatcgctgtcgatgcgggtttttgagatcagttcggacat

SEQ ID NO: 201 - DNA, 3156 bp, Zea mays
aaaaaatcttctcctatccttatctgccgccgcccctcccttctgatatttaccaccgctctctttctcttatcgttttcgtggccgatggccttcacacagctgccgttttttttggctcatcttccctgccctctccctctcatttctctactggccggcgccctccccagccgtcgagctctcacgagtgcgcgcccctgcttccctgctccactcggcgcccctgctcctcccctggtcgtcgttccaagcccaaccccgacctggtgcggctggtggccggggtaaaaaggatatatctggatatatcaaccgctatagccggttatttaaaaccttgtcgggcagcagccgcagctgcaaccgggaggagaagcccaaggtgtcgtcgaaccccgtccttccgtgctcgacctcgccgtcgttcctcagcttcacgctgacggctgacccacagggccacagcccgccatggagctcccctgcgacgcgcctccaagtcccaggccagctcagcctcctccctagcgcccttggagccgacgtcccctccctccctagggctcgccccatctcccatggccacgtccggtccgcctcgtccgcccatgcccccttctccagctcgctctggacgcgcaactttctccccgtcgcgccgatccgcccgccctgccatcgatcttgtcggcgcttgtgtccctgtcatcctcgcggtagttctactccggtgtccttactctgctcgccgatcttctctgttgtggtgcgcactagctgtcttccttctccgtcggccacagctccttggtgccgagcctccatccccatcgcaacgtcagtacgtcacagcctcactagacctctgccgccatgttgcgcccatggatccagttgtgcatcacctccctacacagccttgtcgtggctgggtccggcgtgtcgtcgtgggggcgctcacttcgccgtggccctgcgctccctgctcgacgtagccctaccctgctctagtgccggtcatgctctgcgttcttcctctcgtggaacagctcgctattgcccatggtcactggtctcgtcctcacctcctgtgcacgcttgcaatgccatctccactgcgattgtcggtcatcacgacgtccctagtctatcgcgtcgtactcagatctcaccgatttactctcgccatccaccgtgctgtgtgtcggtgttccctcccggcagaccacgccgtcgtctaaccttgttcgctttgctgcagcaccatcatcacctgccagctccgttcctattatttttccccaacaccgagcctctctgaccttgctgctcgtcggtggttagtggtgtccgaagctaccaagtttaatcctatgtgtgatggtgatgttcgtgcgatgctcattaaatgtttgacaaaaatcccgaaccaggagtggctgctccatcttcttcgtcgaatggaaatcatcgtgctgacacgtcgatgtcatcgatcaccatcctcgtctacgctaagtccgtgtctgtgtagctcattgccacaccctattgccgcttccacgacgttgtcgtggggacttctttgcgtcacgtgtgcttcctctcgtcacgctaaatcaacctgcttccatttgtgtcgacaacaagccgtgaagacactcttgtgctgaccacgcgccaccagctcgacaaaatgaatcccatgagttgcatcgctcgcaaggtgtgtgcggtcaaagacgtcaagcaaaaaccatcgtcgttcttccgactattgtgtcggattggtcatggtaagccaatttgttatttgtgttagttggattgatgaatgatctgactaggtatattaatcatgatgattctgtggtgagtcgaatttctatttctgttattagttcgatgaagggatttgttagatgtactaattatatcggtcctcttgcctttagcatatgtgtgtcgtggttgtaggtataatatttactggaatatccgagtcgtttgcagtggtttggtcgatgtcgtgtggtgaatcgctagtttgagatataggttttgggaagagtgcttgggggtatacttgtcaagcatgtttaaaccggttgtaagtttgaagtgcgtggtatattggtggtgcgtaggttaaatttagtgttttaagcaattatcgataagtctatcgatgttaattatatttagtgtgtttgtacgatggagtcgatgccatgtgctagtagtcattatattctatgattggtggtcgatcaaatgtcgtgattaaatgttaccggctaccataagaatttggaagcgagtagcgttagcgagccaatttcagtcgaaatacaagaaacctcatagtagaagaggtataagtgctttaaaatctagattattgaggatgtagtttcacgagactataatccttttgataatgtcttatctattagacataagattaacgtgctgatttgcttagttggcatactattcaggttagattatattattaggttagaaagttaattaagggtttttatccttagactgagttaggtgtccctaaataataagcctaagtctggtccgccattttggtgtgttctctagcttaggaatatatatagaacttatgtttcgtttattatcgcttctagttcaaatcgggttcggttaagttaaaatagagtagaggttgtacttagtaatatatcggcatttggtaattgcttttaagtgttactatatgcctcgccgttaaatatttaatcctcttcggtgtagcaataattagtcgtgtgctattcttgtttatattcattcatgcacattatgcatttcatttaggtacgttaattaatcacgtggtgtggaggacaagaattgagtcgaccccaagatgatgtaatgagttggctactccgcaaggtgatgatggtggacgaacctgaagatggacagattgagtgagtgccagaacaaaagctgattgccaagagatcgtcgtctaaccaacactaacctagtgttattccaggcaattgtaacacctcgaaatattatattgttagtctagtaaaattttccatggattgtgaattaaaatacctttcaataagaatttcgttacctttagggttacatctc

SEQ ID NO: 202 - DNA, 3155 bp, Zea mays
gggagtagtaactttgaaattatgaatattctcaaggaaaggtgttttgatttaaaaacctctggagaatttttctcattttcacaggattgaactttagggtgttacatatagttgaagatagcatgcataaactattattgtttatagtctgatatagagaaaattgtaattaaaattggaatagaattttttctatatttaattcttttgttataaatatcattgatataactgtaatataataataacaaagaatcttaaaacatggatcaaaataaaagaagaattgcataaatatagctcacaactctggaaaattaccgatctaaaaaatatacatgttgcactttaaacatttctaaagttatctcgttcttcatatctacaaactatgtgccatcattcgaacatcaaataatttgggccccaaactcatgctgtaggttgtcttgcacttgggttgatgatgaagcatgttaaacaacatgttgcatagctcacgcctatagtaagttgatgatctgaaaaaaatctacaagttgtgcttcaagcgcttttagagtcacctcatccttcatatgaccaaatcttgtgctagcatgcgacaatctagggtctcatactcatgttatggttgtcttgaacatgggttaatgatgatgcatgcgaaacaacacgttgggtccatccgtaaaaactgtctgtctaaacaatacaacatttagggcttcaaaatgcatcgaagttgacgcacatcagatcgatatatcatgcaacaaacttgtacgaatataatacccattagtcccatactcatgttttgatcggccttaaaattgggttgatttgttcacaactgaggaacgttgcaaatagcacaatgtatgttttagggtaacatgcctaaacaaatatgtcttatagtatgacatttagaaaagagtaatgaaagtggaaatacaaattttcttccattaactatttttccattaatagaggtcgtaactctgcaaaatagtttatcttgaaaaatctgcatattgcaattcaaatacttttaaagttacctcactcttgaaaacactaaactttaatcggcatgcgaccatctaattatgtgggtcccatactcaagttattgattatgttgaattttagttgatggtggagcgtgtgaaacaacatgttggatcattctgtaagtctaccacataatttaaggcttcaaaaagcttcagagttttcatatggttcatgccacaatcttttcgagaaaacatgcacaaaatcatgactcttttacttacaaatcagtgtattgcgaaaagtttgatgacaaaccttgttgggtcctttttgtaaaaactaccattctaaacattacatcatttagggctttgaaccgattctgacttacattaatgtccataaccatgaaacatttgaaaattttccacttatcttacgagataacatgccaaaacaagtgatgtttacatttttgcaatgagcaaattgtaatgtaattttccttggttaaattgttttgtgataaatatcatgagtcccatactttttttgagtggcctcaaaacatgcattgttagttataaccaagaatcatttaaaatagcactagatgaagttaaagatagcatgcctaaaccattattgtttatagtctggcaaatagcaaattgaaattcaaattggaatgaatttttttctatatttaattcttttgttattaatatcattgatataactgtaatagaataataacaaagaatcttaaaacatggatcgaaataaaagcagaattgcataaatatagctctcaactctagaaattaccgatctaaaaaatatacatgttgcactttaaacatttctaaagttacctcattcttcatatctacaaactatagtgccagcattcgaacatccaatatcttgggccccaaactcatgttataggttgtcttgcacttgggttgatgatgaagcaattgaaacaacatgttgcatagctcatgcctatagtaaattgatgatctgaaaaaatctacatattgtgcttcaatcgcttttagagtcacctcatccttcatatgaccaaatctagtgctaacatgcgacaatctagggtcgcatactcatgttatagatgtcttgaacatgggttaatgatggtgtatgtgaaacaacacgttgggtccatccgtaaaaactgtctgtctaaacaatacaacatttcgggcttcaaaatgcatcgaagttgacacacatcagaaatcgatatatcatgcagcaaacttgtacgaatataatacccattagtccatactcatgttttgatcggccttaaacttgggttgaagtgttcacaactgaggaacgttgcaaatagcacaatatatgttacatggtaacatgcctaaacaagtatgtcttttagaaaagagtaatgaaagtggaaatataaattttcttcgattaactatttttccattaatagagttcgtaactctgcaaaatagtttatcttgaaaaatctgcatattgcaattcaaatacttttaaagttacctcattcttcaaaacattgaactttaatcgacatgcgaccacctaattatgtgggtctcatagtcaagttattgatcgtgttgaattttagttgatggtggagcgtgtgaaacaacatgttggatcattctttaaatctaccacacaatttagggctttgaaaagcttcaaagttttcacatggttcatgccacaatcttttcgagaaaacatgcacgaaatcatgaccctttacttagaaatcagtgtattgtgaaaactttcatgacaaaccttgttgggtcctttttgtgaaaactatcattctacacattacatcatttagggctttgaactgcttcaaacttacattaatgtccataaccatgaaacatttaaacattttccacatatcttatgagataacatgcccaaacaagtgaggtttacggtttggtaatgggcaaattgtaatgtaattttccttggttaaattgtttgtgataaatatcatgagtcacataattgttttttgagtggcctcaaaacatgcattgttgtctataaccaagaatcatttaaaa

SEQ ID NO: 203 - DNA, 3155 bp, Zea mays
attttataacgtttgtactataattatcaatcatccagtaattttctttacacgttaacaaaagaacaacatatatgcaatgattgtctagttactcagttaatttacagtaatcactagataattttacataaatcactcagtaatttgacagcaattgtttggtaattcttaaaccacacagtaatttcatttacccattgagaaaataacaacagatatatagtgattatctagttactaaatatatgtacagtctccactcagtatttttgcaccatttgttcagtaatttcaatcacccagatttagtagttacatagtaattctacagtaatcactgattaatttttcagcatttgttcaacacttccttagtcaccaagtaatttcattaacaaacttaaaataacaataaatatgcagtatttctgcagtatttgttcaacactgtctcaatcacacattaattttataacgtttgtactataattatcaatcatccagtaattttctttacacgttgagaaaagaacaacatatatgcaatgattgtccagttactcatttaatttacagtacaccatttattcagtaatttcaatcacctagattgagtagttacatagtaattttacagtaatcactgattaattttgcagcatttgttcaatgcttcctgagtcaactaataatttcattaacacactaagaaaataacaataaatatgcagtaattttgcagtaattgttcaacactttctcaatcactcattaattttataacgtttgtactataattatcacccagtaattttgtttacacgttgagaaaagaacacatatatgcaatgattgcctagttactaagttaatttacagtaatcactcgataattttacagaaatcactcagtagtttgacatcatttgttctgtaattccttaatcacacagtaatttcatttacccattgagaaaataacaatagatatgtagtgattatctagttactaaataattttgcagtctccactcagtaatattgcatcatttgtttagtaatttcaatcacccagattaagtagtaacatagtaattttacagtaatcactgattaattttgcagcatttgttcaatacttcctcagtcacctagtaatttcattaacacactaagaaaataacaataaatctgcattaattttgcagtatttattcaacactttctcaatcactcattaattttatagcgtttgtactataattatcaatcatcgagtactttacgttgagaacagaacaacatatatgcaatgattgtccagttactcagttaatttacagtaatcactcgataattttacataaatcactcagtactttgacagcatttgtttgataatttcttaatcacacagtattttcatttacccattgagaaaataataacatatatgtagtgattatctagttactaaataattttacagtcttcactctttaattttgcaccatttattcagtaatttcaatcacccagattgagtagttacatagtgattttacagtaatcactgattaattttgcagcatatgttcaacacttcctcagtcaccgagtaatttcattaacacactaagaaaataacaataaatatgcagtaattttgcagtatttgttcaacactttctcaatcactcattaattttataacgtttgtactataattatcaatcatccagtaattttctttacacgttgagaaaagaacaacatatatgcaatgattgtctagttactcagttgatttacagtaataactcaataattttacataaatcactgtaacaccccaggtgtttatttcccgtgcgacaacgagtatggatttaagcgcgggatatcagtaaataaaatggtgttgaattctagttatctttgtctatcacgtatttgtctccgtctatctaagccatttaaaaaaatttagagaaatttggactttaaaaatctttcaagacactgagtctatgctgttcagatcgatcggatacgtgaatatgatttcagaaagagttcaattttataaatttgaccatgatccatatccaagaaaaacgaggcgtagagttataaattgtgctgctctctagtcgaatgttcggatagcgggcaaaattcgtctaaatttaactgaaacgaatgcaaattaaaattaatctgttaaacgaatacgaatttagaaacttagttcagtcctccgattttgtcccaaacaagatttagtagaagtcgtgggtttaaaattaatcgaataaggcggattggaaaagtcacttaagtatttctctcttgttcgagcggtttctacgaattcggtagacactactaaggacaggctgtttaaataaaatgaacctgaactgaccaaactcagagcaattattagcagattcagtttcctatttcaaagtccaagaaaataatatgtgttgccgaaaagtcattttaattcggtctgtttgcttctcgcttatatgtacaccatcagatataaataactgatcaaaattcataagagtttcggtacaaaataaagcagatcaaggtaattagaaccgtgacattaagatcaaactaggagtaattgttgcgcaaaatacaaatcggagaggagattagatattaattaagtaaaacaaaaatagaagataaacctctcaccgctcaaccattttcttattccatgccatcgcattctcctggatttctcctgtacacgcgcccggctctggaattactcgacattttcttcactgcacgtttgctgctatccttatcctctccactgctttatttatcctctcgtgccttctcctcaagcgatgatttccagcgtctgctctggttgtttccgtggatcacagtggcggatccaggattgattcaagagggggctactaaatgaagactaacataaaaaaaatttaaaccaaacaaaaaatataattgatatttaatatgacacaagaagcaagttataatttaaacattgaagaaatatgtagtccaaaaataagtcgatacaaattctagaaatacaataatcttacacataccgttcatgagttgatgctgcgaggtaaatttat

SEQ ID NO: 204 - DNA, 3155 bp, Zea mays
gttaggtgcagtttagtttagctgatccaaatgaggcccaactatatgaactttgtgacatatggttagcaggttactggggtcttattgggtgagaaacatctttggctggtcaattttttacgtgtgtaaaacctcaatcatgtcacatccactcgtaagaagactcggttgtattcctgttaatagaaatggttgtttcctctctaaaaatatgttgactaacttggtctctatagacaagtttagtgacctcgtgggcaatttactctagcaggccccaaaagtcaaacaacaagttacctacttctccataagaatgtagcaaccaataacatgcatgtttgacaaactaacaactaagacccaattgcagcaagagcgtgtgatagttcctaacccacgagacccaatttgcagtagaaaagcatgcataagattttgttgacacctagaggagacggttcctacattgttcgactccagtgcacctaattgggcctataaataaaccaacaatacaccttaagggaaaaattaagttgggtatatgatcacatgtaaatccgacggtgtaaacaagcgaaactatatttttcagacctgctaaccacctgacacaaattgatatagttaggcctcatttggatcagctaaactcgactacagctaactcttgcgttttagtcttttgttgatcttcatttttattagtttcaagatcttcatgcttaacaaaagagaacaaatttcccagcgcatcctcaagaaatagcatactatctttggcatttatcgccaatacatgtcatctaacaatttcaacacctttatttgtgctcccacttgcagctcctcgacattatgcaaaagcttttgagctatttcagtagcccgctttacctgtcagttcttcctcttaatggtcccaccataacattcttccattgtcttaagttgtttctacacataattctttttcgtttgttatgctgaaatttcattgtgcttctatcatcttaggatctagtaagctttctttagtttttaatctcttccctaatctcttctccaattttttgggatccgaattgtcaatacaaatatatgaagtaaagtttagtcccaacaatttggatcaccaaaaaagtgaggaagatattaggtaagagataagaaaactaaagtaagcttccaagatcgtgagattagaggacagtgaaaattcagcacaacaggcaaaaaaagaattttgtgtggaactagcttaagacaatggaagaagattacactgggaccattaagaggaagaaaatagaggtaaagcaggctactgaagccgctaaaaagtttttgcataatgttgatgagttgcaattgggtgcccaaaagaaggatgatgaaattgttagactacaaatagtggtgacaaatgacaaaaagaagatgttgtttcttgaggatgagctacaaaaattgttgtctttggtcaaggataaagatcttgaaactttataaaaataaaatcaaccagagactaaaatgcaagatttagttgctgtccagattaactaatccaaacgaggcctaactatatgaataggtggttagcaggttactaggttcttattgggtgagaaacttttgatgctggtggattttgctatgtgggtaaaccatgaatcatgtcacatccactcttctcaagactaaacacaagagtttggtgcagattagtttaactgtggcctatataaaataatgtggactaacttgttctctatagacaatttttagtgatctcgtgggccaaaagttagacgaaaagttacctacttctccacgagaaagttgcaattaataacatgcatgttggtcaaactgaccacttagacccaattgcatcaagatttggcacacggatgaactgcaaacataaatgaacagtcaggactcacaaaatcaataggcttgtgctattgctctctctctgtcactcaccgagaagacatttacacaactctttatcttgtgagtatcaggagcatcgtcttgctagctttctcctaccagagcaccacactttctcgtagcactagatggcacatcattgatggatccatacatacagcgctagcacccattaaataaatagaagtagacgacgacatgcctagaaactacacctctcgtctcgtctgggccacatgatgcacgcgtcttaccatgagaagcggtcactactgcagctaacagtacgtgtctctccaaacataggctgcactagagtgcgttcttcaactagtggacgcaagactccaactaaatgcaggcatggtctgcatgcacaaggcgccagcccgcatgcctcctccgttgctccatgcatatggggcgtgtcctttggctctgcgatccacctgaaccgctccactttttcatgtactcatcgttaaactccagcaggtttcatataaactgatgcatagtagtagtatatggcatggcactccggtcgaaatccaggactaatggtcggatgtgctgcactcatgttaggtaggcttcacacatcagtcgtgcttacttgttcgtggagctagcttgctagcctttccctttctggtgttcttgcacctagctacagcagatcacgagagctttcaagcccgttgtacgtgctagaggcaaaaggctctccctagccccatctaaaaaaggctgcagcaggaaatgacttttgatcgagccgctactgctggtgcttcctctcttaggctctctattgatccatatccatgtttggtactagtacagcgcagtcgtcagcaccacacacaacactgtttggtcctagtgcaatgatggcaccttgatcgtcttttacgtctccgtcaaaaatgaactaataataatattcaagaaaaacaaactttatatacggtcggtcgtacttacttaaagctaaaagttaatgtaataaataaagcaacaaattcaaaaaagggattaagttatttgagtatttagtttgtgaataagttggtccccatcaagtcggccttgatcttgttatcaatgacgactgtctaaacgataatggactccaacgtggtcgagtatgtcattttatttcacggaatttattaggggac

SEQ ID NO: 205 - DNA, 3153 bp, Zea mays
tgttacatccttgcatgaaggctgattgtgttgggctgtagactttgtctgtcactaaaatcattctgtgtgtgaagttcaacctttgttaaggaggcatattggtctgtattgctgaacgacattagcgtccatgacttaagggataggagttattaccccaaagtcaagctgaatatatagcgatattttgtattttgcggatcaaattgaattcattttgtatttttctaattttgtctgaatatatagcgatattatttagtcatcacctaggtcatctttgcggatcaaattgttatactttgtgtcattatgaactcctaggcccagtttcgaatcacgagtctcttgctgcttcggccactttgtcttttttgcctaatgctggaatccttcccagctccattataacacatgctccatgtcttgcattatctttatgggactgtgtcatgtcacttgttgcttgttcttccatcattctacacttcacagctttattcatattgtgatgctacttgggctattgattcctctaatgattattgtgtttttaatgattattttattgcttggtagactaagtagacaacactttcttgttcaagtgcatagggtgatttgcatgctatgactattgtgatggctaaggtgatttgtgttgattgcttgtagatttatgtgtttctatataggtgctataagtatcgtacgtcctccatgagcgtagtaacaaagtgaggttggtgaatgactaatgtttgccatgtggccaaatcatacttaagaatttaacctctctaaatcaaccaagaagaagagtctgttccccacatttatgccttggccatcttccaataaagaagaatttcaaataatcgaccttacaacatgataaagatgattaacaggtgagacaagtccattttgggattgttgtgtttttctttgctagtggacgtacccgaccaagaacatttctcctcatacccaccaatagttttaatttcctcaaagggtcatctttagtatcagagaactggcaattagaatagcgtttgtggtgaattttatctattcttcctaatcgttcatcttccctatcaatgtcaactaaatcatacacaatcactaggtagcactcaataccacaagagaagagagcaactcacgctcatgacaaactctacccatgaattatttttctaagctctagtaaacgaaagcacatcaccacatgattttttttagaggaacatgtccacaatattaagaaactaatattacatgttatggaaaagtcttgaataatggaagaaaccgctttctatagtaaaggtgaaataaaagattaaagatgataagaggcatggtgaagtctaaagctacccatgattctataaagccaaatacaccagcataaaggatctaggtgacaacgagagtaaatatgattgtattgtgtggaataggtcaatacaaaccacatgtgtcataccttgttcgatacacattgaacaactaaaaataacatatattacattagcatgtatggacaaatttggggttagtaagaaaaaatacaatttctagcttctcagctgattatggtatacaacacgaccaacataaaattacactaggaaaaaaaggtaagattagaggagccatcacagagcatgtgaaccctactagtatgaacaatataaattttggtacttctttctagtagggaagcgagggaaaagattttgtgtcttctcttgttctcgaaacatatttctttataaagttacaaatcagctaaaaagatacaaaagtttagatgacaagttagcccatcataaggtcagaacattgttgatgatacgtaactttataaggaaaaatgttttgaggagagaagatagagaatcatgttttgaggaggtgggccagtttgttgtctaaacttttacagccctttcagatgatatgtaacattataaggaaacatgttttaaggatagaaaatatataatctgttcccacatttctctacccgaaagaagtgtcaaaagttctattgttcggactactaggcttcacatgctctgtgttgactcatatgatcttaccttttctcctggtgtacttttaagtgggtcgtgttgtataccataatcagatgagaagctagaaactttattttttttttcttacttgccctaaatttgaccttacatgctaatgtaatatgtgtacgtgtatcaaataagggatgtcataggtgatttttattggccaattgcacacaacacaattatattctctctcgggctcacccaaatcatctatgtcggtgtatttggccttaaagaatcatggttagctacagacttcaccatgtctcttttcattttactcttttaattcacctttactgcagaaagcgacttcttccattattcaagacttctccagcacagataatattaattcattaatataatatcgagatggtcctctccaaaaaaaaatcatgtggatatgtgtctaggtttactaaaacatagaaaataattgatggatatagtttgtggtgagagtgagttgctctcttgtcctataatattgactgctaccttgggattgtgcaatatttaattgacatgaacaacgaagatgaacgatgaaattcaccaccgtattctgcttgttgccagctctccgatagtgaagaagtatccatatatagatgaaattaaaattattggtggggatgaggagcaaggttgtatgatactagatgagactgtcaagacttccaactcctagagcctcgtatgtattcagtataaccacatgctgattcgaccacatatgtattcaatacgtaccatgaagcgtgatttgaaataggcaatgtagagggagaggggcgctgtcaaagttgaagatggcattctaatttaagcgaccggccggcgtgaattttggcacaatgtaatcaagattgcgggcagttagcagcacgatccaccataattaatttgctttgtcacaaaaactttgcatcttcgacatcgaagaccgtggtataccagaatggaaggggcggggctgagttcatacgtaccatgcatggcctcagatccgccctgggctgag

SEQ ID NO: 206 - DNA, 3151 bp, Zea mays
atttggtgcagtttagtttaactgatccaaatgaggcccaactatatgaattttgtgacatatggttagcaggctactggggtcttattgggtgagaaacatcttaggctggtcaattttttacgtgtgtaaaacctcaatcatgtcacatacactcgtatttctgttaatagaaatggttgtttcctctctaaaaatatgttgactaacttggtctctatagacaagtttagtgacctcgtgggaaatttactctagcaggccccaaaaatcaaacaacaagttacctacttctccataagaatgtagcaatcaataacatgcatgtttgtcaaactgacaactaagacccaattgcagcaagagcgtgtgacagttcctaacccacgagacccaatttgcagtagaaaagcatgcataagattttgttgacacctagaggagacgattcctacattgttcaactccagtgcacctaattgggcctataaataaaccaacaatacaccttaagttgggtatatgatcgcatgtaaatgcgacattaattttcaggcctgctccgacggtgtaaacaagcgaaactatatttttcagacctgctaaccacctgacacaaagttgatatagttaggccttatttggatcagctaaactcgactacagctaactcttgcgttttagtcttttgttgatcttcatttttattagtttcaagatcttcatgcttaacaaaacagaacaaatttcccagcgcatcctcaagaaatagcgtactatctttggcatttatcgccactacatgtcatctaacaatttcaacacctttatttgtgctcccacttgcagctcctcaacattatgcaaaagcttttgagctgcttcagtagcccgctttacctataagttcttcctcttaatggtcccaccgtaacattcttccattgtcttaagctgtttccacacataattctttttagtttgttatgctgaaatttcattgtgcttctctcatcttaagatctagtgagcattctttagtttttaatctcttccctaatctcttctccaattttttgggatccgaattgtcaatactaatatatgaagtaaagtttagtcccaacaatttggatcaccaaaaaagtgaggaagatataaggtaagagataagaaaactaaagtaagcttccaagatcatgagattagaggacagtgaaaattcagcataacaggcaaaaaagaattttgtgtagaaccagcttaagacaatggaagaagattacactaggaccattaagaggaagaaaatagaggtaaagcaggctactgaagccgctaaaaagtttttgcataatgttgatgagttgcaattgggtgcccaaaagaaggatgatgaaattgttagactacaaatagtggcgacaaatgccaaaaagaggatgttgtttcttgaggatgagctgcaaaattgttgtcattggtcaaggataaagatcttgaaactttataaaaataaaatcaaccagagactaaaatgcaagatttagttgttgtccagattaactaatccaaacgaggcctaactatatgaataggtggttagcaggttactaggttcttattgggtgagaaacttttgatgccggtggattttgctatgtgggtaaacccttaatcatgtcacatccactcttctcaagactaaacacaagagttaggtgcagattagtttaactgtggcctatataaaataatgtggactaacttgttctctatagacagttttttagtgatctcatgggccaaaagttagacgaaaagttacctacttctccacgagaaagttgcaattaataacatgcatgttggtcaaactgaccactcagacccaattgcagcaagatttggcacacggacgaactgcaaacataaatgaacagtcaggactcacaaaatcaataggcttgtgctattgctctctctctcactcaccgagaagacatgtacacaactctctatcttgtgagtatcaggagcatcgtcttgctagctttctcctatcagagcaccacactttctcatagcactagatggtacatcattgatggatccctacatacagcgctagcacccattaaataaatagaagtagacgacggcatgcctagaaactacacctctcatctcgtctaggccacatgatgcacacatcttaccatgagaagcggtcactactacaggccaaccgtacatgtctctccaaacataggccacactagagcgtgttcttcaactagtggacgcaagactcgcactaaatgcatgcatggtctacatgcacaaggcgccagcccgcacgcctcctccgttgctccatgcatatggggcgcgtcctttggctttgcgatccacctgaaccgctccactttttcatgtactcatcgttaaactccagcaggtttcatataatctcatgcatagtactagtatatggcatggcactccggtcgaaatccaggactgatggtctgatgtgctgcacgcatgttaggtaggcttcacacatcagtcgtgcttgcttgttcgtggagctagcttgctagcctttccctttctggtgttcttgcacctagctacagtagatcacgagagctttcaagcccgttgtacgtgctagaggccagatgctctccctagctccatctgaaaaaggctgcagcaggaaatgacttttgatcgagccgccactgctggtgcttcatctcttaggctctctattgatccatatccatgtttggtactagtacggcgcggtcgtcagcaccacacacaacactgttcggtcctagtgcaatgatggcaccttgatcgtctttctacgtctccgtcaaaaatgaactaataataatattcaagaaaaacaaactttatatatggtcggtcgtacttacttaaagatgatagttaatgtaataaataaagcaacaaattcaaaaaagggattacattatttgagtatttagttcgtgaataagttggtccccgtcaagtcggccttgattttgttatcaatgacgtatgtctaaacgataatggactccaacgtggtcgagtatgtcattttatttcacggaatttattaggggac

SEQ ID NO: 207 - DNA, 3150 bp, Zea mays
cttgatgatctagagagagcatttcaaaagttggaattggaagtagatgagtctctaagcaagatccgagatactgatgttcttgtttcaaatgaccctgctgctatagatagggtaaatagtgcaatatcatttagagttccacagacagtgaaaggtgcgaaaactaaacgagcaaggaatgtagttgaaaagaagacgaagaagaaaaataaaagttctcaagagcgaggtactcattgttgcatgtactaatttatttagtcaccaactcatttttaatagttgcaaatatatttaaggtataatgttcttttttatatatgtgaattgcagaagaaggaccaggtaacgcatgtgaaaatatgtcagcaccaaacaattccagcaatatgttggtcaacttttcaagcactgtgccatgttttatgcccggagaatatacgagtcttttgcttggtcttgatcaagaagcctcaactgcacgaaaactacattttgatgaaccagcaaatgatacaacatttgaggaatagagaagttttgttattggcacaaaatatagcacgagtctctgttactgttattgttgaccatatataaatcagttgagaatattctagttactgttattgttcgccatatataaatcagaaaattgagatctcctttattaccggtcgatcacagatcaacaggcttcgagtatgctccagatacaaccatttttggacttgcctttttctgatttcttccaacgttttactaatgtcaaaaggaataagagcagaagagtgatccctaaacgaagccgtcaacgaccaacacacatgtccgtcaagagccaacgttacagctagcggagccgctcacacatcacagagccgaacacgtgaaaacagagccgaaaagccagcagccaagcggtggtgtccttcgttgggtccatcacccagtttctgaggggctgcagcgtttggagtttgcagcccggatgcacagcatttttttccttcctggccgccagcttctcacgcacgcagcctgctcgtcttccacctccggccatcttcctccctctaccgagcttccctccccacagcagcagaccaccggcgctccctgttcttctccccccgtgtgcgtgcccccttcatccaggcagcagacggcgcacgcacaccatggagccgaacccgagctctccatctctaatccagcgctcaaggctccgctccctctctcctccaagcgtctggcgccttccctgctcctccatggagccactcctcaccgggatcttgctcgcctgcgtgctcagttccaggcgcgggcacccctttcccccatggccgagctcaacctgccaggacaagccgcgagctcctctgctcctactcgtccatggcgctctggaacttctcgtccagagtcttgcccctctcctacctcaagcagcaggctgggcgtccccatgactgcgccctttccctgctcttgccgtggtcaacgtcccctgctcctccatggcggcgggttggcgcaggcactttctgcccatggcgttcggcacccacccgacaaggacaacgccctccctcctctccattttccattttctttctcggatccaatgacggttggtgtccaacacccctgacccccatcctgcagcgcccagccatggaggcggcaaatctcagctccatggctgtttccctaagtgcagcaggtgcccagatctttcccaggccgcctccctctgctccctgcgctgcatgctctgctcgggctgcagatccctggccaagcgccctgcttcgtccagcgcccgaccttctctgctgtggtcgagctcagcttcactagctcacgaccactgtccctgtgccgctggacgccgttcctctctgctctggccttgccatccgcgccccagcgcctggactgcgctcgccgagctcctccaccggttcgtgcccccgcacttgcagcagcggccgtggatctcctctgcgttgcgcccccggcgtgctcgaagaaacgacgcagcaagtagcagcagcgacgcccttcgctgcgtcgcgctcgccaggacgggcctcacgccatcgatctgcgcggcgcctgcgcgtcgtcgtcgaaacccgcggtgagctcccgtgttccttgattttataaaataaatgaacaaataaattgtgtaatgattgtgtatgtcatttaatcgcagcccttgtcgacgtcacgccttgcgcatcgctcgtcggcaaagagcccaaactaatggcatgcatgcgcgacacgagttggccaggttgttcgccttgaatgattcgtgatttgttttatttacgtattcggtcgatgatgtgcctgcatgtttatatgtgtgtgaaaatatatttgtatgaatggacgtgtgtagagaaggaaatgaagtggaaaagaactcgggaatttttattttgataggaagatgtgcgatgtgttgtttgatgcgaaaactaagttacaaaatgcggattatgttttgggaaatgcatcgatatgtgttcatgtgaaaagtataattgttttatgcaatgtgatgggattcgtgattatatcgggagtatatttattaatgtgacgagtagtttagaaaatgctagtttgcgtggaggacgaattattaagacatgagtgtcggagttcatatattagtggttacgctacgatgatcgaagtgtctcgagtgcacgccaccatatggttgtatgcgagacgaggttatacgcatgatgagtttagtaaaaatccatcggtgtcactggtgtttagttgaggtttatttgcgcgtggaaagtgataatgtgtttaatacttaggacccttagtcgatgtaggtagaaattgttttggcttatatagagaggtggtgacatgccaaagtagtcatcgctttctctatatttataagtcgagtcatgacgatgcgtattatgcgttcgttaaattaggcttcgcatatagtgtatgattgtgctcacgatttcgagcggacactccaagtaagtcaattaggtttgtgatacaagtgtgtaatggagattagttgtttttaggataattattgaaatactcggttcgtagaataaacatgtatgt

SEQ ID NO: 208 - DNA, 3149 bp, Zea mays
atataaattttcttctattaactaattttccattaatagaggtcgtaactctgcaaaatagtttatcttgaaaaatatgcatattgaaattcaaatacttctaaagttacctcattctttaaaacactgaactttaatcagcatgcgaccatctaatttgtgggtcccatactcaagttattgattgtgttgaattttagttgatggtggagtgtgtgaaacatgttggatcattttgtaaatcgaccccataatttagggctttgaaaagcttcaaagttttcgcatggttcatgccacaatcttttcttgaaaacatgcaaaaaatcacgacgctttactcacaaatcagtgtattgcgaaaacattcataacaaaccatgttgggtccttttgtaaaaacaacagttctaaacattacatcatttagggctttgaaccgcttcaaacttacattaatgtccataaccatgaaacatttaaaagttttccacatatcttatgagataacatgcccaaacaagtgatgtttacattttggcaataagcaaattgtaatgtaattttccttggttaaattgttttgtgaaaaatatcatgaatcacataattgttttttgagtggcctcaaaacatgcattgttgtccataaccaagaatcatttaaaatagcactacatatagtttaagatagcatgcctaaactattattgtttgtagtctagcataaaattggaatgagaatttttgtatatttaattcttttgttataaatatcattgatataactgtaatagaataatatcaaagaatcttaaaacatggatggaaataaaagcataattgcataaatatagctctcaactccggaaaattaccgatctaaaaaatatacatgttgcactttaaacatttctaaagttacctcattcttcatatctacaaaatatagtggcagcattcgaacatacaatatcatgggccccaaactcaagctataggttgtcttgcacttaggttgatgatgaagcatgtgaaacaacatgttgcatagctcacgcctatagtaaattgatgatctgaaaaaatctacatgttattcttcaagcgctcttagagtcacctcatcctttatatgaccaaatctactgctagaatgcgacaatctagggtcgcatactcatgttatggttgtcttgaacatgggttaacgatggtgcatgcgaaacaacacgttgggccatctataaaaactgtctgtgtaaacaatacaacatttagggcttcaaaatgcttcgaagttgacgcacatcagaaatcgatatatcatgtagcaaacttgtgcgaatataatagccattagtcccatactcatgttttgatctaaacaatacaacatttagggcttcaaaatgcatcgaagttgacacacatcagaaattgatatatcatgcagcaaacttgtacgaatataatacccattagtcccatactcatgttttgatcagccttaaacttgggttgatgtgttcacaactgaggaacattgcaaatagcactatatatgtttttaaggtaacatgcctaaacaagtatgtcttacatgatgacatttagaaaagattaatgaaagtggaaatataaattttctttcattaactatttttccattaatagaggctgtaactctgcaaaatattttatcttgaaaaatctgcatattgcaattcaaatacttttaaagttacctaattctttaaaacactgaactttaatctttatggaaccctctaattatgtgggtcctatactcaagttattgagtgtgttgaattttagttattggtggagcgtgtcaaacaacatgttggatcattcagtaaatctaccaaataatttagggcttcgaaaagcttcaaagttttcgcatggttcatgccacaatcttttggaaaaaaacatgcacgaaatcatgacactttactcccaaatcagtgtattgcgaaaacattaatgacaaatcttgttgggtcatttttgtaaaaactatcgttctaaacattacgtcatttagggctatgaaccgcttcaaacttacattaatgttcataaccatgaaacatttgatatctttccacatatcttatgagataacatgtctaaacaagtgatgtttgcagtttagcaatgagcaaattgtaatgtaattttccttggttaaattgttttgtgataaatatcatgagtcccatacttgttttttgagtggcctcaaaacatgcatttttgttcataaccaagaattttttaaaataacactacatatggtttaaaatagtgtgcctaaactaatattgtttatagtctggcatagagcaaattgtaattaaaattggaatgaatttttttctatatttaattcttttgttataaatatcattgatataattgtaatagaataataacaaagtatcttaaatcatagaacgaaataaaagcagaactgcataaatattgctctcaactctggaaaattaccgatctaaaaaatatacatgttgcactttaaacatttctaaagttacctcatttttcatatgtacaaactctagtgccagcattagaatatccaatatcatgtgcccgaaactcatgctataggttgtcttgcacttggggtgatgatgaagcatgtgaaacaaaatgttggatagctcacgtctatagtaaagtgatgatctgaaaaaaatctacatgttatgcttcaagcgcttctagagtcacctcatccttcatttggccaaatctattgatagcatgctgcaatctagggtcgcatactcatgttatggttgtcttgaatattggttaatgatggtgcatgcgaaacaagaagttgggtccatccataaaactgtctgtctaaacaatacaacatttagggtttcaaaatgcatcgaagttgacgcacataaaaaatcgatatatcatacaataaacttatatgaaattaatacccattagtcacatactcatgttttgattggccttaaacttgggttgatgtgttcacaattgaggaacgttgcaaatagcacaatatgtgttttaaggtaacatgcctaaataagtttgtcttatagtatgac

SEQ ID NO: 209 - DNA, 3140 bp, Zea mays
gagagtacctcctgtcgccgcacaagcttggcatctaccgctgaagtttcatttaaggacgtccacatctcccgtgaatatggtatggttggcacctagacggtgatgtagcgtggtccttagtccacgccggcacggggtacctacgctgctacgcactgctgctgctccctttcctcctccgtctaggctggcactagcaatcggactgcaagcagccgtgggagttggagacctgtcgactatgccacttcagttgcttcatcaatgatcctgaccaagctcggtgaggttgacttgattataccccaaccttatcgtttcacattgacgattatgtgcatttgagacgtggatgcatagagaaagaattgactccggcggcttagtcctctgcagtaaaacgacaattctatataatagatcgcgacgcaaaccgttaaggataggatatccacgtatgctctatttctaccggccatcagattttggatccacggtgagataagagcgcggcctcttgagtgttgcctttcgtgttctctaccggacaccagaatcttccaaggtaaaatcaatatgtgtccagcgtccagatttcgtcacgtcgcttttatttacagcgaaggcacgaagccgacgcttaacttccgctcccttccttactcgccctcggcatgcaggcgacggcggcgacgcctacgctcgacggcgccaacggctttccctcacacctcttgcacaggcgcaggcgcgtagtaggtttctgcatcatccatcatttctcgcgctcccttcctttctcccgctcggcacacatacaacggcaacgacgctcatgcttgacggcgccagcgactttcgctcccgtctctcgcataggcgcaggcccgtggtgcgtttctgcatctcacatctatatcttcctcaacgtcggcactcatcttccactccctcccttactcgcgctcgtcacacagatggcgacgctcaggctcgacggcactagcggcttctcctacggtcctacctctcacacgggtgcatgcacataccctctcacacagtcccgctctgcacagcgcctccgcatgtcacagccacactcaacggctccatcgctccagcgcagtgcccctccacacggccgggccaggcctgtagtcaaaccggacagacactcaccgcccccccgcccgctctcccttctcggccgaacgtcttggccaggacagatctacaggcaagctgtcctcggccgtacaaggaattacttttattactgtgcaccagtcaatttggattctttactggatgatgctccttcgaatttgtttactcctttggaaacggctcattgtccccctcccctttcaattttggtgtgattttcacctactatatgaaagagtcaaacgacgtgcagatatgaaccaatttgacagttcagtgttgtcgttggtggatttcgattttgtttctgactcctagaatccgcgttggtttagctgagttatcgtccttgcctttcgccaatgcattcattttgccttctgcagtttattgccacaataaatgtgaataatttgattcctacaattgatgtctggcagcaattcatttggacaacctacaacttctattcagaacagatagtatggttttgcagtaaacaaatgattacctattcctttccatactcaccaaaatacatgtctctcctagacctatgaccataaatctcatgttcattcggcaaattaaagtatacgatgtgagctggttgggtggtgcaaacaaagactagaaatcgttagttaaactgatcactgctactctactatacatggagtcctaaataagtttcgctactctgcagtatataggaggagcgagttactattgctattactcgccccatagcagttaaaatgaccagtagctcctattgatcactggaactttgctatacaaggatcccaaaatacatgtctctcctagacctatagaccataaatctcatgtttattctgccaattaaggtgtgtttactctgccaattgaagtataggatgtttgttccatgttcctcgatacaacgcacacctttatatttttcatatttgtgtttcgtgttttactccatcacccatgtttcattgaaataactagctctgcatacctttttactacatataaagttgatcacttcttttgtcggaggtcaccattgctgctacaataggtatgaccaccatatttcctccataatcaccatacttttccctctatgtacatgtagatacacacttcgagtaagtgttcaagtacacatgaccgacgatatgctgctatccataaataaacatatgaacatacatcctatgcaggaccttgcgcttagttcacgtagttcacgaagtccctgtaaacttcattttagcacatagctcttttgtgacaactaagctccatttataaaataaaatccaatatgatttggattctacatttgtacattccaacttttcagctacaaaaatattcatgttgttacctcactcagttcaacaaacgacctgatagtgtatttccccaatctttcttccttctattactttgctttgtattgttttagttgcatcacttcactcctcaaacagcattccctcatcgatgttattagaatttgttattgcatcagtgccatattttatcagatgccagctagggaaagtgatatatactgactaaaatgagatgattgtcaatttagatccataacctcaatttccgtgcttgatatagaagattactagactcctctatcaaggtcctctcagtagcaaaaatagtgggccaaatcacaggccacgtcatctaattgttcaacctgcatgacaatattttctttttgcataagtaagtacttacatgtcaatatattattttcttgcataataaataagtacaacacattaatttagaatgttatattcaccataaccactgaatttattcaaaaagtcttgctaatttctagacgcaaacctgcttccacgtatattaatatatctatgaattgcttatataaatttataatatcactttctttactgtttatatacgctaaattaact

SEQ ID NO: 210 - DNA, 3136 bp, Zea mays
gcaaattgtaatgtaattttccttggttaaattgttttgtgataaatatcatgagtcacataattgttttttgagtggcctcaaaacatgcattgttgtccataaccaagaatcatttaaaatagcactacatatggtttaagataccatgcctaaactattgttgtttatagtctagcatagaggaaattgtaattaaaaatcaaatgaatttttttctatatttaattctttcgttataaatatcattgatataactgtaatagaataataacaaagaattttaaaacatggatcaaaataaaagcaaaaatgcaatctcaactccagaaattaccgatctaaaaaatatacatgttgcactttaaacatttctaaagttacctcattcttcatatctacaaactatagtggcatcattcgaacatccaatatcttgggccccaaactcatgctataggttgtcttgcacttaggttgatgatgaagcatgtgaaacaacatgttgcatagctcacccctatagtaaattgatgatatgaaaaaaatctacatgttgtgcttcaagcgcttttagattcacctcatcctttatatgaccaaatctactgctagcatgcgacaatctagggtcgcatactcatgttatggttgtcttgaacatgggtaatgatggtgaatgcgaaacaacacgttaggtccatctataaaaactgtctgtctaaacaatacaatatttagggcttcaaaatgcttcgaagttgacgcacatcagaaatcgatatatcatgtagcaaacttgtgctaatataatacccattagtccattactcatgttttgatctgccttaaacttgggttgatgtgttcacaactgaggaacattgcaaatagcattatatattttttaaggtaacatgcctaaacaagtatgtcttacaggacgacatttagaaaagagtaatgaaagtggaaatataaattttctttcattaactatttttccattaatagaggttgtaactctacaaaatagtttatcttgaaaaatctgcatattgcaattcaaatacttttaattctttaaaacactgaactttaatcggtatgcgacccgctaattatgtgggtcttatactcaagttattgattgtgttgaattttagttgttggtggagcgtgtcaaacaacatgttggatcattctgtaaatctaccaaataatttagggcttcgaaaagcttcaaagtttttgcatggttcatgccacaatcttttcgtaaaaacatgcacgaaatcgtgacactttactcccaaatcagtgtattgcgaaaacattgatgacaaatcttgttgggtcatttttgtaaaaactaccgttctaaacattacgtcatttagggctttgaaccgcttcaaacttacattaatgttcataaccatgaaacatttgatatctttccacatatcttatgagataacatgcctaaacaagtgatgtttgcagtttggcaatgagcaaattgtaatgtaattttccttggttaaattgttttgtgataaatatcatgagtcccatacttgttttttgagtggcctcaaaacatgcatttttgttcataaccaagaattatttaaaataacactacatatggtttaaaatagcatgcctaaactaatattgtatatagttcggcatagagcaaattttaattaaaattggaatgaattttttctatatttaattcttttgttataaatatcattgatataattgtaatagaataataacaaagtatcttaaaacatagatcgaaataaaagcagaattgcataaacacgactctcaactccggaaaattaccgatctaaaaaatatacatgttgcactttaaacatttctaaagttacctcatttttcatatctacaaactctagtgccagcattcgaatatccaatatcatgtgccccaaactcatgctataggctgtcttgcacttggggtgatgatgaagcatgtgaaacaaaatgttggatagctcacgtctatagtaaagtgatgatctgaaaaaatctacatgttatgcttcaagcgcttctagagtcacctcatccttcatatgaccaaatctagtgcaagcatgctgcaatctagggtcgcatactcatgttatggttttcttgaatataggttaatgatggtgcatgcgaaataataagttgggtccatccgtaaaactgtctgtctaaacaatacaacatttaggttttcaaaatgcatcaaagttgacgcacataaaaaatcgatatatcatacaataaacttatatgaaattaatacccagtagtcccatactcatgttttgattggccttaaacttgggttgatgtgttcacaacgaaggaacgttgcaaatagcacaatatgtgttttaacgtaacatgcctaaataagtttgtcttatagtacgacatttataaaagagtaatgaaagtggaaatataaattttcttccattaatagaggtcgtaactctacaaaatagattatcttgtaaaatctgcatattgcaattcaaatacttttaaagttacctcattcttgaaaacgctgaactttaatcggcatgcgaccatctaattatgtgggtcccatactcaatttaatgattgtgttgaattttagttgatgcagcgtgtgaaacaacatattggatcattctataaatctaccacataatttagagcttcgaaaagcttcagagttttcgtatggttcatgccccttgtactcacaaatcattgtattgcaaaaactttgatgacaaaccttgttgggtcctttttgtaaaaactaccgttctaaacattacatcatttagggctttgaaccgattcaaacttacattaatgtcagtaaccatgtaacatttgaaaaattttcacgtatcttatgatataacatgccaaaacaagtgatatttacactttggcaatgagaaacttgtaatgtaattttccttggttaaattgttttgtgataaatagcatgagtcccatacttgttttttgagtggcctcaaaacatgcattgttatccataaccaggaatcatttaaaatagcactacatatag

SEQ ID NO: 211 - DNA, 3133 bp, Zea mays
aattcataaaacatattcacgttcttgcttctatagcacaaatgtttgcatctagatctttcactctttttgttgtagtttacatatgtttcatcaggttttgtttctgtttgccaaatgccggcgagatgtgatccatcgtttcagttttataagcacgaatttgtacttcttgcatggcagactagacattaattagtcttctctagtgtaccctatagtaataatgagcgtataacattagctataaatagcgttagagtacttccggtagtactattccggtcaccattggcactactccagacctaagtagagttaggatctaccttgacagcatcatatttgtcatgttaagctctacatgtctcaacacttctcatgcccaaactgatgaaaaggtacagtgcaaaaggagccaacagcacattattggtggtgattaaaggtgtcagcagaaagccagcagcacattggtggtgtagagcagcagaagtatagtagaatgagttcaccctttccattgtatttatacacctcgagaaggtgctcaaagacagacagacagacccttgactggaggagtgatacattcattttgctgaagaaatgtggttatggcgcctgaccttatgtcgtcagtgccagggccctacactagtacactcctactgcaattttaatttcacccataaatttatattttccccatacatatctcaataccaaacatgaataatctgggatagagatgtatggagaaaaacaaacttatattctataatgaaaaacaaacttatacctttagtactttaaaacaccaatttcctgtgtggtacgttttctcttaacgagctattacactacagataggttctaaaatgagaagtgtgattttcaacgtatttgtccatgaatttcgaaagttacattattccatccactcttttcgtgtgcagcataacgacattgtgctacaatgtttacgacctgctaaataacaataatagcataaatagttgattatgttagtcgtccagctaatcaagtcggtgaccccgccgctacaaactgcatgcagaagcagcgatacttcacgatgcttcctaatctaagttgataatggatacaaaacatgtggtttagacaaatattgcacaaaggagtggcctctgctagtgctagcagtgctattggggttttattgtgaggcaccgatgccttttttttgtgagaatggtacaaaccagagtattgactacattgatgttgtcgacctacctgtcatttagtaatcctagtcgacagaactaccagtgccaaaagaaaatgaatggcaacactcaacatcctcttattgtagctttttaatcacttggtgctgatgtaaggtaagagtttaggacaaattttttgacttttgaaccctatgtagaataatcaacggtcaatcatgaatctgtgagattaaaaaaaaatacacatatataatacaagcactagtacactgtacactatagctatatgcatctaacgaacatgcacctagtgtgtcgcgctagcagtttgcgacgatttgtttcctctaagacaccgatagactcattgatttgtttattagatttccaacaagctgcacaccaagagtaaggaatcagcacaccaagagtttatccgacccaaaactttacaataaccagaataagcattgattcatgcatttcatcaaacacttggtggacgatgtgctacaactttcctttccaatcaaaccctaggatctttctctccaccataattgcacacatatacacataacatcacataagcattgataggatcttttttttttttttgagacacttgaatggtacaaaccagataatagactacattaatgttgtcgacctacctatttgttacttatcctagtcgacacaatgaccactgacaaaataaaataaatgacgacatcctcaagtacatgagtaaaatgagcaacaatacaaacaaacacggtacaggagaaatcactaaacatgaaaacatactacataacaacagccgtccgattagtttctacggcccagattagatggacgtgggtcatgaatcgttacgcgggtgcagccattgttttggattaaaattccgatggccccgagacatccctgccccgatccaaccgaggccatcggattggcatccagcggtcacattttaatacgacgaaatgctacgcgccgcatgatctcagtcgttcatcacttttcctacggcgctggttccatcacctacctctcgtatcgaacacggaagcgcgagcagtccgcgtggcagagctcgccgatgagcgacgtgcatgacgccgatcaggccgaagccgaaccctatggatgactcgctctacgcgtcaaggactcacaagcgcgaaagagacgtgtcacacgtcggggtcggtccacgatgtggagcggaggtgcggcgggggcgagaggtgctcgggctgatccgcgagcttgatacttcacacacacgaaccacgcacgctgccgaacgcccaccacccaaccttggccaccaatgaacggtgtaggcaggcatggggcaccggcggtggacggcagacttctttctcggtcacaggaagggatggctggctcaacaggggcgaggatgcatgtgtcggtactttacttatgccccggccgtggctaggatctcggagcgcctccacgttcaacgacggtttcgcgttctgttgcgccggcgcgagaggatagggctgatgagctggccctacacgtcagcgtccgggatcaacacacgcgtgcgcgtgcgggctgaccagcggggaccaccacacatcgacccaggcgagagctcctcctgtgctctgacgcagctgaggctgaggagtgggcctaggtcgccggcgtcgaggcgcgcgtggatgtagtgcgccacgcgattcgggtggagtgggtcggccagtgggaaacgaccgatgcggcgttttaggttttgcttttccttttctgttttatttttaaatctcaaattttaattcaaaatttgttgtgaatttcacacttggatcaaatgctcaaatcaagataccagcatgaagaag

SEQ ID NO: 212 - DNA, 3131 bp, Zea mays
ttaaatccgggtgtgacagaaccgaaagtctagctgtctcgtccagtatcatgactcctattctgccatcctttatggactactagtccataatcctctatgggcattgtaacagagtgaggttggtgaatgacaaatgtttgccgtgtggagaaatcatacttaagaatttcgactctacgacatcacagatatagttaatgggtgggacatgttgagaggaaagaatttgatgtaatcaacattacgacatcacatatatagttaacgggcaagacatgtccttttgaggattttcagaggtttctttactagtggacgtactcaagctagaacattgctcctcggcaccactaacaatcttaatttcctctaagggtacttcttcaatattagggaactgggaataataagaatggagtatgtggtgaatttcctcccttcttcctagtcgttcatcttccatatccatgtcaactaaatcctgcaaaatcacaaggcaacaataaatgccataagagaagagagctactcactctcatgataaactctagccatcaattattattctatgctctagtaaacctagtcacatctccacatggtcgttttggaaaggaacatttcacattatattaaggaactaatattacctgtgttatggaatagtcttgaataacagaagactgtttttatagtaagaaatgaaagagtagagatgataagaggtatggtcaagcatacaaccacccgcgattatttaatgtcaaatacaccagcacagatgatctgggtgagcacgagagagaatatgattgtgttgtgtgaaattggccaatacaatcctcctgtgtcagaccttgttcgataaacattgagaaactgaaaaagaacacatggtacatctgcatgaatggacaaattttagggtaagtaagaaaataaaatatagtatctaggttctcacttgattgcggtatacaacacgaccaaggtaaaagtataccagcaggaaaggtaaaatcataggagccaccacagagcatgtgaagcccaatagtccaaacaatagaacttttggcacttcatgctgataggggaatgtgggaacaaattctgtatcttctctatattctccctttctcaaaatatatttccttataaagctcattatcagattatagaactgcaaaagttcggatgataaactagcccatcctgaggtcataacataggtgatgaagaaggtagcctgcaataaaaaataaaatcacataaaagaaacagaaatgttagatgaaaattaaatacacaaaatcaatatattatctttccataaagaaaagggaaggtgtgttaaacctgtctagttaaagctctagcaagcttgacaggaatgtcctttgggcttaataacaaattcaattgactcatgaatgtaccggatagtacattaacaaagaatatgttccaaactatgaagcacaacagtttaaagcaagcactcctcttccttgcactatgagatgtggcaccttccaatttagaaactttcatcatcaatgtcccaacaatatacagaataatttgttgaatcacactaggaaggtatcccgttactaggttagtcatgtagtttttcctgcaaataggccgagtaatatatattcaataggtgcaatatggagacaggtcaatggatagtatatatatttgtagcgacataagatcccacatctatcgagatagcccaactgaagtttcaatacttctccaacctttcttttaaggaagcaggaatcaactgttgcagctgctctgggttagatagtgattgtatacacaccatcggcatcaaaagtaagaatgcaaaaataatacagcctggaactagtgttgatttacgacgcttgttggattgccaaagattgaaccaatacacgtcttctggttctggagccagactagtaacccatttcagtgggttagatgtctgcaccatatttgaggcagtaactgcgtcatagcgagttttgaaaaatacaaaagcagttacgcattcctgctgcatataattccacatagaaattactatccatattataactgctaaattaagcaagtaacaaatgcatgcatgcaagaattttaacctcgtgatctaagttcatggtggattattcattgtcagggttccccttgttttgctcgccttcagagttgaacttggaagaatttggagagtgtggtcccgtgaaacaactgttggtggttgtcgtcctaaatccctgactgccgatttcagctatgaaatgtttgaacttcttatgtgtcgtcttagtgccagtctgtcagataaattaaagacaccaaaaccaagaggttaaatacaaacacacataaggaaagaaaaaaaaatcaacactgaaggaactggacatttgttcacttattcatgtcaaaaagacaaaaaaaattatgagaaaacctagctaatcatgagatgaagaagtcttaatattatacttcccttagaatatataatagtaaatgttcttcattagtaaaagagaaatgcatgcattgagtacaagctagataccattatcttatggacatgcccaactttgtagacaatttgatggaagagataactagacgagtgatactttgtgaagaaatttccaacatcatctctgaatgattctttagctgtctatggtatttcacgaacaaggagtgcaaattggcttggatttagcgttgaccttttgagataaagggacctcaacgtggcaatgtgcttcccctcctgcattgaagggaaaaacatatcagtagaaaacgttccaactacaaggagatggagtctttcaacaattcaaatgtgaaacaaacttacaatgtacagaagtaagcatgttactccagaaattatgtatagcaccgcacaatggatcaagaggctgcatgcaaggaatcaacaaaacatgcactttgttatattctacactgctcattcttcctcaagttctaaagaagtgaatgaagaagaatggtggataaattaatcaaggtagaaaacacttgtaagatgtcggtaactatcacaacatatatatatatatata

SEQ ID NO: 213 - DNA, 3131 bp, Zea mays
taagaatcggaggaggtgtgtgtatttactgggtgctaattgctataaaaaaagtttaaaggccctgtcatcttacttgtcgaaaggcctttaaaattatagagacggtcctataggcgttaatcctaattttgctaatacgtcggaaagttactccacgacgaggttagcgatgggctaaagaatgcatgcagaagctgggcttgatgtaaaagactagtatatggtcgtttcctttcaatttcaacttccaagcgagcgccatccggacggatgtgagctggcctacctaccctaccgagaagccgacacttccctattcccaaaaaacgctgctttcggccactagaaaggttgcaaaatgggcgcaggcagaggtcgtcttggaagtgatgtactcttaacttttaccttgcaccgagcgatagttgtctttctaatcaatacgatcgccaactcgctattaaaacgctgctcttagagcaaacataataagggggttataagctaactaaatgctcaagtggaggagaaaaaataggagagagatatataagagaagcagactataaacttatggcttcgacataataacaaagacgttttgtatgagagacaagtgacgttctgtattaatattgaagagctaactactaaactaaataacaggctacaaagatccttttacggccaacaattaactctattattaaatttgctcttaaatgaagtctatattgcaaattactactcgggttaggtactagagagtggcatgcatgcatccgattgatgggtgacgataggcacgtaagtatttctcgtacgtacgccgctgcgtcagtacgtgtgtagaatgtagataggtatatagtagtgcgtgtatttctcctgcggagtgtgcatgaatatctggtttgcctacagtacagcaaatacagtcagaaagctctaccaagctggctagcaatgcaagatccatcggctgaacctgaccggcagccggctactttcaaatgggagcgcgtctgccgccgggcctccatgccggtcaccaagagtgaacagacaacgagcatgacatggttggagagccacgaacaacgcgcaagtacagatgttcaccctacccatatgcacccatcatatccatgcatgcatgcacggttctcaatcacaggagtcagtcagtacgtcaggagatcctcaaaacataatcaaatgcacaacatcgtctattatatatattggtcatggacttaacaacactgtaagcacgcatgccatcgagcaaccttgacggccccctagttgcatcaagtacaaaattggtagccaccggctaatataccctctcgggggtacccacgatcgaggagagcctgtgtctacctggtcttgcaacaggggctggttgctaccggcagcagctagctttgcgttcctttgcttcccccagccagcttcctccctctcaagtctcgtcaaaacactgcaggggagatgcatggccctagctggaaaaaggccatccatccctctcagggcaaccaaccaaccaaccactaaccagcaccgccaacctctctgtctctctctcactctcactctctacataggattacacttaagcaatgttgctaacaacactgctaactaagggtggtagtaataaacgacataattaacaggcaggacacacacacatatatatatatatagcggcaaggcgacgtgacggcggtggagtccgtccgacatctgtgcatgcaggtccgttacgcgagcggcgccctatggggcgcgcccttccgcctgttgccgagcgagaggacgatctgagggaagaaccctcctccgcccccgccgctcttcttcttcctcgtcgggacgtcgacgtcgcgccgcgcgtggttcctggccgagccgccgttgctggatcctccgctggcgctggcgctgcccccgtgctcgacggggtcttcgaggatggagctgggcgtggcctgcccgtactgcccggggtcgtcgtcgaagcggaggttctcgaagcgcgggaagccgcagcccaggtccggcggcccgcccggcacgtacaggaggatgttggacaggtccccgccctgcatcatcacatggtccacctgcatgcgtgcgtgcgtgcagcccacagctgggtttagcgtacagtaaccacggaaacggggccgtatctaatctaagcgtgcatgggcgtgcgtgtgcatgcaaacgtactactgcgagtgaagcgacgtacggctgattaataacttactaacgtacgtgccaggcgactgattatggcacgcacgcacgcacgcttgaataatccgtcaaccgatcacgctgctagcttagcagctgtcgcgtgcatgtgcatatgtagaagatttttggtggcacgcgtgtagtcttgtatgggtggtggtggtggtatacagtagtagtagcagcagcagaatagcactgtgtaccttgcaggagaggcagcagaagtggaagggctcctggaggatcctgtcacaggccaagcagacgttgccagagcccttgaagggcctggactgcggccgcggcttgaggaagatcaccttggcactgttgatcgtgtagggctgcatgcgtgcatgagaacgacgatgggtcaggatttttaataattcaaaacgattcggagcacgccgcggcgccgtccgtccgtccggtcaccaccgctgcatgctactatccccctttagctagccgccgccggcagcagaaacagtagctggtacgtgacggtccgcgcatcacctggacgaaggagcagtcgatgagcctctcgaggtcgtcaaggcgcaccacgtcattgtacacgtacctccgcacctggcccaacaagtcgagcacacagtcacacacagacaacactacgatcattagtaacatcgttatacaataaatactacggtacagcccgtcacagtacatatacgctgcgtaaaatgatgggtaaatcgaatttacccgttcttcctgcgtgcatgtgaacgtgctgtgctgtgcgctgcgcaacttataacgtgagcaacgcggtgcgtgcgcggtaataattccagcgggaagggata

SEQ ID NO: 214 - DNA, 3126 bp, Zea mays
gttaggtgcagtttagtttaactgatccaaatgaggcccaactatatgaactttgtgacatatggttagcaggttattggggtcttattgggtgagaaacatcttaggctggtaaattttttacgtgtgtaaaacctcaatcatgtcacatccactcgtaagaagactcggttgtattcctgttaacagaaatggttgtttcctctctaaaaatatgttgactaacttggtctctatagacaagtttagtgacctcgtgggcaatttactctagcaggccccaaaagtcaaacaacaagttacctacttctccataagaatgtagcaatcaataacatgcatgtttgtcaaactgacaactaagacccaattgcagcaagagcgtgtgacagttcctaacccacaagacccaatttgcagtagaaaagcatgcataagattttgttgacacctagaggagacggttcctacattgttcgactccagtgcacctaattgggcctataaataaaccaacaatacaccttaagggagaaaattaagttgggtatatgatcgcatgtaaatgcgacattaattttcaggcctgctctgatggtgtaaacaagcgaaactatatttttcagacctgctaaccacctgacacaaagttgatatagttaggcctcatttggatcagctaaactcgactacagctaactcttgcgttttagtcttttgttgatcttcatttttattagtttcaagatcttcatgcttaacaaaagagaacaaatttcccagcacatcctctagaaatagcatattatctttggcatttgtcgccactacatgtcatctaacaatttcaacacctttatttgtgctcccacttgcagctcctcaacattatgcaaaagcttttgagctgcttcagtagcccgctttacctgtaagttcttcctcttaatggtcccaccgtaacattcttccattgtcttaagttgtttccacacataattctttttcgtttgttatgctgaaatttcattgtgcttctctcatcttaggatctagtaagctttctttagtttttaatctcttccctaatctcttctccaattttttgggatccgaattgtcaatactaatatatgaagtaaagtttagtcccaacaattcggatcaccaaaaaagtgaggaagatattaggtatgagataagaaaactaaagtaagcttccaagatcatgagattagaagacagtgaaaattcagcacaataggcaaaaaagaattttgtgtggaaccagcttaagacaattgaagaagattacacttggaccattaagaggaagaaaatagaggtaaagtaggctactgaagccgctaaaaagtttttgcataatgttgatgagttgcaattgggtgcccaaaagaaggatgatgaaattgttagactacaaatagtggcgacaaatgccaaaaagaggatgttgtttcttgaggatgagctgcaaaaattgttgtctttggtcaaggataaagatcttgaaactttataaaaataaaatcaaccagagactaaaatgcaagatttagttgctgtccagattaactaatccaaacgaggcctaactatatgaataggtggttagcaggttactaggttcttattgggtgagaaacttttgatgctggtggattttgctatgtgggtaaaccctgaatcatgtcacatccactcttctcaagactaaacacaagagttaggtgcaaattagtttaactatggcctatataaaataatgtggactaacttgttctctatagacaattttttagtgatctcgtgggccaaaagttagacgaaaagttacctacttatccacgagaaagttgcaattaataacatgcatgttggtcaaactgaccactcagacccaattgcagcaagatttggcagacggacgaactgcaaacataaatgaatagtcaggactcacaaaatcaataggcttgtgctattgctctctctctcactcaccgagaagacatgtacacaactctctatcttgtgagtatcaggagcatcgtcttgctagctttctcctaccagagcaccacactttctcatagcactagatggcacatcatcgacatgcctagaaactacacctctcgtctcgtctgggccacatgatggacgcgtcttaccatgagaagcggtcactactgcaggccaaccgtacgtgtctctccaaacataggccgcactagagtgcgttcttcaactagtggacgcaagactcacactaaatgcaggcatggtctgcatgcacaaggcgccagcccgcacgcctcctccgttgctccatgcatatggggtgcgtcctttgtctctgcgatccacctgaaccgctccactttttcatgtactaatcgttaaactccagcaggtttcatataaactcatgcatagtactagtatatggcatggcactccggtcgaaatccaggactgatggtctgatgtgctgcacgcatgttaggtaggcttcacacatcagtcgtgcttgcttgttcgtggagctagcttgctagcttttccctttctggtgttcttgcacctagctacagaagatcacgagagcattcaagcccgttgtacgtgctagaggccagaggctctccctagctccatctaaaaaaggctgcagcaggaaatgactattgatcgagccgctactgctggtgcttcatctcttaggctctctattgatccatatccatgtttggtactagtacggcgcggtcgtcggcaccacacacaacactgttcggtcctagtgcaatgatggcaccttgatcatctttctatgtctccatcaaaaatgaactaataataatattcaagaaaccaaactttatatacggtcggtcgtacttacttaaagctaatagttaatgtaataaataaagcaacaaattcaaaaaatggattacattatttgagtatttagttcgtgaatcagttggtccccatcaagtcggccttgatattgttatcaatgacgactgtctaaacgataatggactccaacgtggtcgagtatgtcattttatttcacggaatttattaggggac

SEQ ID NO: 215 - DNA, 3126 bp, Zea mays
ctttgaagcttttcgaagccctaaattatttggtagatttactgaatgatccaacatgttgtttgacacgctccaccaataactaaaattcaacacactcaataacttgagtataggacccacataattagagggttccataaagattaaagttcagtgttttaaagaattaggtaactttaaaagtatttgaattgcaatatgcagatttttcaagataaaatattttgcagagttacagcctctattaatggaaaaatagttaatgaaagaaaatttatatttccactttcattaatcttttctaaatgtcatcctgtaagacatacttgtttaggcatgttaccttaaaaacatatatagtgctatttacaatgttcctcagttgtgaacacatcaacccaagtttaaggtcgatcaaaacatgagtatgggactaatgggtattatattcgtacaagtttactgcatgatatatcgatttcagatgagcgtcaacttcgacgcattttgaagcgctaaatgttgtattgtttacacatacatttttttacggatggacccaacgtgttgtttcacatgcaccatcattaacccatgttcaagacaaccatatcatgagtatgtgaccctagattgtcacatgctagcactagatttggtcatatgaaggatggtgactctaaaagcgcttgaagcacaacatgtagattttttcagatcatcaatttactatagtcgttagctatgcaacatgttgtttcacatgcttcatcatcaacccaaatgcaagacaacctatatcatgagtttggggcccaagacattggatgtttcaatgctggcactatagtttgtagatataaagaatgaggtaactttagaaatatttaaagtgcaacatgtatattttttagatcggtaattttccggagttgagagccatatttatgaaattctgcttttatttcgatccatgttttaagattcctttttattattctattacagttatatcaatgatatttataacaaaagaattaagtatagaaaaaaattcattccaattttaattacaattggctctatgctagactataaacaataataatttaggcatgctatcttaaaccatatgtagcgctatttttaatgattcttggttatgaacaacaatgcatattttgaggccactcataaaacaagtatgggactcatgatatttatcacaaaacaatttaaccaaggaaaattacattacaattttttcattgccaaaccataaacatcacttgtttgggcatgttatctcaaatgtttcatggttatggacataaatgtaagtttgaagcggttcaaagccctaaataatgtaatgtttagaacggtagtttttacaaaaatgactcaacaagttttgtcataaaagtttttgcaatactctgatttgtgagtaaagggtcattatttcgtgcatgttttctcgaaaagattgtggcatgaaccatgcgaaaactttgaagcttttcaaagccataaattatgtggtagatttacagaatgatccaacatgttgtttcacacgctccaccatgaactaaaattcaacacaatcaataacttgagtatgagacccacataattagatggtcgcatgccaattaaagttcagtgttttaaagaaagaggtaactttaaaagtatttgaattgcaatttgcagatttttcaagataaactattttgcagagttacgacctctattaatggaaaaatagttaatggaagaaaaattatatttccactttcattactcttttccaaatgtcgtactataagacatacttgtttaggcatgttaccttaaaacatatatagtgctatttgcaatgttccttagttgtgaacacatctatccaagtttagggcagatcaaaacatgagtatgggactaatgggtattaattttgtgcaggattcatgcatgatatatcgatttctgatgtgcgtcaacttcgatgcattttgatgccctaaatattgtattgtttagacagacagtttttacggatggacccaacttgttgtttcgcatgcaccataattaacccatgttcaagacaaccataacatgagtatgcgaccctagattgtcgcatgctagaactagatttggtcatatgaaggatgagatcactctagaagcacttgaagcataacatgtagattttttttcagatcatcaattcattatttgcgtgagctatccaacatgttgtttcacatgcttcatcatcgacccaattgaaagacaacctatagcatgagtttggggcccaagatattagatgttcgaatggtggaactagagtttgtagatatgaagaatgaggtaactttggaaatgtttaaagtgcaacatgtatattttttagatctgtaattttccggagttaagagctatatttatgcaatcaagcttttatttcagtccatgttttaagatactttgttattattctattacagttatatcaatgatatttataacaaaagaattaaatatagaaaaaaattcattccaattttaattacaattttctttatgccagactataaacaatactagcttaggcatgctatattaaaccatatgtagtgctattttaaataatttttggttatggacaacaatgcatgttttgagaccactcaaaaaacaagtacgggactcatgacatttatcacaaaacaatttaagcaaggaaaattacattacaatttgctcattgccaaactataaacatcacttgtttaggcaagttatctcataagatatgtggaaagatttcaaatattttatggctatggacattaatgtaagtttgaatacgttcaaagccctaaacgatgtaatgtttagaacggtagtttttacaaaaatgtcccaacaagatttgtcatcaaagtttccgcaatgcactaatttggtagtaaagggtcatgatttcgtgcatgttttctcgaaaagattgtggcatgaaccatgcgaaaactttgaagcttttcgaagcccaaaattatgtggtagatttatagtatgatccaacatgtttcatacactcct

SEQ ID NO: 216 - DNA, 3003 bp, Zea mays
tcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccagtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctaccagcacagacgtcggattcacctttatgttgataagaaataaaagaaaatgccaataggatatcggcattttcttttgcgtttttatttgttaactgttaattgtccttgttcaaggatgctgtctttgacaacagatgttttcttgcctttgatgttcagcaggaaacttggcgcaaacgttgattgtttgtctgcgtagaatcctctgtttgtcatatagcttgtaatcacgacattgtttcctttcgcttgaggtacagcgaagtgtgagtaagtaaaggttacatcgttaggatcaagatccatttttaacacaaggccagttttgttcagcggcttgtatgggccagttaaagaattagaaacataaccaagcatgtaaatatcgttagacgtaatgccgtcaatcgtcatttttgatccgcgggagtcagtgaacaggtaccatttgccgttcattttaaagacgttcgcgcgttcaatttcatctgttactgtgttagatgcaatcagcggtttcatcacttttttcagtgtgtaatcatcgtttagctcaatcataccgagagcgccgtttgctaactcagccgtgcgttttttatcgctttgcagaagtttttgactttcttgacggaagaatgatgtgcttttgccatagtatgctttgttaaataaagattcttcgccttggtagccatcttcagttccagtgtttgcttcaaatactaagtatttgtggcctttatcttctacgtagtgaggatctctcagcgtatggttgtcgcctgagctgtagttgccttcatcgatgaactgctgtacattttgatacgtttttccgtcaccgtcaaagattgatttataatcctctacaccgttgatgttcaaagagctgtctgatgctgatacgttaacttgtgcagttgtcagtgtttgtttgccgtaatgtttaccggagaaatcagtgtagaataaacggatttttccgtcagatgtaaatgtggctgaacctgaccattcttgtgtttggtcttttaggatagaatcatttgcatcgaatttgtcgctgtctttaaagacgcggccagcgtttttccagctgtcaatagaagtttcgccgactttttgatagaacatgtaaatcgatgtgtcatccgcatttttaggatctccggctaatgcaaagacgatgtggtagccgtgatagtttgcgacagtgccgtcagcgttttgtaatggccagctgtcccaaacgtccaggccttttgcagaagagatatttttaattgtggacgaatcgaactcaggaacttgatatttttcatttttttgctgttcagggatttgcagcatatcatggcgtgtaatatgggaaatgccgtatgtttccttatatggcttttggttcgtttctttcgcaaacgcttgagttgcgcctcctgccagcagtgcggtagtaaaggttaatactgttgcttgttttgcaaactttttgatgttcatcgttcatgtctccttttttatgtactgtgttagcggtctgcttcttccagccctcctgtttgaagatggcaagttagttacgcacaataaaaaaagacctaaaatatgtaaggggtgacgccaaagtatacactttgccctttacacattttaggtcttgcctgctttatcagtaacaaacccgcgcgatttacttttcgacctcattctattagactctcgtttggattgcaactggtctattttcctcttttgtttgatagaaaatcataaaaggatttgcagactacgggcctaaagaactaaaaaatctatctgtttcttttcattctctgtattttttatagtttctgttgcatgggcataaagttgcctttttaatcacaattcagaaaatatcataatatctcatttcactaaataatagtgaacggcaggtatatgtgatgggttaaaatgcatccaccacagtgggatccgaagcttggaattcacacatagcagcttcggtgtctttccacacgctgggacttagctttttcttggtcgtgcacgaacccacggcggtcatcggccacgctgcgccttggctgtttccgtccggaagaccggtgcccctcttccgtgggttcgaaacctagtcgctaggcggtgcgtagagtggggggagggacgaatccgtgcgacgcggggctggatctcag

SEQ ID NO: 217 - DNA, 3117 bp, Zea mays
caagaatcatttaaaataacactacatatggtttaatatagcatgcctaaactagtattgtttatagtctcgcataaagcaaattgtaattaaaattggaatgaatttttttctatatttaattcttttgttataaatatcattggaataactgtaatagaataataacaaagtatcttaaaacatggaccaaaataaaagcatgattgcataaatatagctctgaactccggaaaattaccgatccaaaaaaatatacatgttgcactttaaacatttccaaagttacctcattcttcatatctacaaactctagtgccagcattcgaacatctaatatcttgggccccaaactcatgctataggttgtcttgcaaatggattgatgatgaagcatgtgaaacaacatgttggatagctcacgcaaataataaattgatgatctgaaaataatctacatgttttgcttcaatcgcttctagagtgatctcatctttcatatgaccaaatctagtgctagcatgcgaaaatctatggtctcatactcatgttatggttgtctttagcatggattaattatggtgcatgcgaaacaacaagttgggtccatccgcaaaaactgtctttctaaacaatacaatatttagggcatcaaaatgcttcgaagttgacgcacatcagaaattgatatatcatgcattaaacttgcacaaaattaatacccattagtcccatactcatgttttgatgtgccctaaacttggattgatgtgccctatatatgttttaaggtaacatgcctaaacaagtatgtattacaatacgacatttagaaaagagtaatgaaagtggaaatatagtttttcttccattgactattttctattaatagaggtcgtaactctgcaaaatagtttatcttgaaaaatttgcatattgcaattcaaatacttttaaaattacatcattctttaagacactgaactttaatcgacatgcgaccatctaattatgtgggtcccatactcatcttttgattgtgttgaattttagttgctggtggagcatgtgaaacaacatgttggatcattctataaatctaccacataatttagggcttcgaaaagtttcaaagttttcgcatggttcatgacataatcttttcgagaaaacatgcacgaaatcatgacccttcactcccaaatcagtgtattgcgaaaactttgatgagaaaccttgttgggtcgttttgtaaaaactaccattctaaacattacatcatttagggctttgaaccgcttcaaacttacattaatgtccataaccatgaaacatttgaaatctttccacatatcttatgagataacatgcccaaacaagtgatgtttacagtttggcaaagagcaaattgtaatattattttccttggttaaattgttttgtaataaatatcatgagtcccatacttgttttttgagtggcctcaaaacatgcactgttgtccataaccaagaaatatataaaatagcactacatattaagatagcatgcctaaactagtattgtttatagtctcgcatagagcaaattgtaattaaaattggaatgaaattttttctatatttaattcttttattataaattgatataaatgtaatagaataataacaaagaatcttaaaacatggatcaaaataaaagcagaattgcataaatattgctctcaattccagaaaattacaaactctagtgccatcattcgaacatccaatatcttgggcaccaaactcatgcgataggttgtctatgttttaaggtaacatgcctaaacaagtatgtcttacagtacgacatttggaaaagactaatgaaagtggaaatataatttttcttccattaactatttttcctttaatagaggtcgtaactctgcaaaatcgtttatcttgaaaaaactgcatattacaattcaaatacttttaaagttacctcattcttcaaaacactaaactttaatcggcatgcgaccatctaattatgtgggtcccacactcaagttttgattgtgttgaattttagttgctggtggagcgtgtgaaacaacattttggatcattctataaatctaccacattatttagggcttcgaaaagcttcaaagttttcgcatggttcatgccacaatctgttcaagaaaacatgcatgaaatcatgaccatttactcccaaatcattgtattgcaaaaactttgatgacaaaccttgttgggtcgtttttgtaaaaactttcattctaaacattacattatttagggctttgaacgtcttcaaacttacattaatgtccataaccatgaaacatttgaaatctttccacatatcttatgacataacatgcccaaacaagtaatgtttacaatttggcaaagagcaaattgtaatgtaattttcattggttaaattgttttgtagtaaatatcatgagtcccatacttgttttttgagtggcctcaaaacatgcaccattgtccataaccaagatatatataaaatagcactacatatggtttaagatagcatgcctaaactagtattgtttatagtctcgcatagagcaaattgtaattaaaaatggaatgaaaatttttctatatttaattcttttgttataaatatcattgatataactataatagaataataacaaagtatcttaaaacatggatcaaaataaaagcagaattgcaaaaatatagctctcaactccggtaaattaccgatctaaaaaatatacataatgcactttaaacatttctaaagttaactcattctccacatctgtaaactctagtgctagcattcgaacatctaatatcttgggcccaaactcatgctataggttgtcttgcacttgggttgatgatgaagtatgtgaaataacatgttgggtagctcacgtctatagtaaagtgatgatctgaaaaaaatctacatgttatgctttaagcacttctagagtcacctcatccttcatatgaccaaatctagtgcaagcatgctgcaatctagggtcgcatactcatgttatggtctgtctcttatacacatctccgagcc

SEQ ID NO: 218 - DNA, 3114 bp, Zea mays
caaatccatggaattttctgaagcaactgcatctaaaattattataggctcatgaaaacggatggagtactatccttgccaacctaaaggacaattcttccatctccaatgtaacctagcataccaagaaatcccctttcctccccaattataagtaacctagagtagaagttaggggatctcaaataatgatctccaaacacatcaatgactgtcttaacgaaatcttctcggacttcccaaaacagtagattctccaatacgaacatctgtagcatgcccatgacttagcgtacggaataccgtggtgaccttttagaagcgacttcatccacctatatacacccaactagggataccacacacccaagccaattaatggagagatcggggaagatatcgagcagtgggatgttgcagctagcacccgatacaatgaagcagtagatgcccagccatgcggtaggtgcagatggaaatccaaaagcacaaaatgcatgcaacaacacaagatggtaaatgacaaacatgcttggtatatctgctgatggaaggatagaaacaaaaggaagatcaaggcccgacaatggatctcggatgatcgatcttcgaaatctttgacttgcttttattgcgagctgccccaatgtaagaccctgcaagtcgattagccagatcttgacattcctagtaagactttctagttagggcttggttttccggtagttaacatgggccatgtaccatgtacatctctactacttattaaggtgcgaaagtagtgtgccattccctgttccaccattctgtgttctatcattcccattccttcctttccattctggttccctccctcgtgctcgacggaaggggataagacctgattcttttcttctctgcctccccatctctttgatgctgctcttgtacccatcaccgagttgggccatgtgaaaccaggccagaaacaagcatgtgttacactaccgccccgaaaaacgttgcttgtctccaagcaacctcatatcatgtatatttgctcattatgaatttgctttgtcttatgaagatgtgcaagtagtcatgagaatcttctttgaatcgaaaatgctaaaaatctgggtcccaaggctttagagagaatggtgcctttttttaccgctccagctgctcaatacattctcctaaactgaaaccaacatgattccactgcgctctagaaacaagccaaatgcaaaccaccaggatcccaaggcttttgtagctgactcattggttcgacattttgagaagcaccagcaggttcacacatgtgtatttgcataactgttctgatagtagttttggtatcaaaagtagatatagcagcttgaaccatatctaatctgctagtgatttcattcacatctataagaggttgtttcagccatcggttaagcaatctctttcccatctcaatagtacacgttctgttcaccaagccaaacacataaaagtttttgtttacatcatctttttcttcatcaatggtcaatgctcgcaccgcagcagaatcaagtctcatctcatgtagcagtccaaattgtacttttcaatgtgtaattcccataattattatcatttgctagcaactcagcataagatagtaaagctccaagggcaccaagagagtagtcaaattgagatatcagatcacgaactagtttaacagaacctctgatttttccaagatcttgcacaagatcctttgatttgaagttagactttttctctcagtcaacaaaatactgcatttactaatggcatcttgaagaagagaatgtgaattgatggatttctcacaatctgctgggaggcataatgcaagaagtgcttgctgatccaacatttgtgaatcggctatcttcagggaattcagccaacccaagcttcatgttggtcatatccaaaaagctaagccctacatggagttcactttctcggacaacaggagacggagcaataatgacgggtgactcttgcatgtcattgtttataaacaaaatgtcttcaaatctaccaatatttctaggttttccagattttgttaacatccaatcagagccacttccctcatattgacatttgagattccacaagagttgctggctaaatgaagtaaagcagaaattgtgtgaaagtatgtccttgcaataaacgtggcattctcaccgtgagcagtatagtaatctctgccactttccttcttactgcctctactacaggctccttatcaaagataggcccctccttaaaagtagcaaacaccatgtcatcaacatagctcagacaatctgtcaaacacatgaagggcgcactagtgttaaagatgctgcaaccgatttcgatgagaggctcctgatcaaatacgagcttccacgtcaaagatagggtgcccgtcgaggacgccggtgtgtgcggtcgaggagccgtcatttccttggttgaatatggcgagctcggcgtcatggaccagctcggtgtcgaatagcggcaggtcgttgaggttgttcgagtcagtgtcgaagatggtgagctcagcatcatactccagcctgagacgacgacatggtcggggatcgactcagtgtcgaacaccggtcccttgtcaaactcggtgtcgaagaggggctcgttatcgtggtcatcgaagttgggcccaatgtcctcgaataccacgtcgtcaaagacaggttcgatgctaaggttgttagtgtcggcgtcgaatattagtgcatcatcaaggtcaacgtggaacaactcccagtcaaatatggttctcccgactcctcggatttgagcggaatcgagagaatcagagaaatagggtagtgtaggatggaaaaaattttcttcaaggattggaatggctctgaataccatctatgatgacccgtagcctcctgtgagccaccaccagcacgttagggccatcgtcgagcgttggcgaggtgaatcgcacgcctccggatggtacacgatgatggaagaggataagacacaattcttttcttctcttgtacccatctccgagttgagttgggccgtgggttggtgaaagggaaatagggtcaa

SEQ ID NO: 219 - DNA, 3112 bp, Zea mays
gtgcgcgctcgtacagtcgtactcgtacgtctcgcctgcggcctgcccccgaaccactcggccgctgaacccgccgccatggacacggtctgcgcgggggttttcactgttcaccttttcacctgccctcccatggccatggctatgattgcactgcgcgtcgggcccatcgattgacacacccaaaaccgccttcacttgccgggaccaatgaatgcacagcgttaactcgttctgcctttggtcccgcggcgaagataagtttggggcaaaaaaaaaaaaagatagagcagtaacctgtaacaaggactccagtacgtacggcttttagagttttcgttagtaccaatcaccatctgtttctcacttcgtctcggctggaacgcgacgagcagagagccgaaccgagcaagcagaagcagacggttgctcaggatctctgaaacgacaaagccaaccccgagtccctgacacgagaccatgacccctgaaacaccggcctcagaccatgtgccgcgtgccggacgagcatgggctccgttcgacctcgaccggcccatgcgcgtgcgggcatgtccccagggcaaccatgatgcgcgtccccgtctcaatccagcacgtgagcacgcgtgtcgtgtgattattttgacctgcctttctggcacgatcttggtttcattccaagcaatctgacaaaaagttcagtgattcgggcaaagtatctttgcatacgatcataggccactgccatgctgttgggagatacagtacgagcaatggagatgccctgttgatcttcctttagccctttttattttagacgaactcctctttaaccttttggggatgctgatattgggaaggacaggaagaagcattagcctattgtggtagtaggtacatgaaaatatagtgggggcaaagcggcatgaggagggaatcagatttgggtggcagtggaggaatattttttatcaaatacggatgtttcactttatagattgtcaccagagttgaaggataaagggtgacactgacatttttttcttaatctgtcctttggtaactttaagggtatatataacactagaatctgaacagcagacagtgggaagtgctacaaaacacatgcaggtcctgttcgaaatgcatgaattcagtaagaaactgaatgcacaaggcttcaacttgtatggaactacctcgttctatatttctactgaattttcggaaggcttcactgtgtttggccaaattcatgcacctcgcagtttagatttcgcaatgaatgtcaactggtaacagaagcttctgtccctagaggcctagacttcgccaactggaatgtactgatcattaagtgtcgagttgttttgccatagactagcgccaagacagtaactcttcagcgacaaatgatcaaatggtgcttcttgatttactctttatctcttcgtttcccgaactgcagctgaaagcctggggctgactcacctcagtgcgtacctgaactcgatcggaagcaacttcacacagggagccaactttgcaacagctggttcatcgatcagaagacagaatacatcgctgttcctctctggtttcagccccatttccttggacgtgcagttctgggagtttgaacaattcatcaacagaagccaactcgtctacaacaacaaaggtgacaacagaaaccccccaaaccatctccatcagtatttttatgttttatcccgtcaagattttattcagtaacacttactcttctacatgtaggcggtatctacagggagatcctaccaagggcggagtacttctcccaggcactttacaccttcgacatcggtcaaaacgacatcacctcaagctactttgttaacaataccaccgaagaagtcgaagccataatccctgatctgatggagaggctcacatctgtaatccaggtgctctttggcagagcaagcatcaagttgctgttgctctttggaagatgttaccacacacaacgttccatggatggtctgctcatttagctgaatacatgcaaatttgcagagcgtgtactcgcgtggaggaaggtacttctggatacacaacacagggccgctcggctgcctgccctacgcgctgctgcaccgccctgacctcgccatcccagcggacggcaccggctgctccgtcacctacaacaaggtcgcgcagctattcaacctcaggctcaaggagactgtggcgagcctccggaagacgcaccctgacgccgcgttcacctacgtcgacgtctacaccgccaagtacaagctcatcagccaggccaataagctcggtaaggcgttcatgttggtgttgtttctaaattctaatgctggctggctctgaacgtttcctcgcgcggaaggagctcatgtttgtattgtttgtggtgcaggcttcgacgaccctctgctgacatgctgcgggtacggcggcggccggtacaacttagacctgagcgtcggctgcggcgggaagaagcaggtgaacgggacgtcggtggtggtggggaagtcgtgcgaaaacccctccaagagggtgagctgggacggcgtgcacttcaccgaggctgccaacaagttcgtgttcgaccagatcgtcgccggcgcgctctcggacccgcccgtggcgctcaggcaggcgtgccatagcagagggcaatgaatcggccccgtgtcgctcgccgcgatggccacgctgcagctgcagctgcagctgtttctggctgtgtaactttgcaagtgtaaatcgaaggagcaagcatgctcgaggacgaggtgcacggcttcactttgtaataagggacatgcaaatcagagatccaagagcaatgatttccatcaatagaggatcgatgaccacgaaacaatagcttacgttgtgaaggattgaaatatcgatcatcacaggcgccaatttgtaccgatacagagaatgagcaaacgaaatattttagacaggcatcgccaagaatgggaggtgggtagaaagcttcttggtattcttaggacccgttcgcttgtatagaaataaatcgaaattcgtcacaggtcatcaaaatctatataaatta

SEQ ID NO: 220 - DNA, 3109 bp, Zea mays
tcaatcaaagttccgagaatcaaagttccaaagccaggcatgagctcatctctagagaacacacctgctgtgaattgccactcaggcctcatatccccaaccattacccctactcacacctattgtatctagataaagctgtacttgtttgactacgtcaggaattctgagttacactccgcaacatttatcatgatcagacttttttcatatttcctacttgagcttgttgccttttggaatgcttctgtatgttgatatgcgcccgagtttgagcatctgctggatgcggtcggcatgcatgctgttcgttttgttctgcgtattgctctttgttcaactcctatttcctacataactagcacactcctatttcctacatattttccccttatttatacatgttgcctccaggtatatgtttttcggttcctccagttatgtacatgttgcctcctctggtagatgtttcctcggagttccctacatgtttcctcaattcctcctgtataatgtttgccctttttttgtatatgttgcctcctggtgcatgtttcatccatgcttcctccgctttattcatgttgcctccattataatacctcagttattataatatgcccactccgttattctctgttcattactcagttattccgttccaataactcagttattctatgttcattactcagttattctggtgacggaacttagttattccggtctaatacctcagttattctaatgtgcacactcagttattctctactcattactcagttattccgttctaataactcagttattctaatggacgcactcagttattctggtctaataccttagttattcctgtggacgcactcagttattctctggtttcttcccttcgcgtcctctcccgccgccgccgccgttgaccagatgggtcgcgtcatacgcgcccagcgtaaggaagccggctccgttttcaagtctcaggaggactggtcgtctcagcgaacaggctgcctcagccgcagcaaagtccgacaaggccacttagacaacttttgcggttgtttcaattacattagttgatagtcttctttgtgataaaacagttaaagctaaatatcaaaatcatatcaaagaagctgtagatttctgaaattttgattaattttctttttagcaacatctgcaggcactctgtttccaaatatgccgagcatgacaaggagctgcaaacccggtgcagcccacaactgaaaatccaacaagttcttggcctgctctgagaaggttctcccaagtccatcttcaaaagcttcagcagatgaacaatatgtcaaaatgtacgaagtgctgaaaatagtatctgaaaagtttcctctgagacagaaaaataaaggtggtgctagtcaacagaccaatgaaggtggtgctggtcaacagaccaatgaagtacctgctggacaacagaccaatgaaggtggtgctggtcaacggaacgatgaagtacctgctagtgttaagagaacctatttcaccgtgactaacattgtaaagttggctcaacattcggataacgaggagatctccatgcacatggacacagatatgctcgtcagacattttttcagtgtggtcttaaataacctgctactgccacaaaagtctatttttatgtaacctcacctgaacttcaagctgtatatgacctagaaaagttgaaaaaggttgactggtcatatgtgatatttcattcattaaagaaagctcttgcactgactttaagaagaatccggggcatatgaatggatgtgtccttatgtttctagtaagtaccaggataatgcagagcatatccataattccttaaagtaattgtttttctcatgttgggtaggaaagtgactaagtgaagaatcgttggttcacaggttgttttcatggactgtattcaaaggaacagcttggacacaatgttgcagaattaacctgtatacggaggcaatggtcgataaccttttgagtgcaaaaccaattaagaaaatcagtaagaggacaaaaagggtacgaaaaggaacctttaagacattttgactgcatctgattgttgcaatgcaacttcttatttctttatgtccctttcagctggctgcggaggaaaaggaaagggcagcagaggcacagaagaaagtgatgttgctggaggatgttgatgtaagtactattctattattgttctatgaggtgatgcggaagtgtagtccaaagaaactgactgcacccccttgatgtcctttttagttgattagctgggaagatagctgcttcagacaatttgcagtgctgcatgagaagtcttcttgtaagaggtaaaactagaataattgttaattttttaacctctattgcaaatttacctaacctctgtttcaacttttttagcatcttgacataaatgatgcagatagcatatacaagaagcatattttagaaagatcccacaacagaattgttttagactttccttcctgtgaagtacgggaatctacttttattaattgtttgcaaccatgtggtcatatgcattcccttgtatttcatttggtatgcgaactatggtcagtggggtggcatgataaaattattcttagtgaaggtgctgtggtaagtacttttacctatgattgtcatctcaaacttagttattgttattctttaactatggttgttgtatctttgattgttattccagaatgatttgttgaataaagacataataactgctaaaagtctgaacagggagcttactccaaataaagtgaggtatgtgaatcaggtttgtgctctttgtatttcaatgttactgggaaagctctgtatttctcaatgctctgtatgtctaattgttttttccccagatttttgttcctatagtttataatcatcattggtcgctagttgttgtttctactgtgcaaagaaagatatatgtccgactcttgtcgaggcatatataaagaggtgccaattacgttgcttgaaaaactgcagacgtttttgcaacgtaatcacatggacatatctggttatgatacgtggacaagttgtcgcg

SEQ ID NO: 221 - DNA, 3107 bp, Zea mays
atgatatacgactaagcacaatagtcataaaataataaattatacgcacgtctattttcctaagctaaggtccaacaccagaagactatcaaacatagatttatttattaggaaaacgatagaccatatgagttccacctttttatttgactaaagcataatactgaaagactaattacttagactaattattttggaacacgaaattcgaagtatggaccgaaacaactcaactaaccatttaaaccactcttttgaattaatccttaaaatatcctaactaataaaacatcacactatacttaatttatcaagtagagcatcatcacaccactctctagataagaaaatcgtcgatcatatcctactccaacattatcgatcacaaacatagatgatactaactactagcacaggaaatctacatcatcttacgtgcattgaacacaattaccatcgacaaatttatccacaatcgtataaaatattgaatttaacctaaccgtcaccaaaatactacactctgcaaaatataactagttagaatatactcggcaactaaactcctcgaagcacacctcgcatcgctggcatctttaacttaaactttatacgcaaactaagcgtcttatttcacgatcataaaatcaatagtaaaaatagtaaatcggctcatcgttccaatagctgactcgaatccgcgagatcggtaatgattctccgatttaggcaatttgtcgagcccttggcagatactatccgaacttcacgcaccccaccatccaacctttggacatcttctcttggcgcttcttttgtcagcacgactccaacatactcagaggcatcacgtagggaccgacatcgagacagggtgaccgaacgacgacggcaagacaaaggttggagacgaccagatatcaacgacaagcactagagttttacgatgggctgttgtaatgggacatcgatacacgatccatagaaattaggagatcgacataggcagaaccgatagccgaacaggaactgcgcagattgaccacgtgagactcgatctggcgagcacgacacaagggatcgtatctgctgcttcgacatgaattacttgctgccgagcacgacggaggccggggagcaggaacgctgtgcagcaaaacccacagttgcgcgtaggggtaaactcggctaggcacggcgattggagcaggcgtccactgggcagcgcccaagcgtgcacgacgagaatccgagcagggccagtgcgcagcgaccatggaaaagatccgagctgggttgaatctgagctagagctcgcggcaacagggagcagggcaagcctgagactggaagacaccatggcgagcagcaggtagcttcgacggagagaggcacgacaggaaggtggagcagggagacggacgcacaggggaagcgcgcgccatgggagatggctgtgcgagcgcgttagggagaaacgccagctgcgcggagggcgaactcggtatgacaaccatggacgaggtgggcgagcggaggaacgacgcgatggaggagcgcggcttgcaatggagagcagggctgaccggctgccatgggagatcgacttggctagcaccggcggatcgagaaagtcgaggggaggtcgatgagctgagcgactgcgcagtggagcaagcagccatggaagagcagagagtcgactgggagggaggagatgggacggcgctgggatgtccaggaccagggcgcggctgtaggaggaagatgtgagaacgagcgcctgctgccgtgtggagaggagagataatgctgaggaaaaaaatctgcagaagaagataaggctgggagaggatgcgcacgtagaagaagatattctaccggttacccacttaagcggcgatgaagacaaggaaaaaatgcatcgaatacgattactagcaaagaaaatatcgatgacggccaatgatattctaggaagtttacgtacatgagaagaaaacaacgatagagtgatattttctattgtgaaaaatccaaatacgttgaaaatcataccaaggaacggtggaaatatttagagaaggattttccctaatttccttctttttttaaaacaacaaaatacatatattttagggtatgaaattagagtctaaaaatatacagaaggatcaaacaaaaatgagaccgacaacaatatttagatggtatttgatttggtgaatactctcggaattagatgaattttcacccgatatttatatccgaagttttggatctggccgagaaacacaaggaccaaaacactatccggatcgatttgatttagttgagactctattaatttagttgaactcagataaaaatttatctgtttcccaaatcgatttgatttctctacctagaatagcacactaatgaataatcccaattgttaatcttatgcacggtttcttggtaatgcaagcgatccggagtattctttcggacctagtattatctgctattaaatcaaacattaatctctttatctcggataatatcgggttcggataggatgcaaatagaatgaacccaaacgagatcgagactgatattttaaactatatttgatacgacttgaaatcatataacttcatctgccactcgaacacctgatcactctgccatagatgatttattggagaatcaaatctcaattataattccttggttagcaatctcgcgcatgatttttctcagacaatgcatgattcagattattttgccctgaacattttagttgtcgagttcaaattaatttgttcaggataaaatcatccaagtgggtcgagcttccaattcgtattcgcgcgagtgatgagttttaaataatcaccggatgcaccgattttcggaacaactatgttccaaacatcacgaaaatttaggaagaacccggatagataaaaatgatgtcaaactcgcgatagacaaaacagatgcgatattaaaatcgcgataggcgaagatgattaaaatttagcatccgttttatccactgatattacgtgcttaattccatactcgttgtcgagcggaatataaacaccaggggtgttaca

SEQ ID NO: 222 - DNA, 3106 bp, Zea mays
ttttctatagcacatatctacagaaaatacaatttagttcatcaaacatacagcacagggaaatcactgcgtgcagtccaaaacagcaattaataaatttcagctcctatataattcaagaattgccgtgttctagatacttgaattattctaacactttgacaattgttagagttaaaatgaccaagtgagaactaacaagtagacttactaatttttatacaagttatttcgcgctctagaactaccatacacaattaatcaacacattcaccataatcatcaaatccggcatacatatatatcgatgcgctcttcacatagtaatttgcattttaacttgagcatcacatgaacactactaatttttactcgcgaccgtaaccatacatatttagactacaacaagtaaatcatcgtgattacgagcttaaccaacctatctaacacttcggctaactagagcaacgacatagcccgctaaataacatacacgttggcttgactattattatcactatctaaggcacaacatacaccacaacatttttataaacatacatattcacatgtatattcacacatcgaccaaatctacgaaccgtaaaccactaatctccacatcgtaatcaccacacatttacttcccaaatcatgaacgtatatatgtttatcatacgaaccgagtatttcaataattatcctaaaacaactaactccattacacacttgtatcacaaacccacttgacttacttgaagcgtctactcgaaatcgtgagcacaatcatacaccatatacgaagcataatttatcgaacgcataaacgcatcgtcacgactcgacttataattatagagaaagcgatgactactttggcatgtcaccacttctctatttaagccaagacagcttctatctacaacgaccaatcattcatgtcgagcacacttattttaccatgtctcgcatacaaccatattgtggcgtgcactcgagacacttcgattaaattaacgcaatcactactatatgaactccaatactcatggcttaacaatacatcctccacgcaactagcattttctaaactactcgtcacatcaataaatatatcccgatataatcacgaatcccatcacattgcataaaacaattacacttttcacataaacacatattgatgcattttccaaaacataatccgcattttgtaacttagtttttcgcataaacaacgcatcgcatatttttcctatcaaaatataaaaatatccgagctcttttctacttcagtttcttctctacacgcgttcattcatgcaattatactttcacgcacatattcacgccatcgactgaatcgtaaataaaacgaaatcacaatttttctaaagcgaacaacctggctgactcgtgtcgtgcatgcctgcatgctgtccacggcttgggactttcgttcgtcgagcatgggatgcgcgaggcgtgacgacaagggctgtgagcacagcacagtttaatacacgatttattagtttggttattttatcgaacacgagaaacgcgggacagcggggtctcaccatgggtttcgatgacgtcacgcaagggctgcgcagatcgacggcgggtggcccgacctggcgagcgtgatgcagcggagggcatcgccgctgctgcttgctgtggcattacgtcgagcacgcagagggcgcgacgcagaggggatccacgtggctgcacgaactggcgtcgcggctactgcgcgaggttgacggctgcggggtcgacgacgtcacggacggggctgctgctgctcatgcaccgaggagatccggtgcccgggtgcctggcagggccaacgacggctggacctgggcgcggccagagcgtcgagcgtccggcgaggctcgctgccggcgaggacgacgaccgaaagcggaggtcgagcaagatgcaggggctgtcttctgccttgccgcgcggaggagatgaagcaggggaaacaagcgtcggccttggagaagaaattcctctgtgcaaggaacagagaggaggggctggagataggagcaggggcagtcgaccacgacttgggagaggcagccggcttgggggagaccacgagcagggcgctgcaaaagcagaggccgatggcctgggcgagccttgcgtgtccagcgtcctggccccattgctgctggaggggagggcatccatggaggagggcgcgccagcacaccttctcgagctcggacgctggaagggagccccgaggaagccggagccgagggggaggggtggcgccatggaggccatgctcctgcgcgctggggagaatggctccctgctgccgacgccgtggaggatggggacttggtagagagaggagcagggggcgccatggggaggagagggagttgtctgcatttgggagagggaggcacaagacgcgcaggaggtagaagaatgcgtgtgtgtgctagcttcacttaaacagggcgctgcgctatcctttaaagagagctgctggtgcggccataggccagggagagcagcgcgctggacaccattggcctgctgactggtggccagggactggctgacttggccggcgcttcaggccaaacaccacgcgacagccatggccactgcagcacgtaaggtacgtgagtttgtctctttttttttacattctacagggtaagaaggaaatggtactaaattaagatctacccttataattaattatggttgagttttatactaaacaccccgcatccgtaacaaacgagacatgagaaatttcggtagaaactctaatcgatattgcctgaaaatagaaaaaaaatactcgcattctatttgaaaaatgttttgacttaaatttgaccattgtttttttgaattagaccttcgtagttcgaacaacaattaaattatgcgagtagttctatctcaaaattcttgccgcttttgttcgttccaaattttaagattatgctgcgttataggtctacgccagcggtccgggttataaaattcgagtctcctaaatacggtgttgcattttgcttattaagacaggaaccaatttagcaaataa

SEQ ID NO: 223 - DNA, 3105 bp, Zea mays
ggctgacgacgtcgtcttgcggagatgtccaatctctgcattctcctagggtcgacttgggtcgtcttccgcatcacgtgattaattatcgtacctaaatgaaatgcataatacacatgtatgaataccaaggaatagcacataactaattattgctatagtaaagaggattaagtatttaatcacaaggtattacaattttcacaagtaaaccctatatacatataacttaaaataaccgacagtagcattttaatggacgtagaattactactctaaactattaggcacctcatatcagctaaacacgatatcaacgcaatcaatcatacagaaatcatgatatatataagcatcactaacgtttacctcctagacgatagaaacatttacactaccctttacataaatagcttgaccattcatcgtaaatgatgaaccaatttatgcttacttaacttatacattctctatgacattcttcgtaaatccagcattttagacctaagtcgttccataatacgcaattatttcacacgattacgttaccggaggtgctaaggtattttagcaaacatctaacacaaacacaacacgcctactaaacacgagaattattatgactaataagtctagttaatctaattcaattaaccgaaataataaattggcttaccaagaccgaattgattcgataaccgcgagggcatgacggttttccaatttagacattaggtcgagctcccggcaatcgttgcacggacttctctcacatttttatccaactccaggatcagtctccgggagataaggtcaacgacgagttctatggagtgaacgacaacgttgttgtacccatggcgtggagacgaatgacggcaactcctcaacgtcttcatgggcacagcaaggacacagggcgcgatgactatgcttcactggcaagaaacgtcttggcgagctagtcgacgggagcaacaaactatggatttgaaattcggactaggaatccatggcctaaacgacacggacaaatgacgagtgccggcctgccggggctatcaactcgtcgcgcgaccgggtgacgacgacgaacaaccaagcacggtaaggagctggagaatgatgacgggcctagcagaggtgctcgcgcgcgcagcccatgacagagacacgaagctggacacacaacaacttgaggctggacaggcgcgacatgctacatgacaaccagcagggtgctgctgcaggacagacctacacgatgctggggttgcgatagaacatgaactcgcgctcgccgttggcgccattgtcgcggaggatagcagcgagcatgcgaccgaactcgtcatcgccgagcttgccgacgaaggcgacccggccactaaggcgcgagatcacgatggcgacgttggcgggtgcgctagccagggagcaggaaaccagggcggcggcgcgtgcacaggaaggcgcgcgcggggaggagtcgaggagacctcggctgggcgcggccatgtgaggtgagcccgcggcaacagagctggaggacgtgtagagagatgggcgccgagctggagcaaggagaaacaccatcgctgcgcggcctccgatccggaaaagaaactgggcgatctccgagcaggaagatagatggccggcagagggagccgccatgggcaagctggagggagctccgaccaggcgcggctgggaaaaacgcaggtcaccggcgagctggaggaaggcgagctgaggggcgcggctcaggaaaacaccagggagagggacgccgcgagctggggcaaacagggagcgagggcgcagggctcggcggccagggaaatgggcgccgacagaggagtgcggctggggaaaggctccggccatgggggaagcaaggggccgggggcgaacttgacgtcgaacgtcggccagggagcatagcggagctgggacggcgcgcaggggaggacgaagatccaagcgccatggatggagtaggggagaaagccggctgcgcgcggctggggaagaagcagagaggaaggagccgagcgctcctgcactacgtaggaaacagagatgggaggggataaggagaagcatcaagcggaggaaaagaaaaaaaatcttcaggagaccaacgcccgcgcgcgacggtgagaaagatcggaggctcggagcagggaggggcggcggaggataggatccgagaagtttttttagacttttccatttttctttttttataacggacatcgcagatatttcaaactgctggattattagcgacgcatgattggtcgaatcaaatgagatcgataacaataattggacatgatttgatctagtgaatacttcggaatcagataaatttgcacccgttatttatccaaaattttggatcgggacgagacgcaatcggaacaaatcagaacgatgttaacaacagtaatactgtgttctatttgattggaaatcaaataatttcatccgcagtcaacacccgattccacgaccacaaataatttacgtggagaatcgaatctcaattataatcctcggacgcgatttctcagctgacgagcagagacagaattattttgcaccaaaaactctagttgtcgagttcggttcggtattcaagacattatttagtcccgtcaaattttacgattctcaccaactatcgatcatctaatttgacgccaaggatcacatgctgagagaaataatttaattaatgcgctggcgcattattcttttcggacagcgtggggctccaaattttgcataaaatcagaagttttcagattttcattttcacttgcgcgcgtaatccgaacatacccaaatttgccagcaaacggagattcgataatccaaagtttctcgaaccctttttaattgcttagattatcgaaatgaaaacggcaccaaactcgaacttttgtgagatgattaaattccaagctaaataagatttctcgaataatcttggtaatcggagacatggctaatatcaaaatcgttattcaccccggcctttcttacttacatccataatcgttgtttacgtacagtaacacctggggtgttaca

SEQ ID NO: 224 - DNA, 3105 bp, Zea mays
ttcactccaagaacaatttagtttatctaggtatcttttttttagtcaaaaaatttatattaatattgggagtagtaactttgaaattatgaatattctcaaggaaaggtgttttgatttaaaaacccctggagaattttcctcattttcacaggattgaactttagggtgttacatatagttgaagatagcatgcctaaactattattgtttatagtgtgatatggagcaaattgtaattaaaattggaatgcaaatttttctatatttaattcttttgttataaatgtcattgatataactgtaatagaataatcacaaagaattttaaaacatggatcaaaataaaagaagaattgcataaatatagctctcaactctagaaaattaccgatctaaaaaatatacatgttgcactttaaacatttctaaagttacctcattcttcatatctacaaactacagtgccagcattcaaacatccaataacttggtccccaaactcatgctataggttgtcttgcacttgggttgatgatgaagcatgtgaaacaacatgttgcataactcacgcctatagtaaattgatgatctgaaaaaaatctacatgttgtgcttcaagcgcttttagagtcacctcatccttcatatgaccaaatctagtgctagcatgtgacaatctagggtcgcatactcatgatatggttttcttgaacatgggtcaatgatggtgcatgcgaaacaacacattgggtccatccataaaaaatgtctgtctaaacaatacaacatttagggcttcaaaaagcattgaagttggcgcacattagaaatcgatatatcatgcagtaaacttgtacgaatataatatccattagtcccgtactcatgttttgatcggccttaaacatgggttgatgtgttcacaactaagaaacattgcaaatagcacaatatatgttttaaggtaacatgcctaaacaagtatgtcttttagaaaagacaaatgaaagtggaaatataaattttcttctattaactaattttccattaatagaggtcgtaactctgcaaaatagtttatcttgaaaaatatgcatattgaaattcaaatacttctaaagttacctcattctttaaaacactgaactttaatcagcatgcgaccatctaatttgtgggtcccatactcaagttattgattgtgttgaattttagttgatggtggagtgtgtgaaacatgttggatcattttgtaaatcgaccccataatttagggctttgaaaagcttcaaagttttcgcatggttcatgccacaatcttttcttgaaaacatgcaaaaaatcacgacgctttactcacaaatcagtgtattgcgaaaacattcataacaaaccatgttgggtccttttgtaaaaacaacagttctaaacattacatcatttagggctttgaaccgcttcaaacttacattaatgtccataaccatgaaacatttaaaagttttccacataccttatgagataacatgcccaaacaagtgatgtttacattttggcaataagcaaattgtaatgtaattttccttggttaaattgttttgtgaaaaatatcatgagtcacataattttttttagtggcctcaacacatgcattgttgtccataaccaagaatcatctaaaatagcagtacatatagtttaagatagcatgcctaaaatattattgtttatagtctagcatagagcaaattgtaattaaaattggaatgagaatttttctatatttaattcttttgttatagatatcattgatataactttaatagaataatatcaaagaatcttaaaacatggatcgaaataaaagcataattgcataaatatagctctcaactccggaaaattaccgatctaaaaaatatacatgttgcgctttaaacatttctaaagttacctcattcttcatatctacaaactatagtggcagcattcaaacatacaatatcatgggccccaaactcaagctataggttgtcttgcacttaggttgatgatgaagcaagtgaaacaacatgttgcatagctcacgcctatagtaaattgatgatctgaaaaaaatctacatgttgttcttcaagcgctcttagagtcacctcatcctttatatgaccaaatctactgctagaatgcgacaatctagggtcgcatgctcatgttatggttgtctcgaacatgagttaacgatggtccatgcgaaacaacatgttgggccatctataaaaactgtctgtctaaacaatacaacatttagggcttcaaaatgctttgaagttgacgcacatcaaaaatcgatatatcatgtagcaaacttgtgctaatataatacccattagtccattactcatgttttgatctgccttaaacttgggttgatgtgttcacaactgaggaacattgcaaatagcactatatatgtttttaaggtaacatgcctaaacatgtatgtcttacaagacgacatttaggaaagtgtaatgaaagtggaaatataaattttctttcattaactatttttccattaatagaggttgtaactctgcaaaatagtttatcttgaaaaatttgcatattgcaattcaaatacttttaattctttaaaacactgaactttaatcggtatgcgacccgctaattatgtgggtcctatactcaagttattgattgtgttgaattttagttgttggtggagcatgtcaaacaacatgttggatcattctgtaaatctaccaaataatttagggcttcgaaaagcttcagagttttcaaatggttcatgccacaatcttttcgaaaaaacatgcacgaaatcatgacactttactcccaaatcagtgtattgcgaaaacatggatgacaaatcttgttgggtcatttttgtaaaaactaccgttctaaacattacgtcatttagggctttgaaccgcttcaaacttacattaatgttcataaccatgaaacatttgatatctttccacatatgttatgagataacatgcctaaacaagtgatgtttgcagtttggcaatgagcaaattgtaatgt

SEQ ID NO: 225 - DNA, 3105 bp, Zea mays
gatcaccatcgcatgggctgaaacctaccctggcggcccactttgtttttccctcgctcgacccattctcccgctatcacaccgcgcggccgtctaagtaatccgacgctgacagatgggccacggtgaccagctccctaaaccacgcgcgtgcaacgggcgtcgctaatgcgtggacccgaactccacgtgacgcaatcgctagcgccgttgccgcagacaatggctcgctggacccaccgtccagtcaccgcgcgcacgaagtcctgttcctcttcttcccttttctctgcatgcgcagccacctcggcgatttgcccggctcagctggctagttcaacggtcgcccgaacccgtcggacgccatcacttcggcacataagtagcatcctcagcgctcgggcgcgatgaaccctcacccgaagccatatgtaagtatgtaacacccttattgtacgtaaatagcgaatatgaaagtatgggaatattaataagaataatagtctctctatcttgatctgtttcgtctgtcgcgagttcgacatcgtttttatttttatctatccgggcttgtcctaaatttttgtgatgttcggaacataattgttccgaaaatcagtgtgtccggtgattatttaaaattcatcgctcgtgcatactagtgtctagcgcgcgatcattcgcgcgtagtggcactgataacagaaaggaaaatgttgatggtaaagattaagaattatcttatcatttggtatgaaacaaacatatatgtttcctcctgcgcatgaccaagagatggaaattgatactaatgcaacatataaaaaaatattgccggcgactaaaacctgataaggcaacaaaatttaatatatatgctatattgttcttaacaggctaacagagatagttcttaagtaatataagtccctaactaagaacacaattagaagttggcagaaagatgtaacataagttgatttagttcctagcaccacgtaatcttaaaagagataaaatcaattacatatacacatagcaaatggtctaggtaaatcaactaaagataaaaaaaagaaattatttctcaaacatatagaggagtagggaataatgggacttctgcagtacaactattaatagcaaataaagatacgaagacaacgtaattgacttattgtatgtatagacaacaaggaaatttcagcaaaaaaaacaccagcagttgctgacaccatgatgttgcctgccgctgctaaagcacctcatcaggcacgatgtgctatagacacattaagctggatgtcgtaaagtaataatcctactattttatttgtggttggtgtctgattagcagcagcatctggactcattgattgactcgccgtgtatgcgcttatggaatcgaaacaacaaatgagtcgcaactgcattgatgatgatggcaataggtaataaagaaggggaaaacacacctatgcaactaatcaggctgttaaagaatcaacctgggctgcctcgaccactatccaccacagctgagcagctgagtagctgcttgagctcctcgatctgcgtcgcgacgtcgatggccatctcctccagcctcagagacctcagcttgggtgcgtccatctcttgaagcacaaggaacacagccgaggcggcggcggcctcctgaccctcggcttgggcacgtacatcttttggagcccaagggacgcgcccacctcgggcgcgcgcaacgacagcggcgaccttggccgtggcggtgggaggcggcgccgcgttgtgagtgagcggattgctagctccacgatagaacggcgaccctatccattcgccaacaaatgcttcaggaaagggcgagtgaagctattgtttgtgccgttcaaatcacatccgacgctataaaatttttctatcgacatggaccaccgagagcagtcgttttcgaccgtgtttcatatataggaaatacgaatttggaaatttagtccagtcctccgatttcctcctaaacagattaactagaactcgacaactaaaatgtttggggcaaaataatctgaatcgcgcattgtccgaggaaaatagtgcgcgaggttataatctaatttattcttcggcacactccgtaaaataataaaatcaactgtgtttagataagggataaattttatccgattttgactaaaccagtgttgtctcaaaaattgtatctgatatccagtccatttaggctctcgcccacgtaaacgatgtgtgtcgtcgtttccagaaagatcgcaatctcgatgccgcatcgatatcgcgcatttatttcgcgatatgtcgagtcttgcgtacgtttacaagtatagattagggaatacgaactcggaagcccaacccactctgatgattttatacccaaacaaatttatttagaactcgatgaatgaagttttcggaacaaattatcagagccagaaccattaatcctctgattattccatttcatagttcggagaaggaaatgtgtagtcgtatagtgtgtcgacccagtatacatcgctaaaaatcgtgatccaaaatatctgcaattttcctttaaaaaaaggaaaaatctctcgtggctctctctcttccccctgatcttttcctctgtcgtcggcttatctcctactagtgggcttatctcctactagtgtctaacgcgtgctctgcacgcgttgttgtttttatccttcacgatgctgccaggtagatgcttatgcatcccgcaattctagaggccacttcatcggttgcttctcgcctacaggcatagccttgggggagtgggtgtgtccattcccctctggtgaatgctctgaagaagctagggttcatcagtggggtccagtaattgttgtgttggccatgaactgcattcatgcctctggatttgcaccatgcggctgatgcttcttggagtctctgtcaaagttcagtggagaattaataaatgaaatattaatgttaggttgacatgcatgtttatcaatcagaaaaacaaatatccctttggtcatatcattgaacatattcaatgattcttgcttcattgcaaatgttgaacga

SEQ ID NO: 226 - DNA, 3104 bp, Zea mays
catatgacaaacgcttcttaacttggaagagaaaaatactccaggatttagctagcaaggccaccaaaacggttaatatttttgagaaaaaattaactaggaaataaaagagttacagtagttaatgaatagtcctgtggtggtttcacctgacacctgtgccttcatgatctagcagactagcacgagtgcaggctgaatatcaggaccttgtaacttctattatcacaatttaagccatcttgctaatacaaaaagtaacagagattgaggtaaatagaaaaggcagcattcttaatatgcaaacagaaaggccatgtagtacattaaaacactagatattagcattcctcaatttggtacctataactggcatacttatacaaaactacagaaaaatggttaaaatatgaggcatactccatcatacagtaagggcagtgcagctaacctgtaatcaaagtagcggtgaagattatccagtgaagcaacatagtcatcatggtaaagagcattcaagtactgcaagaattgaacctggcaagcagaacacagatacaaaaattcacatgattaggaaatgttcatccttccccgaattctcctagaaaatttaaggtgtattctgtgccataacttacacgatgaagctccggagctaatgtttgaagctgtgtcatagtggcattaaataaattcaaaggcactgatccaggatccctgtaataacagagttgtcactaaagactgctttatctttcatgtccttttaaaggagtagaacaagtttgtggcagtattagctatttatgactatatgtaggaactggattctcacttctcaagaatatcagcttgttggttaagatatgcctctaattgccaccttgatctcagacaggttgggttgtcatctgctttaaaagtattagctaacatagaaaaaaaaaggaatgcaattataattgtcaaccaaaaaaactttgatgcccagataaaaccaaaataactctacatagtgatattacatacagtacagaaaagctgatttataaggcagaaaatcattagcctaatctatttggtgtttgaatcagcctccttgcaaaataaaaggtaaggttgcccaaaatttccctgccggagtccacaatatgtaggaactttcagaactcagtatgccctaatgtatttagtaatacataccaattaactagcatgagtaaaaaaacaaaagatcataattgtacaaaaatatatatataagctgcaaatgctccacttcttcagtagtgcaatggtatttgagagaaacatggcactggcagtgaatgctctaggccaaacaatggcaatgaatgctgtaggccaaacaattatatagttaattaattatgacataaaagtaagatgaacactgatgcagctagatgcgagccaaccttgccccatgccaaagttgtaacagatcaggaggtaatctcgtcaagcttggaattaaaataaaatacttgaaacggatactgtttcttagaatcggaataaattcatgcagtgaatagcccttcccaggatcccatattacagccaaaaaaggaagaaactaactagatgccaggaaaaaattgagatagatagtccatccaggttgtgaccatcacttttcttttcattctggagtttgaccattttttgtgtgtgctttaacatttattttttggcatatttaatacttccatcaaaatcaaagcagcaaacatggcagggttcaagtataccgttgtcaaagtcatagggtgacattgatgcacgagttaaagttgaagaactctcccccatatgatgctcagaggcataaccctgatgaaatttgtcaaatataccagcgtgcgaacctatgtctgcatccatcaagttgcccatttcactattgaagtcctcatgttctgccaggtcatatgaagcatcagcagagttacagtacatgacaagatctgccaacagatggcatacaccctagaaaatttttcagttaacaacatcagcactttaaataagaaaaaagggaccaacacatgatgaaaaaacatcgtgaatgccttttactactcttagcacctcaaaggtcattgagttgaaggcaagtatgcagcaacgaagaaatactccaagttggctatttggatccaagaatacatcttctgcactcgcaccctctggtgcagtgaacacacctggccaaaagaaatatcattccagagcaagctgtcaatttgaacgcctctttatgatggaaacataaatacgtcaaaacatccatccatccccacatcatgtgaatctcacctcgtagcttatcaaagaagttgaacaagtcatcaggtgagttgagtgctgacagggcacttgtcagctgctcgcagaaccaaccattagtcaaatcatccactgccctcagctgcttcaaaaattcttccagtggaggctccagaaaatcatcgcatgactacaaaattattgaagtaagaggacctgtgtatctaccacaatatcaactgcaacattgactgactgtgcaatccgtgacggccatctatacataaccagacatcacatcactgttttgtttattttgcttgaacttaaatggtagacggttgagcataaatgcaattactacggggggaaaatcataggaccaatgcctaaatcctcgagaccctaatgccccaatccaaagcgctcactccacatcaccaaatacaagtacagcacagggcagagcaatcattacaagcagcaacatctcgaaaattcgagcggggagcaagcgagaaagcgcgcgaggacgtacccgggtgagcgtaaacaggaagagtccgaggcggttgtggtgagtgagggactcgaaggggaagggcggcacgacgtcgcccccggcctgcgccgccggcgcaaagacctgcacgaggtggcacaccgccatcttgtgcggcgtcagctccaggagcgccgtgcctgtgccgccaccgtccgccgccccgccgccgacccccgcgaacaagttcatggctccgcccgccaccggcagagagaaaggaggg

SEQ ID NO: 227 - DNA, 2989 bp, Zea mays
ttctagatttggagaaggaaatccggctaacgggattcgagtcaaaaggtgagttgtcatcccgcgccttccccttctttggaaaaactagtttcgtgtgacgaaatggctggccgcgcgcgcttgatggaggttagggtttcgttcgactcgcctgatgcatcgatgatcattcacgaggccatcctccacacctatttttttcggttcggtcttttttttttgcgatttgcagccctattattcttcctgacgtgttgtcggcccttcaatgtgatgtttcatatataaactcaaggattagattcggatgtgcactttttctagggcggctattattaggttggagattctgtagttccttgcatcggagctgaacatttttgtggatactagatttgcgtttgcttgttttgaaattgtggtctatgtttaactctgattgcttggtagattttttgggcttgcaacattgtgcgcctattgttgtttagctgggctttatgaatggttagtggctttgcgtttgttctggttatatttttagttattcatatagatttccagaactagggtttgttaggggataaaacagtggtaatttttgtttgaattttgctgtggaacttgagataatttcaccctaccaaacaggcactatagatggacccttaactagagatgatcagtttaactatagatggaccctaccaaactagccaagttacttaacttgacatgagaagtttaattcggtgagccaccctgtttggtaggcactataaacactcttaaaatatgcattagaaaggtggataattcgataatcaacttcaccaaacaaccaattaacaaaacaagatcatttatataaaaataatttcacaaaacaacataaaaagttatagtattaacaaactgaatatcaaagtgcgcaaacaaaaaaaatgatgcatttgttgcactattgttttgccctgtttcgattttttattcttttaatataattggaagcttttctttctagtcatttcacacaaaaaaaacatctggcttacctgatttttcgctataagtcatctaagagcaatgcaacatagaatgaaataatcaaaggtgcaatggcggagtagcacaaaacaactgttgcgatgagcatgtaaattggagccctggtgttatattgtagaacccctagagaccatgttgctttcacttcatccttcgtcttgcatagaccctttttttaagatagaaaatgatgagataaaacaatcaagagagctcaaagccaacaaagaatctatcaatgacaacaatttaatagttagggtgtgaagttgttatcaaatgcaaaaatgttaagaataatattttgacagtaggtaacgataaagtgagacaacagaattacttgaacgcaacaaatctggggaagaatgttgcacttccagacagatatttgacaatcatattcacaatcttagtataatgattgtgaatgtctgtcaaagatttaaacaatgtgcttacaactgtcaaaaatagaaaacattaaaaatgatgaaatagaaatatttcacttatgtccttatagctgcttggctctgcgaagggattcactattgttttgagagaaacataagaagtgtagttaggcatgcgagtaatataatgagtgcaatttggggaatgtttgagtgtttgactcaaaccatcttgatttctcgttgctccaccactactttcagaaagggtaccttctccatattttataaagttgtaacaacagagatatcagcaagaaaaatcatataaaaacaaaaatgagaaacaatgaaaaagataataacataaaccatagattgtctgatttgcttctcgtatagtttccttagattagaaggttggaccatattatttgacgtggtttagtagctttcataattgtccattcatcatagacttgagcatgaagattttgagatttatgagattcatcatatctactactgaagaagacaaaaagggtactctacagtttcagcttctaatttgggcaacaatttcttagtataatcactacaatattcaattgtgtcaacctttttatcaataagaataagtaaattagtcatattaatatgctttgtgcccttgtattactttcagtttcaagtttacatatatgactttaacgcgacagcgcggacaattttctccgtatgacattcgatctcttggtatattttatcagcctacaatgcaatgtaatcagaatataataaaatttctatttcattttttgtagggttgtttttggacatgtatccctctctataattaaagtgtagaattacctttgtgtgacctatcacaaccattgatctatagaaagtattttagtgaagcaataaaaatttatagtttcatttggagacgttacaaggacatctctcaccaacactacaaagttatctagtttaatatctgatttggattttgcagtagccctcaaatttaaaatatgtttgtaagattttgatagtatgaaataattgacaaagtaaacccaataaactaacaacagaaatgcccacaaccttatactttttcatgggaatgtttgtacatacatacaaagtttagttttgttgtaaacaactaaatatacatcatttgtgacattgcactactaatgataagcaaaattagagcatggaaagcatgtatttattattttaagttgcatgtatgacaaaccgttaaacaaataataaaacacttgtaaaaatcattataagattacttataggaacattacccactcctagtctttttatttacgagaagttttaaattaattgagtagatatgttcgtatagattgtagttaagacaccaccagttgcagcaacagtgagatgaaccggaagtagtacaatcctacagtatataaagatcaacaacattggaatatcaagtacac

SEQ ID NO: 228 - DNA, 3097 bp, Zea mays
ccgaaagtctggttgtctcatccagtatcacgactcctagtctgccatcctttatggactactagtccacaatcctctatgggcattgtaatagagtgaggttggtgaatgacaaatgtttgccgtgtggagaaatcatacttaaggatttcgactctacgacatcacagatatagttaatgggtgggacatgttgagaggaaagaatttgatgtaatcgacattacgacatcacagatatagttaacgggcgagacatgtccttttgaggatttttagaggtttctttactagtggacgtactcaagctagaacattgctcctcggcaccaccaacaatcttaatttcctctaagggtacttcttcaatattagggaactaggaataataagaatggagtatgtggtgaatttcctcccttcttcctaatcattcatctaccatatccatgtcaactaaatcctgtaaaatcacaaggcaacaataaatgccataagagaagagagctactcactctcatgataaactctagccatcaattattattctatgctctagtaaacctagtcacatctccacatgatcgttttggaaaggaacatttcacattatattaaggaattaatattacctgtgttggaatagtcttgaataacaaaagactctttttatagtaaaggtgaaatgaaagagtagagatgataagaggtatggtcaagcatacagccacccgcgattctttaatgtcaaatacactagcacagatgatctgggtaagcacgagagggaatatgattgtgttgtgtgcaattggccaatacaatcctcctgtgtcagaccttgttcgataaacattgagaaactgaaaaagaacacatggtacattagcatgaatggacaaatttcagggtaagtaagaaaataaaatatagtatctaggttctcacttgattgaggtatacaacacgaccaaggtaaaagtataccagcaggaaaggtaaaatcataggagccaccacagagcatgtgaagcccaatagtccaaacaatagaacttttggcacttcatgctgataggggaatgtgggaacagattctgtatcttctctatattctccctttctcaaaatatattttccttataaagctcattatcagattatagaactgcaaaagttcggatgataaactagcccatcccgaggtcataacataggtgatgaagaaggtagcctgcaataaaaaataaaatcacagaaaagaaacagaaatgttagatgaaaattaaatacacaaaatcaataaattatctttccataaagaaaagggaaggtgtgttaaacctgtctagttaaagctctagcaagcttgatagaaatgtcctttgggcttaataacaaattcaattgactcatgaatgtaccgcatagtacattaacaaagaatatgttccaaactatgaagcacaacagtttaaagtaagcactcctcttccttgcactatgagatgtggcaccttccaatttataaattttcatcatcaatgtcccaacaatatacagaataatttgttggatcacactaggaaggtatcccgttactaggttagtcatgtagtttttcctgcaaataggccgagtaatatatattcaataggtgcaatatggagtcaggtcaaatggatagtatatatatttgtagcgacataagatcccacatctatcgagatagcccaactgaagtttcagtacttacttctccaacctttcttttaaggaagcaggaaacaactgttgcagctgctttgggtcagatagtgattgtatacacaccattggcatcaaaagtaagaatgcaaaaataatacaacctggaactagtgttgatttacgacgcttgttggattgccaaagattggaccaatacacgtcttctggttctggagccagactagtaacccatttcagtgggttagatgtctgcaccatatttgaggcagtaactgcgtcatagcgagttttgaaaaatacaaaagcagttgtgcattcctgctgcatataattccacatagaaattactatccatattattactgctaaattaagcaattaacaaatgcatgcatgcaagaattttaacctcgtgatctaagttcatggtggattcttcattgttagggttccccttgttttgctcgccttcatagttgaacttggaagaatttggagagggtggtcccatgaaacaactgttggtggttgtcttcctaaatccctgactgtcgatttcagcaatgaaatgtttgaaattctaatgtgccgtcttagtgccagtctgtcagataaattaaagatgccaaaaccaagaggttaaatacaaacacgcataaggaaagaaaaaacattcaacactgaaggaactggacatttgttcacttgttcatgtcaaaaagacaaaaaattatgagaaaatctagctaatcatgagatgaataagtcttaattatacttcccttagaatatataatagtaaatgttcttcattggtaaaagagaaatgcatgcattgagtacaagctagatacaattatcttatggacatgcccaactttgtagacaatttgatggaagagataactagacgagtgatactttgtgaagaaatttccaacagcatcactgtatgattctttagctgtctttggtatttcacgaacaaggagttcaaattggcttggatttagcgttgaccttttgagataaagggacctcaacgtggcaatgtgcttcccctcctacattgaagggaaaaacagatcagcagaaaacgttccaactacaaggagatgtaacctttcaacaattcaaatgtgaaacaaacttacaatgtatagaagtaagcatgttactccagaaattatgtatagcaccacacaatggatcaagaggctgcatgcaaggaatcatcaaaacatgcactttgttatattctacactactcattcttcctcaagttctaaagaagtgaatgaagaagcatggtggatgaattaatcaaggtagaaaacacttgtaagatgtcggcaactatcacaac

SEQ ID NO: 229 - DNA, 3150 bp, Zea mays
gagctatatttatacaattctgcttttatttcgatccatattttaagattctttgttattattctattacagttatatcaatgatatttataacaaaataattaaatatagaaaaaattcattccatatttaattacaatttgcttttatatcggactataaacaaaaatagtttaggcatgctatcttaaactatatgtagtgttattttattcctggttatggacaacaatgcaggttttgaggacactaaaaaaactatgggacacatgatatttatcacaaaacaatttatccagggaaaattacattacaatttgctcattgccaaactgtaaatatctcttcttttggcatgttatctcataagatacgttgaaaattttcaaatgtttcatggttatggacattaatgtaagtttgaatcgcttcaaagccctaaatgatgtaatatttagaacggtagtttttacaaaaaggacccaacaaggtttttcatcaatgtttttgcaatacactgatttgtgagtaaaaggttcatgatttcgtgcatgttttctcgaaaagattgtggcatgaaccatacaaaaactctgaagctttttgatgccctaaattatgtggtagatttacagaatgatccaacatgttgtttcacacgctccaccatcaactaaaattcaacacaatcaataacttgagtatgggacccacataattagatggtcgcatgtcgattaaagttcaatgttttgaagaatgaggtaactttaaaagtatttgaattgcaatatgcagatttttcaagataaactattttgcagagttacgaactctattaatggaaaaatagttaatcgaagaaaatttatatttccactttcattactcttttctaaaagacatacttgtttaggcatgttaccatgtaacatatattgtgctatttgcaacgttcctcagttgtgaacacttcaacccaagtttaaggccgatcaaaacatgagtatggactaatgggtattatattcgtacaagtttgctgcatgatatatcgatttctgatgtgtgtcaacttcgatgcattttgaagcccgaaatgttgtattgtttagacagacagtttttacggatggacccaacgtgttgtttcacatacaccatcattaacccatgttcaagacatctataacatgagtatgcgaccctagattgtcgcatgttagcactagatttggtcatatgaaggatgaggtgactctaaaagcgattgaagcacaatatgtagattttttcagatcatcaatttactataggcatgagctatgcaacatgttgtttcaattgcttcatcatcaacccaagtgcaagacaacctataacatgagtttggggcccaagatattggatgttcgaatgctggcactatagtttgtagatatgaagaatgaggtaactttagaaatgtttaaagtgcaacatgtatattttttagatcggtaatttctagagttgagagctatatttatgcaattctgcttttatttcgatccatgttttaagattctttgttattattctattacagttatatcaatgatattaataacaaaagaattaaatatagaaaaaaattcattccaatttgaatttcaatttgctatttgccagactataaacaataatggtttaggcatgctatctttaacttcatctagtgctattttaaatgattcttggttataactaacaatgcatgttttgaggccactcaaaaaaagtatgggactcatgatatttatcacaaaacaatttaaccaaggaaaattacattacaatttgctcattgcaaaaatgtaaacatcacttgttttggcatgttatctcgtaagataagtggaaaattttcaaatgtttcatggttatggacattaatgtaagtcagaatcggttcaaagccctaaatgatgtaatgtttagaatggtagtttttacaaaaaggacccaacaaggtttgtcatcaaacttttcgcaatacactgatttgtaagtaaaagagtcatgattttgtgcatgttttctcgaaaagattgtggcatgaaccatatgaaaactctgaagctttttgaagccttaaattatgtggtagacttacagaatgatccaacatgttgtttcacacgctccaccatcaactaaaattcaacacaatcaataacttgagtatgggacccacataattagatggtcgcatgccgattaaagttcagtgttttcaagaatgagataactttaaaagtacttgaattgcattatgcagatttttcaagataaactattttgtagagttacgacctttattaatggaaaaatagttaatggaagaaaatttatatttccactttcattattcttgtctaaatgtcatactgtaagacatacttgtttacgcaagttaccttaaaacatatattgtgctatttgcaacgttcctcagttgattttacataaatcactcagtaatttgacagcatttgttcggtaattccttaatcacatagtaatttcatttacccattgataaataacaacagatatgtagtgattatctagttactaaataattttacaatctccgctatgaatttttgcaccatttgttcagtaatttcaatcacccagattgagtagttatataataattttacagtaatcactcattaattttgcatcatttgttcaacacttcctcggttacctagtaatttcattaacgcactaagaaaataaaaataaatatgcattaattttgcagtatttgttcaacactttcttagtcactcattaattttattgcgtttgtactataattatcaatcatccagtaatttacgttgagaacagaacaacatatatgcaatgattgtctagttactcagttaatttacagtaatcactcgatattttttcataaatcacttagtagtttggcaacattttttcggtaattccttaataacacagtaatttcatttacccattgagaaaataataacatatatgtagtgattatctagttactaaataattttattgtctccactctgtaattttgcgccatttattcagtaatttcaatcaccgagattg

SEQ ID NO: 230 - DNA, 3092 bp, Zea mays
gaagttatattttttaaattggtaattttctatagtagagagctatatttatgctattcgacttttatttccatccaggttgtaagattctttgtcactattcttttatagttatatcaatgatattttaaacaaaagaattgaatatagaaaaatttcatttcaattttaattacaatttgctttttgccagattataaacagtactagtttaggcatgctatcttataacatatgtagtgctattttatatgtttcttggttttggacaacaatgcctgttttgaggccactcaaaaaacgagcatgtgactaatgatatttatcacaaaataattacattacaatttgctcattgtcaaactgtaaacagtacttgtttgggcatgttagctcataagatatgtagtattttttcaaatgttatatggttatggacatcattgtcagtttcaagcagtttgaagccgtttcttggttatgtacacatcaacccacgtttgagaccactcaaaacatgagtatgggactaacggtaataattttgagcaaatttgttgcataatatatcgatttatgatgtggatcaacttcgaagcattttgaagccctaaatgttgtattgtttagatacgcagtttttatagatagacccaaccgtatctaacatttgtttcatatgcttcatcatcaacccaagtccaaaacaatctatagcatgagttcgcgcccaatatattggatgtatgaatgctggcactggagtttggacatgcagaacaatgtaactttagaaatgtttagagggcaacatatatattatttagattggaaatttttcagaacttgagatgtttagaaatgtttagtgggcaacatatatagaaaagtttagagggaaccatatatatatttatgatattcgacttttatttccatccatgttttaagtttcttttttactattctattatggttatatcaatgatatttataacaaaagaattaaatcaagaaaaatttcattccaattttaattacaatttgctcattgccagaatataaacaataccgatttaggcgtgctatctagaaaaatatatagtgtttttttttcttggttatggacaacaatgcatgttttgaggtcacttcaaaaacgagtatgagactcatgatatttatcacaaaatgattaagcaaagaaaaattacattacaatttgctcattgccaaactgtaaacaatacatgtttgggattgttatatcattagatatgtagtgttttttcaaatgtttcatggctatgaacatcaatgtaagtttgaagcagttcgaagccctaagtgatgtaatgtttataacggtagtttttacaaaaaggatcgaacatgttttttcacacgctctgttatccacgtaagtcgaagacatatgtagtgttatttgtaatgttccttgtatatgtacacaacaatccaagtttgaggccgctcaaaacatgagtacaagactattgggtattaattttgtgcaattttgcagcataatatatcgatttctgatgtgcatcaacttcgaaacattttaaagccctaaatgttgtattgtttagatagacagtttttacagatagacccaactctatccaacttttgtttcatatacttcatcgtcaacccaagttcaagacaacctatagcatgagtttggggcccaacatattggatgtataaaccatgatagtttagacccattaattcagaaggtatgtagtcgattttgtaatgtttcttgataatggaaacatcaaattatgtttgaagccactcgaaaaattgtatgggagtaaagggtcttgatttcctgcatgctttctccaaaacattgaggcatgaagcacgacaactttaaatcgtttcgaagccccaaatatatatactttttaatcggtagtttttagataattatccaacatgttatttcacatattccaacatcaaccaaagttcaacactatcaatactttagtatgggacccacagaattagatgcatgctgtcattaatgttcagtgatataaagaattaggtaaattgaaaaccatttgaatcacaatactcaaattttttggggtaaactattttgtagagttacgggctatatttaaggaaaaataattacttaaaggaaattaatattccatctttcatgactctattctgattgtcgttctgtaaaccatacttgtttaggcttattatatgaaatgtacgtaataatatttggcatgttcctcacttatgtacacattaacccaagtttgaggccactcaaaaacatgagtatggactaatgggtattaactttgtgtaagtttgctacataatatatcaatttctcatgtgcgtcaactttgaagcattttgaaggcgtaaatgttgtattgtttagatagaaagtttttacatatagaaccaacttgttatttcgcatgctccctcattaacccaacttcaagacaatcattactattctactatagatataccaataatatttatcacaaagaattaaatatagaaaaacttcattccaactttcattacaatttgcacgttgatagactataaaaacactagtttgggcacctcatcttagaaggtatgtagtgttgcttcaaatgttccttgtttatggacatcaatgcaagcttgaggccactcaaaaacgagtatgggactaataatatttatcataaaacaataaaacaaagaaaaattacattacaatttgctcgttgccaaattgtaaacattacttgtttgtgctagttataacataagatatgtattgttttttcaaatgtttcatggttatggacatcaattgaagtttgaagcggtttgaagccctaattgacataatgttttgaattgttgtttttacacaagtatccaacatgttgtttcacacgctccattatcaacgtatgttcaagatccatagtatgtgacttgtagaattgaatggtctagaggaatgaggtaaatttataaacgtataaagccaccatgtagacttttctaga

SEQ ID NO: 231 - DNA, 3087 bp, Zea mays
gttaggtgcagtttagtttagctgatccaaatgaggcccaactatatgaactttgtgacatatggttagcaggttactggggtcttattgggtgagaaacatctttggctggtcaattttttacgtgtgtaaaacctcaatcatgtcacatccactcgtaagaagactcggttgtattcctgttaatagaaatggttgtttcctctctaaaaatatgttgactaacttggtctctatagacaagtttagtgacctcgtgggcaatttactctagcaggccccaaagtcaaacaacaagttacctacttctccataagaatgtagcaatcaataacatgcataagattttgttgacacctagaggagacggttcctacattgttcgactacagtgcacctaattgggcctataaataaaccaacaatacaccttaagggagaaaattaagttgggtatatgatcgcatgtaaatgcgacattaattttcaggcctgctccgacggtgtaaacaagcgaaactatatttttcagacctactaaccacctgacacaaagttaatatagttaggcctcatttggatcagctaaactcgactacatctaactcttgcgttttagtcttttgttgatcttcatttttattagtttcaagatcttcatgcttaacaaaagagaacaaatttcccagcgcatcctcaagaaatagcatactatctttggcatttatcgccaatacatgtcatctaacaatttcaacacctttatttgtgctcccacttgcagctcctcgacattatgcaaaagcttttgagctatttcagtagcccgctttacctgtcagttcttcctcttaatggtcccaccataacattcttccattgtcttaagttgtttctacacataattctttttcgtttgttatgctgaaatttcattgtgcttctatcatcttaggatctagtaagctttctttagtttttaatctcttccctaatctcttctccaattttttgggatccgaattgtcaatacaaatatatgaagtaaagtttagtcccaacaatttggatcaccaaaaaagtgaggaagatattaggtaagagataagaaaactaaagtaagcttccaagatcgtgagattagaggacagtgaaaattcagcacaacaggcaaaaaaagaattttgtgtggaactagcttaagacaatggaagaagattacactgggaccattaagaggaagaaaatagaggtaaagcaggctactgaagccgctaaaaagtttttgcataatgttgatgagttgcaattgggtgcccaaaagaaggatgatgaaattgttagactacaaatagtggtgacaaatgacaaaaagaagatgttgtttcttgaggatgagctacaaaaattgttgtctttggtcaaggataaagatcttgaaactttataaaaataaaatcaaccagagactaaaatgcaagatttagttgctgtccagattaactaatccaaacgaggcctaactatatgaataggtggttagcaggttactaggttcttattgggtgagaaacttttgatgctggtggattttgctatgtgggtaaaccatgaatcatgtcacatccactcttctcaagactaaacacaagagtttggtgcagattagtttaactgtggcctatataaaataatgtggactaacttgttctctatagacaatttttagtgatctcgtgggccaaaagttagacgaaaagttacctacttctccacgagaaagttgcaattaataacatgcatgttggtcaaactgaccacttagacccaattgcatcaagatttggcacacggatgaactgcaaacataaatgaacagtcaggactcacaaaatcaataggcttgtgctattgctctctctctgtcactcaccgagaagacatttacacaactctttatcttgtgagtatcaggagcatcgtcttgctagctttctcctaccagagcaccacactttctcgtagcactagatggcacatcattgatggatccatacatacagcgctagcacccattaaataaatagaagtagacgacgacatgcctagaaactacacctctcgtctcgtctgggccacatgatgcacgcgtcttaccatgagaagcggtcactactgcagctaacagtacgtgtctctccaaacataggctgcactagagtgcgttcttcaactagtggacgcaagactccaactaaatgcaggcatggtctgcatgcacaaggcgccagcccgcatgcctcctccgttgctccatgcatatggggcgtgtcctttggctctgcgatccacctgaaccgctccactttttcatgtactcatcgttaaactccagcaggtttcatataaactgatgcatagtagtagtatatggcatggcactccggtcgaaatccaggactaatggtcggatgtgctgcactcatgttaggtaggcttcacacatcagtcgtgcttacttgttcgtggagctagcttgctagcctttccctttctggtgttcttgcacctagctacagcagatcacgagagctttcaagcccgttgtacgtgctagaggcaaaaggctctccctagccccatctaaaaaaggctgcagcaggaaatgacttttgatcgagccgctactgctggtgcttcctctcttaggctctctattgatccatatccatgtttggtactagtacagcgcagtcgtcagcaccacacacaacactgtttggtcctagtgcaatgatggcaccttgatcgtcttttacgtctccgtcaaaaatgaactaataataatattcaagaaaaacaaactttatatacggtcggtcgtacttacttaaagctaaaagttaatgtaataaataaagcaacaaattcaaaaaagggattaagttatttgagtatttagtttgtgaataagttggtccccatcaagtcggccttgatcttgttatcaatgacgactgtctaaacgataatggactccaacgtggtcgagtatgtcattttatttcacggaatttattaggggac

SEQ ID NO: 232 - DNA, 3085 bp, Zea mays
aagttttgtacttactctccaaaagatggatgaatatatttaacaccccaggtaccgtgtgctcaacaacgagtatggatttaagcacgtaatatgagtggacaaaacggatgctaaattttaatcatcttcgtctatcgcgatttttatatcgcatctgtttgtctgtcgcgagttcgacatcgtttttatttttatctatccgggctcttccaaaattttcgtgatgttcggaacatagttgttccgaaaatcgatgcgttcggtgattatttaaggttcatcgctcgcgcgaatacgaatttggaaattcagtccagtcctccgatttcctctcaaacaaattaatagaagccgacgactaagtttttagggtaaaataatttagtccccttttgtcatccgcgacgtgtctacggatttttaattgaattgttctgtagtcgagtgtttgattagcgaacggaattcgtctaaagtcaactaaatcaaacgtcgactaaattatcgaatccgatctcgtctggtttaatccgtctacatcttgctcccgtgacgatgttgacatcgtctccgaggggattccgactgcgatgccacattcggctcgtacagtttaaaatttatttatttctaaagtgtcgagcctagtgtcaatttaaaattaatcgattaagacgaactgaaattgtcatctaggtatttcactcggttcgaacaatttctataaattcgataaatgcactacttggggcaggctgtttaaataaaccgaaaccggaacaattgctagccaattcggttttctatttcaaaatccgagaaaataatatacgtagttgtatagtgcgtcgaccttttaatcatcgctaaaaattccgattcaaaaatatctgtaattttcggtaaaaaagaaagaaattaaaaaaggagaaaatatctctctcctgtccttatccttgtcgctgttcagctgatggagatttccccacgtcatcccttccatctctcatttccagccacctagcccgcccggttcttattttatgcctgtgttcaaccaacatcaggaattatctctccgccgcttagtctctccttcctatctcctcacgccaccaatccaggcacaggtctacatcttcagctataccacgtcggctccctgggaaaattccagtctgagcacgtcacttgctcacccttcctcacgacactccttttcttcctcgcccgtgcattccagcccgccatggcgctcgtcactgcgtcagctctgcaatcgcgcctaggccaagacttcctggtgtatcttcttcctcacacagtcaacggcctccagctcgtctcgccaccacgccaactgtatcgtcttcaaccccgagtcctcaacatcactgtcccacgccggtcgtctgccacgccatgagctcgccggctgaccgccgttcgttgctcggcgcccacatcaggacttcgctgcacccttaggactccgaccccaatcccaagcgctgtctagtggccaccaggctatgagccgggccaccccctgcgctggacttccacccctgcgccatggccgaccgtctgggtactcgaccccgccagcaagcgtccatggccacgtccgctcgcgcctctccatgccgcgcgctcgccgggctgtgcgtcgctaggacccgaagcgccgtccttcgtttggacagcaacgacgtgcgcaaaagccttgttgctgctgttggaggcttctcgacaaaatatctagcaaagagttgaagctccagtgcaccgccgtcggggttcgactggccacttgtgcgagctgctatcgaacttggccggccatggcgctcacatcccagccgttctcctgctcctcgcatcgtgattgccgagttcaccggcaaccacagtcacgtcgtgccgcgccgcgagctcgctccccgctatcgtcgtttcccgtgcccgctggccgtgcgtccctgcagctccctgttcggcaaaatgagtggaccggtgctcgtcgcgtgttgggaagatcgacaccgatgttcttgccggatattgattgtttgattttggggagaacaacgcacacatggtgttcaatgaatggttcaaaccggatagcctcgtcgaaatcatggctccgagtcgattcggatatggtaagttgatccatttatttcccgttagtataaggaatggttggattggataaatatagtagtcgtgatgattatctcgttgtgagcttatgtgccatagttatatttgtcgtaagatgaaatgtcttagcgtgcatagtggtatgattagtgtttgtggcagtggttcgattattcattggtgtagactcttggtagtgatttgcgagtttagttggagtaagctgacgaagaaccaaattagtgcgatatttaacgtgtgatcgacgaaaagcccgaattagtaatcaatgtagtgaatctgagctaaatttattattggcgcgcaagttgttagccgaattgttagatagattaaataattatgtgtgatgcgaaataaaattaaattagttcttggtaagcaaagtggtatagtataatttataaagcgagggataaatttagcatttaattaattagctgatgagttgtgtttaggctaattatgtttaatgggtatggtttgttgttcgtgatgtttgcgataggttcgtttaatttagagaagcgtgattattgcgcttagtcatacatcggtaactagtgtttccgtataaaattgtacaatgcctcgccactaggtgtttaatgcgctatcgtatagcactatttagatttgtgctattcctgtttatatgcattcatgtgcataatgcatttcattcaggtacgtgaatataattaaccacgtaatgcggagaaccagagccaagttgaccccaaaatgacataacgggtggactaattcgcaaggtgatgcggatggacgaaactgaagatggacagacgaaacaagtattagaacaaaagatggtcgtcaagcggacgtcatctaacaaacagtaacatagtgtttattccaggcaagcccc

SEQ ID NO: 233 - DNA, 2851 bp, Zea mays
tcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccagtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctaccagcacagacgtcggattcacctttatgttgataagaaataaaagaaaatgccaataggatatcggcattttcttttgcgtttttatttgttaactgttaattgtccttgttcaaggatgctgtctttgacaacagatgttttcttgcctttgatgttcagcaggaaacttggcgcaaacgttgattgtttgtctgcgtagaatcctctgtttgtcatatagcttgtaatcacgacattgtttcctttcgcttgaggtacagcgaagtgtgagtaagtaaaggttacatcgttaggatcaagatccatttttaacacaaggccagttttgttcagcggcttgtatgggccagttaaagaattagaaacataaccaagcatgtaaatatcgttagacgtaatgccgtcaatcgtcatttttgatccgcgggagtcagtgaacaggtaccatttgccgttcattttaaagacgttcgcgcgttcaatttcatctgttactgtgttagatgcaatcagcggtttcatcacttttttcagtgtgtaatcatcgtttagctcaatcataccgagagcgccgtttgctaactcagccgtgcgttttttatcgctttgcagaagtttttgactttcttgacggaagaatgatgtgcttttgccatagtatgctttgttaaataaagattcttcgccttggtagccatcttcagttccagtgtttgcttcaaatactaagtatttgtggcctttatcttctacgtagtgaggatctctcagcgtatggttgtcgcctgagctgtagttgccttcatcgatgaactgctgtacattttgatacgtttttccgtcaccgtcaaagattgatttataatcctctacaccgttgatgttcaaagagctgtctgatgctgatacgttaacttgtgcagttgtcagtgtttgtttgccgtaatgtttaccggagaaatcagtgtagaataaacggatttttccgtcagatgtaaatgtggctgaacctgaccattcttgtgtttggtcttttaggatagaatcatttgcatcgaatttgtcgctgtctttaaagacgcggccagcgtttttccagctgtcaatagaagtttcgccgactttttgatagaacatgtaaatcgatgtgtcatccgcatttttaggatctccggctaatgcaaagacgatgtggtagccgtgatagtttgcgacagtgccgtcagcgttttgtaatggccagctgtcccaaacgtccaggccttttgcagaagagatatttttaattgtggacgaatcgaactcaggaacttgatatttttcatttttttgctgttcagggatttgcagcatatcatggcgtgtaatatgggaaatgccgtatgtttccttatatggcttttggttcgtttctttcgcaaacgcttgagttgcgcctcctgccagcagtgcggtagtaaaggttaatactgttgcttgttttgcaaactttttgatgttcatcgttcatgtctccttttttatgtactgtgttagcggtctgcttcttccagccctcctgtttgaagatggcaagttagttacgcacaataaaaaaagacctaaaatatgtaaggggtgacgccaaagtatacactttgccctttacacattttaggtcttgcctgctttatcagtaacaaacccgcgcgatttacttttcgacctcattctattagactctcgtttggattgcaactggtctattttcctcttttgtttgatagaaaatcataaaaggatttgcagactacgggcctaaagaactaaaaaatctatctgtttcttttcattctctgtattttttatagtttctgttgcatgggcataaagttgcctttttaatcacaattcagaaaatatcataatatctcatttcactaaataatagtgaacggcaggtatatgtgatgggttaaaatgcatccaccacagtgggatccgaagcttggaattcacaagtatcttttggggcgtgtctctagaccatagccgactctaatcgaaaggagctcg

SEQ ID NO: 234 - DNA, 3079 bp, Zea mays
  misc_feature (1231)..(1232): n is a, c, g, or t
cttcttcatgctggtatcttgatttgagcatttgatccaagtgtgaaattcacaacaaattttgaattaaaatttgagatttaaaaataaaacagaaaaggaaaagcaaaacctaaaacgccgcatcggtcgtttcccactggccgacccactccacccgaatcgcgtggcgcactacatccacgcgcgcctcgacgccggcgacctaggcccactcctcagcctcagctgcgtcagagcacaggaggagctctcgcctgggtcgatgtgtggtggtccccgctggtcagcccgcacgcgcacgcgtgtgttgatcccggacgctgacgtgtagggccagctcatcagccctatcctctcgcgccggcgcaacagaacgcgaaaccgtcgttgaacgtggaggcgctccgagatcctagccacggccggggcataagtaaagtaccgacacatgcatcctcgcccctgttgagccagccatcccttcctgtgaccgagaaagaagtctgccgtccaccgccggtgccccatgcctgcctacaccgttcattggtggccaaggttgggtggtgggcgttcggcagcgtgcgtggttcgtgtgtgtgaagtatcaagctcgcggatcagcccgagcacctctcgcccccgccgtacctccgctccacatcgtggaccgaccccgacgtgtgacacgtctctttcgcgcttgtgagtccttgacgcgtagagcgagtcatccatagggttcggcttcggcctgatcggcgtcatgcacgtcgctcatcggcgagctctgccacgcggactgctcgcgcttccgtgttcgatacgagaggtaggtgatggaaccagcgccgtaggaaaagtgatgaacgactgagatcatgcggcgcgtagcatttcgtcgtattaaaatgtgaccgctggatgccaatccgatggcctcggttggatcggggcagggatgtctcggggccatcggaattttaatccaaaacaatggctgcacccgcgtaacgattcatgacccacgtccatctaatctgggccgtagaaactaatcggacggctgttgttatgtagtatgttttcatgtttagtgatttctcctgtaccgtgtttgtttgtattgttgctcattttactcatgtacttgaggatgtcgtcatttattttattttgtcagtggtcattgtgtcgactaggataagtaacaaataggtaggtcgannaaaaagatcctatcaatgcttatgtgatgttatgtgtatatgtgtgcaattatggtggagagaaagatcctagggtttgattggaaaggaaagttgtagcacatcgtccaccaagtgtttgatgaaatgcatgaatcaatgcttattctggttattgtaaagttttgggtcggataaactcttggtgtgctgattccttactcttggtgtgcagcttgttggaaatctaataaacaaatcaatgagtctatcggtgtcttagaggaaacaaatcgtcgcaaactgctagcgcgacacactaggtgcatgttcgttagatgcatatagctatagtgtacagtgtactagtgcttgtattatatatgtgtatttttttttaatctcacagattcatgattgaccgttgattattctacatagggttcaaaagtcaaaaaatttgtcctaaactcttaccttacatcagcaccaagtgattaaaaagctacaataagaggatgttgagtgttgccattcattttcttttggcactggtagttctgtcgactaggattactaaatgacaggtaggtcgacaacatcaatgtagtcaatactctggtttgtaccattctcacaaaaaaaaggcatcggtgcctcacaataaaaccccaatagcactgctagcactagcagaggccactcctttgtgcaatatttgtctaaaccacatgttttgtatccattatcaacttagattaggaagcatcgtgaagtatcgctgcttctgcatgcagtttgtagcggcggggtcaccgacttgattagctggacgactaacataatcaactatttatgctattattgttatttagcaggtcgtaaacattgtagcacaatgtcgttatgctgcacacgaaaagagtggatggaataatgtaactttcgaaattcatggacaaatacgttgaaaatcacacttctcattttagaacctatctgtagtgtaatagctcgttaagagaaaacgtaccacacaggaaattggtgttttaaagtactaaaggtataagtttgtttttcattatagaatataagtttgtttttctccatacatctctatcccagattattcatgtttggtattgagatatgtatggggaaaatataaatttatgggtgaaattaaaattgcagtaggagtgtactagtgtagggccctggcactgacgacataaggtcaggcgccataaccacatttcttcagcaaaatgaatgtatcactcctccagtcaagggtctgtctgtctgtctttgagcaccttctcgaggtgtataaatacaatggaaagggtgaactcattctactatacttctgctgctctacaccaccaatgtgctgctggctttctgctgacacctttaatcaccaccaataatgtgctgttggctccttttgcactgtaccttttcatcagtttgggcatgagaagtgttgagacatgtagagcttaacatgacaaatatgatgctgtcaaggtagatcctaactctacttaggtctggagtagtgccaatggtgaccggaatagtactaccggaagtactctaacgctatttatagctaatgttatacgctcattattactatagggtacactagagaagactaattaatgtctagtctgccatgcaagaagtacaaattcgtgcttataaaactgaaacgatggatcacatctcgccggcatttggcaaacagaaacaaaacctgatgaaacatatgtaaactacaacaaaaagagtgaaagatctagatgcaaacatttgtgctatagaagcaagaacgtgaatatgttttatgaatt

SEQ ID NO: 235 - DNA, 3078 bp, Zea mays
gtcccctaataaattccgtgaaataaaatgacatactcgaccacgttggagtccattatcgtttagacagtcgtcattgataacaatatcaaggccgacttgatggggaccaactgattcacgaactaaatactcaaataatgtaatccattttttgaatttgttgctttatttattacattaactattagctttaagtaagtacgaccgaccgtatataaagtttggtttcttgaatattattattagttcatttttgatggagacatagaaagatgatcaaggtgccatcattgcactaggaccgaacagtgttgtgtgtggtgccgacgaccgcgccgtactagtaccaaacatggatatggatcaatagagagcctaagagatgaagcaccagcagtagcggctcgatcaatagtcatttcctgctgcagccttttttagatggagctagggagagcctctggcctctagcacgtacaacgggcttgaatgctctcgtgatcttctgtagctaggtgcaagaacaccagaaagggaaaagctagcaagctagctccacgaacaagcaagcacgactgatgtgtgaagcctacctaacatgtgtgcatcacatcagaccatcagtcctagattttgaccggagtgccatgccatatactagtactatgcatgagtttatatgaaacctgctggagtttaacgattagtacatgaaaaagtggagcggttcaggtggatcgcagagacaaaggacgcaccccatatgcatggagcaacggaggaggcgtgcgggctggcgccttgtgcatgcagaccatgcctgcatttagtgcgagtcttgcgtccactagttgaagaacgcgctctagtgcggcctatgtttggagagacacgtacggttggcctgcagtagtgatcgcttttcatggtaagatgcgtgcatcatgtggcccaaacgagacaagaggtgtagtttctaggcatgtcgtcgtctacttctatttatttaatgggtgctagtgttgtatgtagggatccatcaatgatgtgccatctagtgctatgagaaagtgtggtgctctggtaggagaaagctagcaagacgatgctcctgatactcacaagatagagagttgtgtacatgtcttctcaatgagtgagagagagagagagagagcaatagcacaagcctattgattttgtgagtcctgactgttcatttatgtatgcagttcgtccatgtgccaaatcttgctgcaattgggtctgagtggtcagtttgaccaacatgcatgttattaattgcaactttctcgtgcagaagtaggtaacatttcgtctaacttttggcccacgaattcactaaaaaattgtctatagagaacaagttagtccacattattttatataggccacagttaaactaatctacacctaactcttgtgtttagtcttgagaagagtggatgtgacatgatttagggtttacccacatagcaaaatccaccggcatcaaaagtttctcacccaataagaacctagtaacctactaaccacctattcatatagttaggcctcgtttggattagttaatctagacagcaactaaatcttgcatcttagtctctggttgattttatttttataaagtttcaagatctttatccttgaccaaagacaacaatttttgcagctcatcctcaagaaacaacatcctctttttggcatttgtcgccactatttgtattctaacaatttcatcatccttcttttgggcacccaattgcaactcatcaacattatgcaaaaacattttagcggcttcagtagcctgctttacctctattttcttcctcttaatggtcccagtgtaatcttcttccattgtcttaagttggttccacacaaaattcttttttgcctgttgtgctgaattttcactgtcctctaatctcatgatcttggaagcttactttagttttcttatctcttacctaatatcttcctcactttttggttatccaaattgttgggactaaactttacttcatatattagtattgacaattcggatcccaaaaaattggagaagagattagggaagagattaaaatttaaagaaagcttactagatcctaagatgagagaagcacaatgaaatttcagcataacaaacgaaaaagaattatgtgtggaaacagcttaagacaatggaagaattttacggtgggaccattaagaggaagaacttacatgtaaagcgggctactgaagcagctcaaaagcttttgcataagttgaggagctgcaagtgggagcacaaataaaggtgttgaaattgttagatgacatgtagtggcgataaatgccaaagatagtatgctatttcttgaggatgcgttgggaaatttgttctcttttgttaagcatgaagatcttgaaactaataaaaatgaagatcaacaaaagactaaaccgcaagagttagttgtagtcgagtttagctgatccaaatgaggcctaactatgtcaactttgtgtcaggtggttagcaggtctaaaaaatatagtttcgcttgtttacaccgtcggagcaggcctgaaaattaatgtcgcatttacatgcgatcatatacccaacttaattttctcccttaaggtgtattgttggtttatttataggcccaattaggtgcactggagtcgaacaatgtaggaaccgtctcctctaggtgtcaacaaaatcttatgcatgcttttctactgcaaatttggtctcgtgggttacgaactgtcacgcgctcttgctgcaattaggtcttagttgtcagtttgacaaacatggatgttattgattgctacattcttatggagaagtaggtaacttgttgtttgacttttggggcctgctagagtaaattgcctaagaggtcactaaacttgtcaatagagaccaagttagtcaacatatttttagagaggaaacaaccatttctattaacaggaatacaaccgagtcttcttacgagtggatgtgacatgattgaggttttacacacgtatgttcattgctca

SEQ ID NO: 236 - DNA, 3073 bp, Zea mays
tgagcaatgaacatacgtgtgtaaaacctcaatcatgtcacatccactcgtaagaagactcggttgtattcctgttaatagaaatggttgtttcctctctaaaaatatgttgactaacttggtctctattgacaagtttagtgacctcttaggcaatttactctagcaggccccaaaagtcaaacaacaagttacctacttctccataagaatgtagcaatcaataacatccatgtttgtcaaactgacaactaagacctaattgcagcaagagcgcgtgacagttcgtaacccacgagaccaaatttgcagtagaaaagcatgcataagattttgttgacacctagaggagacggttcctacattgttcgactccagtgcacctaattgggcctataaataaaccaacaatacaccttaagggagaaaattaagttgggtatatgatcgcatgtaaatgcgacattaattttcaggcctgctccgacggtgtaaacaagcgaaactatattttttagacctgctaaccacctgacacaaagttgacatagttaggcctcatttggatcagctaaactcgactacaactaactcttgcggtttagtcttttgttgatcttcatttttattagtttcaagatcttcatgcttaacaaaagagaacaaatttcccaacgcatcctcaagaaatagcatactatctttggcatttatcgccactacatgtcatctaacaatttcaacacctttatttgtgctcccacttgcagctcctcaacttatgcaaaagcttttgagctgcttcagtagcccgctttacatgtaagttcttcctcttaatggtcccaccgtaaaattcttccattgtcttaagctgtttccacacataattctttttcgtttgttatgctgaaatttcattttgcttctctcatcttaggatctagtaagctttctttagtttttaatctcttccctaatctcttctccaattttttgggatccgaattgtcaatactaatatatgaaataaagtttagtgccaacaattcggatcaccaaaaaagtgaggaagatattaggtaagagataagaaaactaaagtaagcttccaagatcatgagattagaggacaatgaaaattcagcacaacaggcaaaaaagaattttgtgtggaactagcttaagacaatggaagaagattacactgggaccattaagaggaagaaaatagaggtaaagcaggctactaaagccgctaatttttttttgcataatgttgatgagttgcaattgggtgcccaaaagaaggatgatgaaattgttagactacaaatagtggcgacaaatgccaaaaagaggatgttgtttcttgaggatgagctgcaaaaattgttgcctttggtcaaggataaagatcttgaaactttataaaaataaaatcaaccagagactaaaatgcaagatttagttgctattcaggttaactaatccaaacgaggcctaactatatgaataggtggttagcaggttaccaggttcttattgggtgagaaacttttgatgccggtggattttgctatgtgggtaaaccctaaataatgtcacatccactcttctcaagactaaacacaagagttaggtgcagattagtttaactgtggcctatataaaataatgtggactaacttgttctctatagacaattttctagtgatctcgtgggccaaaagttagacgaaaagttacctacttctccacgagaaagttgcaactaataacatgcatgttcgtcaaactgaccactcagacccaattgcagcaagatttggcacacggacgaactgcaaacataatgaacagtcaggactcacaaaatcaataggattgtgctattgctctctctctctcactcaccgagaagtcatgtacacaactctctatcttgtgagtatcaggagcatcgtcttgctagctttctcctaccagagcaccacactttctcatagcactagatggcacatcattgatggatccctaaatacagcgctagcacccattaaataaatagaagtagaagacaacatgcctagaaactacacccctcgtctcgtctggggcacatgatgcacgcgtcttaccatgagaagcggtcactactgcaggccaaccatacgtgtctctccaaacataggccgcactagagcgtgttcttcaactagtggacgcaagactcgcactaaatacaggcatggtctgcatggacaaggcgccagcccgcacgcctcctccgttgctccatgcatatggggcgcgtcctttggctctgcgatccacctgaaccgctccactttttcatgtactcatcattaaactccagcaggtttcatatgaactcatgcatagtactagtatatggaatggcactccggtcgaaatccaggactgatggtctgatgtgctgcacgcatgttaggtaggcttcacacatcagtcgtgcttgcttgtccgtggagctaacttgctagcctttccctttctggtgttcttgcacctagctacaacagatcacgagagcttgcaagcccgttgtacgtgctagaggccataggctctccctagctccatctgaaaaaggctgcagcaggaaatgacttttgatcgagccgctactaatggtgcttcatctctaaggctctctattgatccatatccatgtttggtactagtatggcgcggtcgtcagcaccacatacaacactgttcggtcctagtgcaatgatggcaccttgatcgtctttctacgtctccgtcaaaaatgaactaataataatatgcaagaaaaacaaactttatatatggtcggttgtacttacttaaagctaatagttaatgtaataaataaagcaacaaattcaaaaaagggattacattatttgagtatttagttcgtgaataagttggtccccatcaagtcggccttgaacttgttatcaatgacgattgtctaaacgataatggacgccaacatggtcgagtatgtcattttatttcacggaatttattaggggac

SEQ ID NO: 237 - DNA, 3073 bp, Zea mays
actgctggaattagatatcagagtgcttgctcaaaaaaacgaagtcctgcgtgcgtgcatgaaggtagaaggtgatattttggtcgcgttcaatagttggcacaagtcaatgtcttctttgggttatacatagggacatacagaaaaatgatctaaatggtacgtaacagcactgtctaaattaaaggacgtaaccccaagccagcaaatttggaatgaagcaaaatccagcaatgattatgtaccatattgtgtgtgtgtgtgagagagagagtttggctctatgtatgactctctaatgacaagcaaccttcgtgtttttatagaaaacgatatgccatacaagtgcatccaacagaagacaactgttacaattcagttcagaacttcagatataacaaatcactgcacgatcagtagcgaaacatgacagctcaggttaacaccacctaacagcgacacacagaggcaagcatgcaaaatgaaaactgagctcgaacgcggccgcatgcatgcatacagaagatcactggaacacgtttcttcaatgcctgcctcgggatttcgccctgctggcctcctctggggtcgacgggaacagctccacgtacctcgtcccaatggtcatcttatccttgcacatggccgtcttcgcgacttcagctgtcggaaactcaacgaaggcttcacccgtggccttcccatcggagcggtaggcgatatgcacgttctcctctgccagctcgtactccaggaagaacttgatgatgtcctcagtggtggcagagtagggaagcccgcggagcttcagaacctctgtgtactccatgctgcccttatcttcagacggcttcctaggcctcggaggaggcggggagcggcggtactccggctcgaaataaccgccctggttcacctcattggctattgcacagtagtactcgtgcttcttgcacctgaacacctcgacatacctccgccccatgttctgcctgtcgcggtgcagcgcaaactctgcctgcatggctgttgggaagactacaaaagcctcgccggtgaagcgcccgttcttgttaaccaggaggcagtccactatgtccagccccacaaagaacttgcagacgtcaatgtcgttgcaatcaaaggggaggcctcgcagccggacacatgggaagctttggataccggtgctagaccctgcaccagctaggttgctgttaaagggctggtagaagccgccgccggcaccgctggcgctgcttcccatagccccaaaatagggagcacctggttccatcatcctggccctctttgagacatccagtgggctccctgcgttcactgcgaagtagggattcgattccatcatcattcgcgtcctctttgatccctcgtacccatccgaacccccccagcctcccatcattgcccttcagataatccagagtcccaaaaaagagaaaaaagaaaggagaacaacccccatctctcaatcccaatttcaaataataacctgaatgtaaatataactgcggaggaaagaaataataataggattgacagaaaggatactaaacaagcaaagcgcagtgaaatttgtgccccaataaagttactgttggcaacatataagtaaaggcaattttttatcaatgactggggagttttctctgagcacttaagttcatgtttcagtgcatcagaatatcaatgctgactctgtagctaaaatttcctaggataatatatttgttcgttgggaatgtatcgtgtgttcacatagtctctacgatcatatgaacacttaaaatctggtgtgtctataagcaatccaacggcgatcgataacttttatttaccccctcgtatcttagctttgatgacaattgtccatttatcacctctcaatctctcaccttaacgttggattgctcataaacgcaccagatttaaaatgcaaatatgagcacgaaggtttcatgagcataaaatatgtccccttgttcgttttacatgattacatcagttcaccatacagcggttctaaaggggaacccaacagagatttgtcactggatgaagagcaagacaaagaaaaatgtcaaagctgtgtatgcaatgtgtgacagtagagtagactggatgcaagtattaatcgaggaccacatgctgtgtggtaacagagtagaatgaatggcagtattatgtcatcaattgtctataataatatttttcgatacgaataaaatcctgccaactaatcaaccggtacacaataaatctacccagcacagaatcgtgctggggtgtttcggtgcccggtaatttcccatgagcactcttatcttataggacgaatcgcatagagcggcagatcgttggagcaccacaccaccaggggcggataccgctgtggattcccagtttcccacccaccacgcgaaagacaaacctaacgaacgaagcttcgacgagccggatggactgtttcgggtcccggagaaaaaggttggtactagggttcagggtcagggggaaggaagattctacggcggaattgaagggggaagagagaggtgcaggtgcagccgaagcgtacctgtatctggacggagacgtgttcatctgagtgggtcggcgaccggcgcggtggcggaggcggggggcgagttccccgttgcggtcaggagagagttggcgtcggcctcaggcggctagggttactagggcactcggacgggagaggacgatgaggacccttttgggaaggaaacgggaaggccgcgactcggactcgcgggcttgatgggccttcagccaatcccgaggtgggctgtgcaggcctcgacggcttcttgaaggccgaggatcaggagaagttactgtgcaaacgacagcagtgaacaggcccaacaaaacctattcctcttgttgtatcagtattactcgcggttagacacgctttgtattcctattcacttggttctaaactataactataagtttttttagcttatgtatacataaatatactgtttttactatatatccaaacacatgtgtatcttagtgc

SEQ ID NO: 238 - DNA, 3072 bp, Zea mays
gtcggtccaccgcacctccacgacatgcggccgatgcagctccaccccttgcccaagttgtggccctagatgtaacaaacccctcaccggagcctgcgctttcctcggtgcgctcgatcgccccactccgtggctcagattgctcaccagagtacccccgacccaccaggttcttgtccactacggcgaattagagcttgctggtgccgctgtgcatcagttctccgcacctccacggcgtccgaccgatgcagctccacccattgcccaagttgtggccctagatgtcccaatccccttaccggagcccgtgttgtccacggtgcgctcgatcgccccactcggtggcttgggttgcttgccagagtacccccgatccacccggttcttctcctctacggcaaattagagcttgctggtgccactgcgcgtcggtccgccgcacctccacggcgtgcggtcgatgcagctccaccccatgcccaagttgtggccctagatgtcccaaacccctcaccggagcccgtgctgtcctcggtgcgctcgatctccccactccatggctgggattgctctgtagagtacccccgacccgcccgattcttgtctactgcggcgaattagagcttgccggtgccgctacacgtcggtccgccacacctccatggcgtttggccgatgcagctccaccccttgcccaagttgtggccctagatgtcccaaacccctcaccgaaacctgccctgtccactgtgcgctcgatcgccccactctatggttgtgattgatcgccagagtacccccgacccgcccggttcatctcctctacggcgaattagagcttgtcagtgccgctgcgcgttggtccgccgcacctccatgacgtctggccaatgcagctccaccccttgcccaagttgtggccctagatgtcccaaaccccccactggagccttcactttccttggtgcactcgatcgccccacttcgtggctaggattgctcgccattgtacccctgacccgccggttctttttctctgcgacgaattagagcttgcaagtgtcgctgcacgttggtccgcagcacatccacgatgtccgaccgatgcagctccacccctttcccaagttgtggccctagatgtccaaacccctcactggagcctgcgatatcctcggtgcgcccgatcaccccacctcgtggctagattgctcgccagagtacccctgacctgcccggttcttctcctctgcggcaaaataaagcttgctagtgccgctgcgtgtcggtctgccgcacctacacggcgtccgactaatgcagctccaccccttgcccaagttgtggccctagatgtcccaaacccctcaccaaagctcccattgtccttggtgctcttgatcacctcaccaatggctgggatttatcactagagtatccccgacccgcccggttcttctcctctgcggcgaattagagcttactagtgccgatgctcgtcggtccgcctcacctccatggcgtgcggccgatgcagctccacccgttgcccaagttgtggccctaaatgtcccaaacccctcactggagctcgtgttgtccttggtgcgctcaatcgccccactccatggctgggattgctcgccagagtaccctcgacccacacggttcttctcctcaacggcgaattagagcttgccggtgccgctgcgtgtcggtttgccgcacctccacgacgtccgaccgatgcagctccaccccttgcccaagtcatggctctagatgtcccaaacccctcaccggagcccgcactgtcctctgtgcgctcgatcgccccactatgtggctgggattgctcgccagcgtacccccgacccgcccggttcttctcctctacggcacattatatcttgacggtgccacttcgcgtcggtccaccgcacctccacggcgtcccgccgatgcagctccaccccttgcccaagttgaggccctagatgtcccaaacccctaaccagagcccgcgctatcctcggtgcgctcaatcgccccactcagtggctaggtttgcttgctagagtacccccgacccgcccggttcttctcctctgcgatgaattagagcttgccggtgccgctgcacgtcggtccgtagcacctccatggcgtccagccgatgcagctccatcccttgcccaagttgaggccctagatgtcccaaacccgtcaccgaagctcgagttggcctcgctgcgctcgatcgccccactccatggatgggattgctcgctagagtactcccgacccgcccggttattctcctctgtggcgaattagagcttgtcggtgcctcttcgggtcggtccgccgcacctccacggcgtccggccgatgcagctccaccccttgcccaagttgtggccctagatgtcccaaacccctcatcggtgcccgcgctttcctcggtgcgctcgatcgccccacttcgtggctaggattgctcgccattgtacccgcgacccatcggttcttctcctctacggcgaattagagcttgccagtgtcgctgcacgtcggtccacaacacatccacggcatccggccgatgtagctccaccccttgcccatgttgtggccctagatgtcccaaacccctcactggagcccgcgatatcctcggtgcgctcgatcaccccactctgtggctagattgctcgcaagagtacccccaacccgcccggttcttctcctctgcggcgaattagagcttgctggtgccactgcgcgtcggtctgccgcacctacatggtgttcgaccgatgcagctccaccccttgcccaagttgtggccctagatgccccaaacccctcaccgaagctcccactgtcctcggtgcgcttgatcgccccactccatggctgggatttatcactagagtatccccgacccgcccggttcttctcctctgcggtgaattagagcttactagtgccgctgcgtgtctgtccgccgcacctccacggcgtgcggctgatgcagctccaccccttgcccaagttgtggcccta

SEQ ID NO: 239 - DNA, 3071 bp, Zea mays
ttatggactactagtccacaatcctctatgggcattgtaacagagtgaggttggtgaatgacaaatgtttgccttgtggagaaatcatacttaagaatttcgactctacgacatcacagatatagttaatgagtgggacatgttaagagaaaagaatttgatgtaatcgatattacgacatcacagatatagttaacgggcgagacatgtccttttgaggattttcaaaggtttctttactagtggacgtactcaagctagaacattgctcctcggcaccaccaacaatcttaatttcctctaagggtacttcttcaatattagggaactgggaataataagaatggagcatgtggtgaatttcctcccttcttcctaatcgttcatcttccatatccatgtcaactaaatcctgcaaaatcacaaggcaacaataaatgccatacgagaagagagatactcactctcatgacaaactctagccatcaattattattctatgctctagtaaacctagtcacatctccacattatcgttttggaaaggaacatttcacattatattaaggaactaatattacctgtgttggaatagtcttgaataacagaagactccttttatagtaaaggtgaaatgaaagagtacagatgataagaggtatggtcaagcatacagccactcgcgattctttaatttcaaatacaccagcacagatgatctgggtgagcacgagagagaatatgattgtgttgtgtgcaattggccaatacaatcctcctgtatcagaccttgttcgataaacattgagaaactgaaaaagaacacatggtacattagcatgaatggacaaatttcagggtaagtaagaaaataaaatatagtatctaggttctcacttgattgcggtatacaacacgaccaaggtaaaagtatactagcaggaaaggtaaaatcataggagccaccacagagcatgtgaagcccaatagtccaaacaatagaacttttggcacttcctgctgataggggaatgtgggaacagattctgtatcttctctatattctccctttctcaaaatatatttccttataaagctcattatcagattatagaactgcaaaagttcggatgataaactagcccatcccgaggtcataacataggtgatgaagaaagtagcctgcaataaaaaataaaatcacagaaaagaaacagaaatgttagatgaaaattaaatacacaaaaccaacatattatctttccataaagaaaagggaaggtgtgctaaagctgtctagttaaagctctagcaaccttgacaggaatgtcttttgggcttaatatcaaattcaattgactcatgaatgtactagatagtacattaacaaagaatatgttccaatctatgaagcacaacagtttaaagcaagcactcatcttccttgcactgtaagatgtggcaccttccaatttagaaactttcatcatcaatgtcccaacaatatacagaataatttgttggatcacactaggaaggtatcctgcaaataggctgagtaatatatattcaatagatgcaacatggagacatgtcaaatggatagtatatatatttgtagtgacataagaacacacatctatggagatagcccaactgaggtttcagtacttacttctccaacctttctttcaaggaagcaggaatcaaatgttgcagctgctctgggttagatagttcttgtatacacaccatcagcatcaaaagtaagaatgcaaaaataatacagcctggaattagtgttgctttactccacttgttggattgccaaagattggacaaatacaagtcttctggttctggagccagactagtaacccatttcattgggttagatgcctgcaccatatttgatgcagtaactgcgtcatagcgagttttgaaaaatacaaaagtagttgtgcattcctgctgcatataattccatatagaaattactaatttaatccatattattactgctaaattaagcaattaacaaatgcatgcatgcaagaattttaacctcgcgatctaagttcagggtggattcttcattgttagggttccccttgttttgcttgcattcggagttgaacttggaagaatttggagagggtggtcccgcgaaacaacaactgttggtggttgtcgtcctatatccctgactactgatttcagctacgaaatatttgaagttcttatgtgtcttctatgtgctagtctatgagttaagttaaagacacaaaaaccaagaggtgaattacaaacacgaataaggaaagaaaaaccattcaacactgaaggaactggtcatttgttcacttgttcatgtcaaaaagacaaaaaaaattatgagaaacctagctaattataagatgaagaagttttatttatacttcccttacccttagaatatataatagtaaatgttcttcgttagtaaaagagaaatgcatgcattgagtactagctagataccattatcttgtggacaagcccaactttgtagacaatttgatggaagagataactagacaaatgatactttgtgaaaaaatttccaacagcatcactatatgattctttagttgtctttggtatttcatgaacaaggagtgcaaattggcttggatttggcgttgcccttttgagatgaaaggacgtcaacgaggcaatgtgcttcacctcctgcattgaagggaaaaaacatattagcaaaaaacgttccaactacaaggagatggagcctttcagcaattcaaatgcgaaacaaatttacaatgtacagaattaagcatgttattccagaaattatgtacatcaccgcacaatggatcaagaggttgcatgcaaggaatcatcaaaacatgcactttgctatattctacactgctcattcttcttcaacttctaaagaagtgaatgaagaagcatggtggatgaattaatcaaggtagaaaacacttgtaagatgtcgataactatcaaaacatatatatatatataattcaaaacacaacatttcaaca

SEQ ID NO: 240 - DNA, 3067 bp, Zea mays
ttgtcctagcacttgatcagacaggttcgtccatcatcattatcctgcggattagcccgcgcttggggtcgactttggatcatcttttgcatcgcgcaattaataagcgtaccaaaatgatttgcataatgcacatgaatgcatagcactgacttcaccgcacaactaaaattcttcgcatgaaatgccgatagcgcctaccggcaaagcactaaaattactaagcaaataaatccagcttacccgcatccaacgtgacttaatacttgtgagaatgttgataaatcctggctcgacttgtcgttgaacatcttacgggtgtcgtgcggcttcactttcttctccataccttccgttgatttctctcaaacaagcgacgatcgacgaggatcgcgaacatgacgagagggcgaaaaccatctatcacaacaactctctctatcccgcaaacaacatctaaaacagccatatgaagcagtgttgagatcttccacccccatgacccagatggggctgaccatggggaggcaaaacatgacgagacgcatatcggaagagttactgggattaaagttgacgacacgcatcatggcgaggcggcatatggcgaggaaaataggaacgaacgacgacgagggagcagcacactgcgtgggacttggcgaggtggaggtgtgtcgctgagtaacgctggtggagcttgctggttcgacatgggaggaccaacaaggtcgactgtcagtgagactagataatggagtgtagtccagcaccaaattgacgacagccacaagaagggcaaagatgaggtcgagcaaggtaaaacgggttcaatggctcgacggcagatgcgagcatgcgtgaaacccgatggatgagagcgggtgcgtcgcagtgacaacgagcagacgcacaagcgttaacgcgagccagcggcaagcacgagtgctgaggtataaccgacaacacctggcgagcacgaagcgaagcacacaaccgcgacgacagtcgaatcggcaacagagtgttggcgaactcgacgaacacgaccatggtcgcgtactgacgcggataggacaacgacagttgacgagttggagcaccagcgagtagccgacgcgagaagcaaagcgaggtcactgtcgggcagacttggacacaagcacacacagtgtttcaccgtgtccagcgtgcgcgttacggactcgatgtcgactgcgagcagtttcgcgtgcacgacaacgcgacgaaggagaactgaacagggagcttcgcggcagcacgcgcgcacgaacaacgtaaggctacgcgcgcgacgaggaagcagaaagccacgacaagggagtgcggcaaaatcctgggcacgacacagggaaccggccacggcgagcatagggacaaggcaaggcggagcgcgcgtcagggagaaacaccggcgacctgcgctacaacaaagctggagcgagctgggcaggaagtcgagatccgagcagagcaaacgcaggggcgcgacaagaccaaatccgagctgaagcagggaagaccgcggcatgggaggaacggctggagatcgagctggagttaggcgcgcagggagctgcagccagccatggagatggggtagggaaccgagcagacgccagggcgctggggctgggcagaacgcaaagaaactccaggaaagagaagctgctgggcagagggagctacggaaggaccgcggcgagcagagggcttcacgcgctggaggagtaggagccaggggcacggctggcgtccatggggaggaactggagggagagggaagcagggagaacgccacggctgggagctgctcgcggcagcaggcgcggtaccaagcacggccatgggagcaggccggacacgcgtcgcgagcagagaaaaagaaagtggagggaggagagaggagcgcggacgagagccgctcggctggggagcgcgcgcacagggagcgttgggcgccgagatctgggaggagcgtgcagaggacgccggcgccatgggcgagcgggggaagtaccacgcgcagggaaggattgagctggaggaagatgacgcggtggagaagaaaatagactgggcagcgggattttatcccccggcggctggagatcttttctcccctgagcggcggccgaatggctgaaaaagaatcggagaaggggatagaaatggaagaaggccagctgcgcgtgaagaagaacgacggcgggatttttctatccacgaactgaacggcggctgagaagatttttcccccgcagatgaatgcgcgcaggtaaaaatttggtgaagataagcttcacgcgagaaaaatcagcaggaggcggttagaaaaatattttcctttttttttcagattttcagaaattcatagatatttttgaatcgggatttttagcgacaaacaaatagtcgtatgcacattattttctcggatcacgaaacggaacatctgaggtttacgattctgactaaatttcgattagataatttttgtgactatttcggccacgatgtaaacggaccagattgacacgagttcggcttcggtattttaatctgcgtgattccactaatattagccgaaatcatatctgctgatgcacgtcaaaacagcctgcagaagggtaaattgaatcatatcctggcgcacgatttcactcagacgacgcgcgatcccaattattccgccccgaatattttagtcgtcgagttgaaatgaatttgttagggataaaatcatgaaagtgggcgggcttgccaattcgtattcgcgcgagcgatgaatttaaataatcaccggacgcaccgattttcggaacgacgatgttccaaacatcacgaaaatttaggagaggccggataaataaataaaaacgatgtcgcactagcgacaaatggaacagatgcgatattaaaatcgcgataggagaagatgtttaaaatttagcatccattttatccactgatattacgtgattaaatccatactcgttgtcgagcggaatataaacacctgcggtgttacactaagaaatcaagc

SEQ ID NO: 241 - DNA, 3058 bp, Zea mays
tcgggaccaacttattcacgaactaaatactcaaataatgtaatcccttttttgaatttgttgctttatttattacattaactattagctttaagtaagtacgaccgaccgtatataaagtttgtttttcttgaatattattattagttcatttttgacggagacgtagaaagatgatcaaggtgccatcattgcactaggaccgaacaatgttgtgtgtggtgctgacgatcgcgctgtactagtaccaaacatggatatggatcaatagagagcctaagagatgaagcaccagcagtagcggctcgatcaaaagtcatttcctgctgcagcctttttcagatggagctagggagagcctctggcctctagcacgtacaacgggcttgaaagctctcgtgatctgctgtagctaggtgcaagaacaccagaaagggaaagactagcaagctagctccacgaacaagcaagcacgactaatgtgtgaagcttacctaacatgcgtgcagcacatcagaccatcagtcctggatttcgaccggagtgccatgccatatactagtactatgcatgagtttatatgaaacctgctggagtttaacgatgagtacatgaaaaagtggagcggttcaggtggattgcagagccaaaggacgcgccccatatcatggagcaatggaggaggcgtgcgggctagcgccttgtgcatgcagaccatgcctccatttagtgcgagtcttgcgtccactagttgaagaacgcgctctagtgcagcctatgtttggagagacatgtacggttggcctgcagtagtgaccacttctcatggtaagacgcgtgcatcatgtggcccagacgagacgagaggtgtagtttctaggcatgtcgtcgtctacttctatttatttaatgagtgctagcgttgtatgtagggatccatcaatgatgtgccatctagtgctatgagaaagtgtggtgctctggtaggagaaagctagcaagacgatgctcctaatactcacaagatagagagttgtgtacatgtcttctcggtgagtgagagagagagagcaatagcacaagcctattgattttgtgagtcctgactgttcatttatgtttgcagttcgtccgtgtgccaaatcttgctgcaattgggtctgagtggtcagtttgaccaacatgcatgttattaattgcaactttcttgtggagaagtaggtaacttttcgtctaacttttggtccacgagatcactaaaaaattttctatagagaacaagttagtacacattattttatataggccatagttaaactaatttgcacctaactcttgtgtttagtcttgagaagagtggatgtgacatgattcagggtttacccacatagcaaaatccaccagcatcaaaagtttctcacccaataagaacctagtaacctgctaaccacctattcatatagttaggcctcgtttggattagttaatctggacagcaactaaatcttgcattttagtctctggttgattttatttttataaagtttcaagatctttatccttgaccaaagacaacaatttttgcagctcatcctcaagaaacaacatcctctttttggcatttgtcgccactatttgtagtctaacaatttcatcatccttcatttggcacccaattgcaactcatcaacattatgcaaaaactttttagcggcttcagtagcctgctttacctctattttcttccccttaatggtcccagtgtaatcatcttccattgccttaagctggttccacacaaaattcttttttcactgtcctctaatctcatgatctttgaagcttactttagttttcttatctcttacctaatatcttcctcacttttttggtgatccgaattgttgggactaaactttacttcatatattagtattgacaattcggatcccaaaaaattggagaagagattagggaagagattaaaaactaaagaaagcttactagatcctaagatgagagaagcacaatgaaatttcagcataacaaacgaaaaagaattatgtgtggaaacaacttaagacaatggaagaatgttacggtgggaccattaagaggaagaacttacaggtaaagcgggctactgaagcagctcaaaagcttttgcataatgttgaggagctgcaagtgggagcacaaataaaggtgttgaaattgttagatgatatgtagtggcgataaatgccaaagataatatgctatttcttgaggatgcgctgggaaatttgttctcttttgttaagcatgaagatcttgaaactaataaaaatgaagatcaacaaaagactaaaacgcaagagttagttgtagtcgagtttagctgatccaaatgaggactaactatatcaactttgtgtcaggtggttagcaggtctgaaaaatatagtttcgcttgtttacaccgtcggagcaggcctggaaattaatgtcgcatttacatgtgttcatatacccaacttaattttctcccttaaggtgtattgttggtttatttataggcccaattaggtgcactggagtcgaacaatgtaggaaccgtctcctgtaggtgtcaacaaaatcttatgcatgcttttctactgcaaattgggtctcatgggttaggaactgtcacgcgctcttgctgcaattgggtcttagttgtcagtttgacaaacatgcatgttattgattgctacattcttatggagaagtaggtaactttttgtgtcacttttgggcctgctagactaaattgcccacgaggtcactaaacttgtctatagagaccaagttagtcaacatatttttagagaggaaacaaccatttctattaacaggaatacaaccgagtcttcttacgagtggatgtgacatgattgaggttttacacacgtaaaaaattgaccagcctaagatgtttctcacccaataagaccccagtaacctgctaactatatgtcacaaagttcatatagttgggcctcatttggatcagttaaactaaactgcacctaac

SEQ ID NO: 242 - DNA, 2940 bp, Zea mays
ttttgtaattttgtgtgtagcttgcaactcgaaccacctggatcccatggaacttgcagggctttgacactcactatagtgtgaccaacacgtgaatagtatgggagtgtcagatgactgtacgtttgtactccaagatcaaatgagctgaagcactgactagcaacaaaatttccaaacagacactgtgtagtgaagatttgcaatatcaaaagttggcaggtccaaggaaaaccgaacctcagttgcaccatcactgaatttacagaaatctgaatatgcagaatctcatgtccaaataatgcgagataaagctttgggtaattctggatttgaatttttgatacctcacttcttcctatgctggaataattaagcttgcccacatattttccaaatatccctagacataagggatggtgcctccaggatagtagtccatctaacatttgacatgcagcactccacggtggaagtttgccaacaacgattaatatctcaccatcttgatttagctcgtgactatcagaaggaccatggtaagtaagaaacatgaccatatgatctcggtcgacctatcggccatagtctttgttggcaagacaaagagatccaagaacttcatcacttaaagacgtaatctccatcggattgcctccttgttgttgctgtttttgcccattggtgacatgaaaattggacctgtatatgtatgctactaaggcttctaaaatttttgcttcctgacccttgttgtgtaggttatcgatcacctggtctgtatgaaccattccgagctcaagtaggagatatggttttttgacattggcaaccaagttatcagtgttcaacttggcaacctgcttttctctatatgcatccaaatactgtatgcccattattccaagtgctttacctcctgaacagaatgtcaacattacagtagcctcaaacagccgcactgcctcatacatttcagttgtggaatcctccatggtaatacgaggatctgatggacttgtggagaaatctaagagaagtgtaaacatgttgacatcaaaataaagcaaagactccaactttgctgcatcacacatcttctttgtattagagctgtagttgatagtggaccatgcaccaacaaatgtaagagagcgcaactcatatacatccaaccaataagaggcataatagagatataaaacagagttcagacttctatcactgagcaacctagtaaagctgcagtctggaaagtcacagtatagcttatataggtgttcattgcttccacaactaaaattaatttgcctccctactgacatgtcctcaagcacctggtgagtgactgttctccatggtctcaagccacctgtccatgacggaagacacatatggatggccttctattccgaatttcttacttgtgattcatggtacaactgctcaggctcatatgttgtgccttccttggtgtctgaattaggatctacaacaagtacctggtttgtaatatccatagctaggtctaaaaataatggagagtccctggcatgagtagatccatcattggtagcaagctcaacaatattatgtgtcttttcatcagtcatatactcttcaccatttgctagctgctgcattataccttgatgcgagacaaagttctgaggcctcctctcatcccgcaccactatgtcatatggctcagcatgcattgtggcctcaccaaccataaagtctccgtgagccaccagcttaagtaaactgtcgtggggctcataactttgcagcaactcatcaccccacacaatctggctagaaagtggatcaaacactttgtgcatatcactctaagacatcattggtgccttgaacactgtcagcttgcactgctgctctagacgatatggatcaaaaccatgatgcgattcctcatcccatatcaccttcacgagaggattttcgtcgaacagctcatgtgcgggtgttgtcgacaccattgaagcctcgaatgcaacttgctgaactcgtattgtatcattatcccaacgaggcatgccatcgaacacctcatgggcagccacctcaaacatcaccgcaggaaactggtcacacttccaccgccgccactcatcaccaaatgcaaatcaccgccaccagcgccaccgtctcgcctcccgagtagcgtcgcgtcgccgccgaagtttgaaggctccgaatcgacgaagtcgcagccgctcctccgcttccgatcgtagcacccaaccaccgctgatgcacccttggcgaggatcaccgaggctttgataccacttgtcatgccccgtggccgccggcggtgaagaccgagacgtgaggcgatcgagaagctcatctggaccgtgtcttcgtgaggaagacaacgagaacaagagtcttttctgattttctctcccccttccttcctctagtgcatgatctccttttgtagctttcctctttccccaaaagatggccccacatgtcagtctaatataaaagaacatgtgtggtagcctggcccactgacagtataatactagggcatacgtgtatgacacaaaagagtggtgtagcatcgggattcttggggaggggttgtcgctaggttgttatgatgcgaacttcggccttgtcaccctattcgtggcgtataaagctctagcgcggccgtgattcctccacccgtgccgccgtgagcctttcgtcggatcagtgattgggggatatccacctgtgcgtaaaattggggggcgtagctggttttggagcttcacctggtcgccgtgaacctgcatggggcttcagcgggcgaaactagggttgggggacctttgattggtcgctgatgtccgatcttcgctttagggccgcgctgcaccatgggcggtcctctctgtgccctaatttgtggtaagg

SEQ ID NO: 243 - DNA, 3042 bp, Zea mays
  misc_feature (985)..(986): n is a, c, g, or t
gtaataaacactaggttagtgttgttaggtgacgtccacttgaccatcctttgtcctggctcttgatcaggcaggttcgtccatcagcatcgccatgcggagtagcccgcgcttggggtcgacttggcttgtcttccgcattacgcgattaattaacgtacctgaatgaaatgcattatgcacatgaatgcataaaaaacaggaatagcacaaatctaactagtgctacgtgatagcgaatttaaacacctagcgacgaggtgttgtacaagatcatacggaaatactagttatcgatatacgactacgcacaataattacgcttctctaaattaaatgaacctaacgcaacacgaaacaacaaactatacacatgaaatacaattagcctaatcacaacttatcagttaattaattaaattctaaacgtatcccttgctttataaattatactacatctttataagtgattaaaatatttcatcaacacacaggtctactaatattttactcggtacactaattcagctaagtgactggaatagcgaaatagctcgtcatagctgaatctggctcgataatcgcaagaattgtgaagtcgacgagagtttcatgacttacgcaatttattgagcaccttaatgagcatcgcactagcacattaatttattcattgatcgaactactctgaataatttatcagcttaccattttcacggctgacacgaatccgcgagatcggtagcgattttctgatccagacaatttgtcgagcgcttggagaatatcgcgatgctatctccgtcttcacccgattcttgtgattcttgatgacgcgcggaacggcgacgatcttcgattgaagtctttaaccgagtacttgataagcgatacacaggggtctcgcttatttttgtctaatatccgagcagaaggcacagctgcgtggtagggagaaacaatcgggcgtgacgagctgaacaannttgatgacgcacggaacgacgatgagttggagacttgcagggtcgaacacgacaaagagcttcggatcccaacgcgcaattgaaagataaaccgtcgggggccacaagcatgtcgcggacgcgacgggtattggcgacaagaagcaagggggttgctgttgcgatggtgaaagatgaagggcactatggagcagggagacacgcctcggagccgagtattgagatgtcctggccaacggccagaccgaggcgatggccagggaactcagcacgggcgcgacgatttggcagacagggagaacatgatgacaaggagcaaagtttgcagatgccgcgacggggctgcccaaacacaaagacgacgacgtggagcgagtagcgcacacacacgtcgcaacaaaacaaaacgatggctgttcaaggcttgatatttcctggagcagagctaaggtgctgggagttcacagcggtgctccacgacggccatcaccggcgtcgagcaaggggcgatctagcgaggtcgacggcaaataacgtgacgacgagctggaataccagggtgacccgagcgcgacggatgagccgtagccaagcagtgggacgcggctgcgggcagaggagtaacagaggccgagcagagaaacgcaggggacgcgcgcggggtgaaagagtcgagccgcggcgcgcgcagacttcacggcgctcggcgcggcgagaacgcacgcgcacgagaagatgtagcagggagggagtacgcgcgcgcaaaggagctcgacggctgggcgagttaggaggagcaccatggctaaactgaggagtgcgcaaggacagagacgcgctatggcgacgagctggagaccgaatgtgagcatgtgctagcagcggagagccgcgaccacgaggttcgttgacgacggccaggggtccgactgagcgggctggagcagagggcagggccgagctgcacggccggcgagctggagcaccggtgagcagcaggcgcgggcgaactccatgggaggaaaatccgagctggtgcagggaggagcagagagaagaggcaatgtctcggaagaagtctgagccccatgggaggacgcgcacaggaaggctgaagcttgcaggggacccggcgcggttggggaagagagcgagccgcagggaaatcggctgggagggagcgcgcgtccacaggaagaaaccgagcggctgaggagagagagcaggaaatattccgcgacgggatgagaccgacggctggaactcggttgggggcttccgctggcgagctacgcgcatataaaacgaacaggggcggcggcaaaaatatcacatagtcaggtacggtggctggggagaggatgagaacgagtgagacacaggaaaatcttgcgccggctgaacggatgaaggagagaagatgagcacgacgtcaggaaatatcctacgaagaggataaagattggagagaaaacaaaaattcaacagaggaaatatttctcagtccttttttttcaacacaaaaatacaaatgacatgcttcggattagcgaaccaatttaatcgctaattacttatatccgaaaattcagatccgggcaagaaacgacggcccgaataagactgatttcgtcttcggtaatttgttcggtgggattcgactaaaattagccgaaaccaaatccgctattgtatacgcgattttgtcgccacaacagcaagctgaaggataaattgaatcatattcgcgcgcacgatttcactcagacgacacgcgatcctagatattttgccccgaataattctagtcgtcgagctcaaattaatttgcccgggataaaatcatccgagtgagtcgggcttccgaattcatatttgcgcgagcgaggtatgttaaataaccaccggacgcaccgatttttgtaacaacgatgttccaaacatcacgaaaatttagtacgagtctgaatagataaaaataaaacaatatctaactcgcgataaatgaaacatatgcgatattaaaatcgcgagagacgaagatgtttaaaattta

SEQ ID NO: 244 - DNA, 3042 bp, Zea mays
cgcgacttcaagtcacacctccatggcgtacggccgatgcagctccaccccttgttcaagttgtggacctagatgtcccaaactcctcaccagagctcgcgctgtcctcggtgcgctcgatcgccccactccgtggctgtgattgctgactagagtacccctgacccgcccagttcttctcctctgtggcgaattctagcttgccggtgtcgctgcgcgtcggtctgccacacctccacagcgtgtggccgatgcagctccaccccttgcccaagttgtggccctagatgtcccaaacccctcacaggagcccgtgctgtcctcagtgcgctccaccaccccacttcgtggatgggtttgctcgctagattactcccgacccacgcggttcttatcctctacgacgaattagagcttgccggtgccactgcgcgtcggtccaccgcacctccacggcgtccggccgatgcagctccacaacttgcccaagttgtgggcctagatgtctcaaacccctcaccggagcccatgttgtcctcggtgcgctcgatcgccccactccgtggctgcgattgctcaacagagtaccaccaacccgctcggttcttctcctcttcggtgaattagagcttgctagtgccgctgtgcgtcgatctgccgcacctccatgatgtttggccgatgcagctccaacccttgcccaagtggtggccctagatgtcccaaacccctcaccggagcccgcactgtcctcggtgcgctcgatcaccccactccgcggataggattgctcggtagagtaccctcaacccgcccggttcttctcctctacgatgaattagagcttgccggtgccgctgcacgtcggtccgccgtacctccacggcgtgaggccgatgcagctccacccgttatccaagttgtggccctagatgtcccaaacccctcaccggagcccgtgttgtccttgatgcgctcgatcgccccacttcgtggctaggattgctcgccagcccgcccggttcttctcctctacggtgaattagagcttaccggtgccgctgcgcatcggtttgccgcacctccacggcgtcccgccgatgtagctccaccccttgcccaagttgtggccctagatgtcccaaacccatcaccggagcccatgttgtcctcggtgcgctcaatcgccccactccgtggctgggattgctcgctagaataccccgacccgcccggttcttctcctctgtggcgaattagggcttgccggtgccgctgcgcgttggtccaccgcacctccacggcgtccagacgatgcagctccaccccttgcccaagttgtggccctagatgtcccaaacccctcatcggagcccgtgctatcctcggtgcgctcgatcgccccactccatgtatgggattgcacgccagagtacccccgacccgccagttcttctcctctgcggcgaattagagcatgccggtgtcgctacgcttaggtttgccgcatatcaatgtcgtccggccgatgcagctcaaccccttgcccaagttgtggccctagatgtcccgaacccctcaccagagcctgcgctatcctcggtgcgctcgatcgccccactccatggctggcattgctctctagagtacccctgacccgctcgattcttctcctctgcggcgaattagagcttgctggtgccgctgcgcgtcggtccgccgcacctccacggcgttcggccaatgcagctccaccccttgcacaagttgtggccctaaatgtcccaaaccactcaacggagctcgcgctatcctcggtgcgctcgatcgccctactccgtggctgggattgctctccagagtacccccaacccacctggttcttctcctctgcggcgaattagagcttgccagtgccgctgcatgtaggtccgccgcacctccacggcgtccagccgatgcagctccaccccttgctcaagttgtggccctagatgtcccaatcccatcactggagcccgtgttgtcctcagtgcacttgatcgccccactccatggctgggattgctcgctagagtacccctgacccgcctggttcttctcctctgtggaaaattagagcttgccggtgccactgcgtgtcggtccgccgcacctccacggcgtctggccgatgcagctccacccctttcccaagttgtggccctagatttctgaaaccccacactggagcccgcactgtcctcggtgcgcacgatcgccccacttcgtggctgggattgctcgctagagtacccccgagccgctcggttcttctcctctatggcgaattagagcttgccggtgccactgcgtatcggtccgtcgcacctccacaacatccggccgatgcatctccacaccttgcccaagttgtggccctagatgtcccaaacccctcaccggagcctgcactgccctcagtgcactcgatcgccccacttcgtggctgggattgctcgccagagtaccctcgaccttaccgattcttctcctctgcggcaaaatagaggttgccaatgccgctgccgtcggtccgtcgcacctccacggcgtccgaccaatgtagctccacccttgcccaagttgtggccctagatgtaccaaacccctcactagagcccacactgtcttctgtgcgctcgatcgcaccactccatggctgggattgcttgctagagtacccccgacccacccggttcttctcctctgcagcgaattagagcttgccggtgccactgcacatcggtacaccgcacctcaacagcgtccggccggtgcaactccaccccttacccaagttgtggccctagatgtcccaaaccccacaccggagcccgcgctgtcctcggtgcgcttgatcgcccgactccgtggctaggattgctcggtagagtacccccgacccgcccggttcttctcctcttcagcgaattagagcttgttggtgcctctgcgcgtcggtccgccgctcctccacggcgtccggccgatgcagctcca

SEQ ID NO: 245 - DNA, 3039 bp, Zea mays
gtcgcccgacttgaaatcattgaagcacactgcaccaagcatgaaatgcaacaggtggaaatccatccagtagaagaatgctgctttagacattgacactaaccgaccagttattctgtttcaaactttcaatagatttcaaaccatttttttacaaaaactgtgaatagctttcatgtgttcagcccagtatatgacccgaaaaatagtattgttgtgcctgtgaatgacatgtgaggcccaacctcatttgtcattgacatagagtagtgttttgcaaaagggcctctagctgaattggttttgtggtctgagtagcactcctcaggtcctgggttcgactcccagtgggagcaaatttcaggttgtggttaaaagaatcccttcatctgtccacgctaaagcacaggtctaaggctccgccccggtcgcggttgttctcacatgggctttgatgccgctatatatgggcggggcacgggttcaggtgtttctcgacctgtgggagaaggtcttctatacaatactcgggggctgccttacccctccccctgcaggtcgagtttatagactagtgttattttggcaacatgtggtttcactagtgatgataaaagatatattagcacccgaagtttagaagtcagacaggatgcagcctgaacatcatcctcttgtgattggtggggtaatttgacacaaatgtaaaatgcatctttcagcatataaaaaatatttcagagcaagtgcaaactagaagggcagaaaaaaaagtctggtacacatagcagtttccaaggcaaagggatgatgactacctattgaaaaaaatcattttatttgcagagtttgatgtcacaaattccattttttccagagtatggtgcttcaaacaatgaagtttatattagtatacttaagtcgcagttctgttagtttcattcccaaatagacatcattgttttggattctggaacagtatgctgaaagtgaaaccttgagttgcttgcaaccatatttcctatttataggcaaagcgttgtacggtacactggctgtactaaagtggggcaatcagtgccttgaaaattgaggacatcagataaggggcaccatttgactgtagtgatgcactccatatttgcaatgtccacgcaaaatgcttttaggtaatggtcacaaatgtacgcaaagattggctatgccctcttcactatcaaatggcatcaatcgcagtaaaatactttgaggtagcctacatctgggaaccagacaacaaaagatgcctatctatgaatgcaattgttaaacaaataccatggatcttgaaatcagcataagcatgtatagtaattattaagtagcggcaggaccactttaactttcgtgtagtttattcaattggaccccatccctatgcccttgtcactatattttcagcataaagtggaaccatgtctaatagctaaatgatgtgggcataatatccaaactcttttcaccaatggttaaatactttgaaacaacctagtccaataatttattcattagaagcacaaccacaatcacaagaaaattaaaacaaagacacggaaggccggaaccttgagttgagagtaattaaagggaaatcgtactcccaagtaagtttgattaaggataagaagggtttgctcaccgattccctgatggccttggtgagctgcctcctcgccctcttgatcttcttgtccaacgcctgggcctcgttgtcatcaatgcggggtagcaccctctccagcaccgccgggtcaagaagggccatcgactcatcgacgaggtgaggatacaattcgcgcatctcatctaaagtcttggccttgtgccccagcgcgtcattgatggattaatgcccggcgttcttcacttgggcggcgcccttgctagattgctcgccgccgccggcgcagcagggcgcggcgagggtctctgggacgcgagcctcgtcgtcggggcggcacgcgcgcccgaatagcacgagcttcttcttggatgacggctctgtggcatccgaggccttggctggcgttgactcgggcggcggcgtcttcctctttttgcgctcgggtggcgcctcgtggcccttggtggacagcgccgtccggctcgtgaacgccctcttcgccgcggacgacggcttcgtgctggtgctatgctctggcgatagggcctgcggcggcggcggcggcctcatggcggtaacggcgtgttgtgattttgcacttgcagcgtgggagagggagcgaggagtggagattttcaggaggtcacctttttgctgctttaccctcatcaaatgagagcttcgacagattaccctcgtgcaaaactgataatggagttggacaaactgatcattttgagtctttgctatacagacagctcgcaatgttgcttgggcagcccactggtgatgcatctccaggaaagagtactccaacaaataataaaaggactaccaagaaattgacacagagtaagaaggaaaaaattagcacctaactgtttgtccacctatgtatcaacttgatgtcttgatttatgaacaagatgtcagctatgtatgaacttcctcacagtagtgtttaccaaattagcacctaattgtgtgaatctggaattgtctttgatccaaattggtgaggtttgctgtaaagttgtctgcatgttttagaattacaggtgcttcactagaaattacaagtgatgcgttttggtaaacactactcaaaagtgctgtaaagttgctgctgtggggaagagccagccagccaggcacggcgtccgggtagcagacgtcggcaaggatgtagacgtccgggcagcagacgtccacggtggattaactgagaaacgaaaaagaaagcattcagtaaatgaaacatcccctcgcggtgactgttgacctctgactgccagagggcgctgccggccggccaatacacatatatgcccattaatatttatgttcttaactaagtttatactatattatataat

SEQ ID NO: 246 - DNA, 3031 bp, Zea mays
gtagtaaggctcagagacaaacattgtcggcggccgcaccctgcatgaccattgtccgatgaagaacccgccggtggcacgcaccttaccatcaccgacgccatgagcgattccacatggaaaatctcctcatcactcctcgaagcatctgagcttagagcctataaccatcaccgcttccaaattgttaagagcaaagttgatatccgtgaacgcgagggcatgtcctatgacattgattgttgcctccacaaataaacagaaacaattgatatgaattttatcctcgaatcattagatggagcctcaaagggtgccaaatgttctagttgataagtacgaacatattgtcagcaacccaagtgtaggagtgctgaagaatttcacagggaggaagaagaatgtggtggctgggaagaacagcgagaagagagttcagagtagtgtattgtctttcttcctgcccacgcctctgcctaccccttttccttaagtaatccctttacagagcatagaagagcaagtccaagcaaatgaccgcctaggcccaactaattgacccagttactacccattacacgggagtttgatttgcgcacacgtcggcccatctcctcctgtgctcactgtgtactgttggtgaagccggcacatgcctggggctgacacatattgtccttatacttcattaaggatgtgtttggtttaagatcaaagtaggataaggcggggacaacaccgtcccctcgattttttgggaccacaccgccaccaaaaattgctccggtgttcactttcccccgcgtgactctcatccaaacaatatagaaaatatggctatctcctttcatccctccttgtacatctaactaaacacaccacaagttgatctttccaccgccaccctaacataaatgttttgtgtagtgtatgttacaattatcttgatttccttgttttgtcgactccttggtgatcgatgtgcctaactggctaaagaatgatatagtttgtaaagatttacaagagcaacacgttaggttgtttccagaaagaatatcatttactatatacactatgcataggctatcaacctcgaagggacgcgcagctcgcatgtaattccggcgattgcacgtctttacaaaataagataattatatcatggtctcaaatttgtcgagcttcttcactctttgcatagatctgaccagcaatgccaaaaatattcctgcacattttcagtttggatcagaccaatcaggaatatatgtacatatagcttgaatatatagattgattctactacatggtatatatgtacatatcaacaagtttcgccagcctttgtgatactcctatatggttaaaagaaataagaggaccaacaagatgcaagaaacactgaaaagatgtgaggtgataatgttgttgagtacaaaattttaaaattcattttatgaaattatgcaagaaaggaaatcctacctgcaccaatgaaagagccgtttgcaattatctggttcccttgactattcagtgtgaccccaacattcaagagagtaccacccaaggctgtatacatggtggccatctgaagaacagtagctttacgtgcagcacgttctgactgcaaatgccattcagttcagattcaggccaaagaaaaaaaatagcgtagtagtttttaggcagaccagatgaggccaaacaaagattactagtttttagtagatttgagggcgatgaaaaaaaatcttgcaatgtatctcccgcagtcttgagaagatgcaagtcaatggcctacctccagtactctgaccctaagtttcagatctcctgtctcaagttgtcctacaaaatcttcaattctctgtattctgtacggcattgatattgtagaatcacgagcctgttgtatgttggacataacagtggtaatgttttagtgctgagcaatataccatacacatgacgaaatgtaaaaaaaaaacaaatgtgaaccagcagatttatatgcttacatcatttgcttgcttccttatttcctggaccaattgaggtccagtttgtcgtctctgtttcaagtctaacagttcctgaagttcaaacgaaattaggctcgcaaacacagacaaacatccaaatgggcttctgtttctaggaagcaaaacggagtaagaactaaattataatgagataataaaagaagcccaggaacatcaaggaatataaaacagatggtttagcatgtgaatcattttttagctgtactgacccttcttagaagatataagataacaagactaaatagaacacatgaatggaaaaggtactgtaagaaaacttgattattatccggaggcttacttgagcatatggtgctgcaactttgacaaacgaaaattctggatctaatatgtatccaattcctgccaaataaaatagtcattaatatacaagtggttaccttattatttcggttgcagttgataatagtagagaataaataaataattggaatataaaattgtgaagaattgggctacagcagactaacaagatgcatgacttatttagatatgcatctgatttcctggaacttagattaacaatagatagtatggtatattcagatacaggcagtaaaacaataaagcgtaaagacaaataaaaaattatcttgaagaagtggtagagcattccacgttattaataagagagcgtcaactacaaaaccagcccagaagtaccgaacaaagacagaagcacatatgccccaaaaaaagcaaaaatagaaaataaaggaaacatggaaagaacatgttactgtttcctcagctattacatgagatttagtagaaagactaatatttgtgttcacatgttgctcagaagattctatgtcataattgttagagtatatttggaagtttacatattgtgtttcgtagactgtcatgtgttagaatatatttggtagttcacatattgtcaggaacatagcctaggcgtctaataccatgagaga

SEQ ID NO: 247 - DNA, 3080 bp, Zea mays
ggggaaggttataatccaatatgcgttcactgccctaggatcaaagatcaatggcccgaaatcatccacacaacagatttagcacgggccctccgtttgatgatctacggcccagacctttcctagccgaaagggtatgcgagatctaatctgtgccgttcaccttgccctaggatctaatccgtgtcgttcaccttctactacctcagttattctaatgtgcacactcagttattctctactcattactcagttattccattctaataacttagttattctggtgtcagtactcagttattctggtgacggaactcagttattacgttctactacctcagttattctaatgtgcacactcagttattctgttctaataactaagttattctactaattactcagttattccgttctaatacctcagttattctacttttccgactcagttattctggagtcagcactcagttattctagtgggcgcacttagttattccatgttcatttctcagttattctcggttcagtactcggttattctgtgttcatcactcagttattctggtgacgaaactcagctattctctgctcgtgcctcagttcttgtgggccaactcagttattctactccaatccctcagttattctgttataatacctcagttattctaaaccctcagttattatgttataataccgcagttattccatgttcctaactcagttattctatgtcggtactcagttattctaatgcgcgccttgagttattccatgttcatcactcagttattcgagtgacagaactcagttattctactttgatccctcagttatcccgtgtcatacctcagttattgtaatgtgcctactcagttattatatgttcatgactcagttattccgttccaacaactcagttcttctaatggacgcactcagttattctggtgccagaactcagtaattcctttccaatacctcagttattcttgtgggctaactcagtgattatggtgtgcagactcagttattctggtgtcggcactcagttgttcggttctgatccctcagttattctactccaatccctcagttatcctgtatcatacctcagttattgtaatgtgcccactcagttatgcggtgtttattactccgttattctctattcacattcagttattacgttcaagtaactcagttatgttattgctcattactcagttattctgttgtgcacactcagttattctattgttcactactcagttattatctgttcattagtcagttattccgttccaacaactcagttcttctaatgcacgcactcagttattatggtgacagaactcagttattccgttccaataccttagttattcttgtgggctaactcagttattctcctccgatgcctcagttatcatcatacctcagttattggaatgtgcccacttagttattattgtgcagactcagttattctggtgtcggcactcagttgttcggttctgatccctcagttattatgttataatacctcagttattgagatgtgccgactcagttattccatgttcgtcactcagttattcttttgtcggaactcaattattctaatgggcgcacatagttattctggtgtgataactcagttattctcgtgtgcctactcacttattctctgctcattactcagttattctctttgtaatcactcggtagtggggactccgtattctctattcacagtcagttattgcgttctattaactcagttattccatgttcgccactcagttatttactcagttattgtgttttcattactcagttatttcattccaacaactcagttattctaatggacgtactcagttattctggactaatacctcagttattcttatgggccaactcagtcattctactacgatctcttagttattccgttataatacctcagttattgtaatgtgcgcactcagttattacatgttcagtactcagttatttctttcagtagctcagttattctattgtgcggactcggttattctggtgtcagcactccgtcctaatacctcagttattctctgctcatgactcagttattctagtgggcgcactcagttattccatgttcatgtctcagttattctggagtcagcacgcagttattctagtgggtgcacttagttattccatgttcatttctcagttattctcggttcagtactcggttattctgtgttcatcactcagttattctagtgacggaactcagttattctctgctcatgcctcaattcttgtgggccaactcagttctactccaatccctcagttattccgttataatacctcagtattccatgttcctaactcagttattctaaacccttagttattatgttataataccgcagttattccatgttcctaactcagttattctaatgcgcgccctcagttattccatgttcaacactcagttattctctgtacgttactcagttattgtgcgttcattactcagttattctagacgacgcactcagttatttgagtgacagaactcaattattctactccaatccctcagttatcctgtgtcatacctcagttattgtaatgtgcctactcagttattatatgttcatgactcagttattccgttccaacaactccgttcttctaatggacgcactcagttattctggtgccagaactcagtaattccgttccaatacctcagttattcttgtgggcggtgtgcagactcagttattctggtgtcggcactcagttgttcggttctgatccctcagttattctactccaatccctcagttatcctgtatcatacctcagttattgtaatgtacgcactcagttatgcggtgtttattactcagttattctctattcacagtcagttattgcgttcaagtaactcagttatgctattgttcattactcagttattctgttgtgcacactcagttattccatgttcactactcagttattatctgttcattactcagttattccgttccaacaactca

SEQ ID NO: 248 - DNA, 3030 bp, Zea mays
cattttaagacttgcttgggcccggccaaacccatcaacagagagatatctatgctttccattctcaactccttggctgttctagatacagagctagtatagacatattgtaattgtatagcaaaggccacgaatctttaaaaaaaactcaagacattttataatttaaaaccagacaaagctttatgatttaaaacgggaacagtaataaatgtgcacaatgattacggtcatcatcatcatcctaaaacagcagcaacaaatgccactaataccataccaggttacaagcagagtctccaccgacaaacgcaccacccactcatttcattccgagcaaaccaaccaccggacttagccccacatacacaaacaatccacggaggaaaatcaaaacagagcctagcagcagatataacaagagtctgacaaaccgccccaatcatggggccaacagttccatcgccgccacattcatcagtcgctgatagcaggcgacgccgaccttgaccgtgacccaggaggtgacatggacgctggccggggtgacctatgatgaccgcgccgaggctcctcatcctcctcgcctgctggggacctcttcctcctgtcatcagcatacaacaagctgttactaccattcaacaaagacacccatctgaagcagctactcctgctgtgtatatataatgaattctattttaccatataaaataaaatacacctgtaaagaatgcaaagaatgtgcctgaatatacattaattgtgcaactgtacaagggatgtccaacagcagtattgctcgggaaaaggcacttcacatcaagctttacaaaattactcaaacaaataaaaggcactattccctgatgtcctccacaaagaagtggccacttctcatttcttagtcaaacaaatgtttagtttaacaaccccaaaatgaatgttgcatgttacagatgggatgtttctcaacaaaaataaccactcaataggatgcacaatatcactacttcaaaacataactagactaacccatagacatgtaccaacagtcaaggaacagaacttactcatcacgaccattgtctgcaccacggcgatcatttatatcatcaggagtataggatctcctcctatccctgttattttctttaggctgttttgatgacctcgggtgctcttcctttgcccggggtggggaagcagagtagtcatcacgccttttcggggcaggggagtatgacctgtaatataggtaacatcatttcgaggaacgttactgcacttgtacatcatggttggtccattacttattcaaagagactcaaaactcgcagacatactgtgatctaccacgaccacgagggcgtggtgagcgggaacgcgagtatgaacgagaacgggaccgtcctgcacctaaggaaagatagcaacttgtcagttttcaaacaacttacaaaaccatcagttttcaacaacacattttgctaccagaagatgcaaccttcaaacaggcaatttagataaaaaaagatatgatacaatagaattacaaaaaatgccaatcatgaaacttaaatgaacaaaacataagtttttttatcccctcccccactccagataaaacaccaacagttaaaaaagatatgatgcatactcaatcattcatccatgcatctcaaataataggacaaaacaaagcaaataacttagattaccatgacgattcggacgacgcccttcatgaccagaataacctctgcagaggtacaacttcagtcattttaagtgaaatacagatagtgcttccagaaaacaaatgcttatcggcataccttggtccagttcgtctacgcatgtcctcaggccttttccgtgtatccgcagcaagtacaacagttatttcacgcccagcaaacatctggcgattcatgtggtactgtgcctcagaagcgtcataagcatcaacgaactccacgaacccaaatcctcttggctccctgaatgatcacaaaagccttcgtaagtaatatggcactggtaaacaaataagatggcacataacaatcaaaaatagtatgtgcctcacgagttactaccaggctttcatattattatggtgaatcatttatagttctccatagagcatagctaataacttacaaacatgttcatcaaatagtagcaagcctcaaaaagtgattaggagcccttagatccaaaatttcttgtatacatcttcgtaaagtgatttgcttcaatttcttcgagtttgaaaactcatgaaaagttcttgagaccaacttgtcttcattatatattcccatggaagacacggtcaaaccctcttctcttcaggaaattaacaaattgaatcttgtcttgataaaagaacttcattctcacaatactctatctcaccaagcaaatgaacgactaggattgttcagggcttgtatttacttcaaccaaaaatacagtcctgagaataatttgaagagagtaattcgtaccagaagaaagaatcatcatataatgtaaataaatcctatacacaggaaattaattagtgaagttcaacagatggttgtattactagtcttattccacatgttttgccttaagctatcctatgatgttttatattatgcagaaactgcataaaaggaagagaaagggaatggttgagttctttttatgctaatttgctaagctgcgacaatcagtccattttttgactgcaccatcatgaagtatatgtgtgcaatccgtgagcctgtgacagtgtgtagacatccagcaaagtgtacagcccaagcaaagctttcagtcgcatgcaaacatttttagcagtcttaatttcaacatcatggccaaaatataagatccaaaaatgctagctcctaaaaagcagcagaaagcccccaaacactttcgtagaaccccaaatggttagagatgtttatatccaaacatggaaggtgcaaaagcactttgtagtgcagtggcttgtgctcgccacagttc

SEQ ID NO: 249 - DNA, 3027 bp, Zea mays
  misc_feature (1922)..(1923): n is a, c, g, or t
  misc_feature (2713)..(2714): n is a, c, g, or t
atttcgtgaaataaaatgacatactcgaccacgttggagtccattattgtttagacagtcgccattgataacaagatcaaggccgacttgatggggaccaacttattcacgaactaaatactcaaataatgtaatcccttttttgaatttgttgctttatttattacattaactattagctttaagtaagtacgaccgaccgtatataaagtttgtttttcttgaatattattattagttcatttttgacggagacgtagaaagatgatcaaggtgccatcattgcactaggaccgaacaatgttgtgtgtggtgctgacgatcgcgctgtactagtaccaaacatggatatggatcaatagagagcctaagagatgaagcaccagcagtagcggctcgatcaaaagtcatttcctgctgcagcctttttcagatggagctagggagagcctctggcctctagcacgtacaacgggcttgaaagctctcgtgatctgctgtagctaggtgcaagaacaacagaaagggaaaggcttgcaagctagctccacgaacaagcaagcacgactgatgtgtgaagcctacctaacatgcgtgcagcacatcagaccatcagtcctggatttcgaccggagtgccatgccatatactagtactatgcatgagtttatatgaaacctgctggagtttaacgatgagtacatgaaaaagtggagcagttcaggtggatcgcagagccaaaggacacgccccatatgcatggagcaacggaggaggcgtgtgggctggcgccttgtgcatgcagaccatgcctgcatttagtgcgagtcttgcgtccactagttgaagaacgctctctagtgcggcctatgtttggagagacacatacggttggcctacagtagtgaccgcttctcatggtaagatgtgtgcatcatgtggcccagacgagacgagtggtgtagtttctaggcatgtcgtcgtctacttctatttatttaatgggtgctagcgctgtatgtagggatccatcaatgatatgccatctagtgctatgagaaagtgtggtgctctggtaggagaaagctagcaagacgaagctcctgatactcacaagataaagagttgtctacatgtcttctcggtgagtgagagagagagagcaataggacaagcctatttattttgtgagtcctgactgttcatttatgtttgtagttcgtccgtgtgccaaatcttgatgcaattgggtctgagtggtcagtttgaccaacatgcatgttatcaattgcaactttctcgtggataagtaggtaacttttcgtctaacttttggcccacgagatcactaaaaaattgtctatagagaacaagttagtccacattattttatataggccatagttaaactaatttgcacctaactcttgtgtttagtcttgagaagagtggatgtgacatgattcagggtttacccacatagcaaaatccaccagcatcaaaagtttctcacccaataagaacctagtaacctgctaacgacctattcatatagttaggcctcgtttggattagttaatctggacagcaactaaatcttgcattttagtctctggttgattttatttttataaagtttcaagatctttatccttgaccaaagacaacaatttttgcaactcatcctcaagaaacaacatcctctttttgtcacttgtcatcactatttgtagtctaacaatttcatcatccttcttttgggcacccaattgcaactcatcaacattatgcaaaaactttttagcggcttcagtagcctgctctacctctattttcttcctcttaatggtcccagtgtaatcttcttccattttcttaagctggttccacacaaaattctttttgcctgttgtgctgaattnngggactaaactttacttcatattagtgttgacaattcggatcccaaaaaattggagaagagattagggaagagattaaaaactaaagaaagcttactagatcctaagatgagagaagcacaatgaaatttcagcataacaaacgaaaaagaattatgtgtggaaacaacttaagacaatggaagaatgttacggtgggaccattaagaggaagaacttacaggtaaagcgggctactgaagcagctcaaaagcttttgcataatgttgaggagctgcaagtgggagcacaaataaaggtgttgaaattgttagatgacatgtagtggcgacaaatgccaaagataatatgctatttctagaggatgtgctgggaaatttgttctcttttgttaagcatgaagatcttgaaactaataaaaatgaagatcaacaaaagactaaaacgcaagagttagttgtagtcgagtttagctgatccaaatgaggactaactatatcaactttgtgtcaggtggttagcaggtctgaaaaatatagtttcgcttgtttacaccgtcggagcaggcctggaaattaatgtcgcatttacatgtgttcatatacccaacttaattttctcccttaaggtgtattgttggtttatttataggcccaattaggtgcactggagtcgaacaatgtaggaaccgtctcctgtaggtgtcaacaaaatcttatgcatgcttttctactgcaaattgggtctcatgggttaggaactgtcacgcgctcttgctgcaattgggtctnntggagaagtaggtaactttttgtgtcacttttgggcctgctagactaaattgcccacgaggtcactaaacttgtctatagagaccaagttagtcaacatatttttagagaggaaacaaccatttctgttaacaggaatacaacctagtcttcttacgagtggatgtgacatgattgaggttttacacacgtaaaaaatttaccagcctaagatgtttctcacccaataagaccccaataacctgctaaccatatgtcacaaagttcatatagttgggcctcatttggatcagttaaactaaactgcacctaac

SEQ ID NO: 250 - DNA, 3025 bp, Zea mays
gcacgagtgtaacgagtataatataaataatctacactaaaagaatgaaacactttaaaaccaagcattaagcaccatggcatcgactacctccattaatcaaatggacatattatactagaaaatacatttttatttctagatttttattaactctttaaactatgtatcttaattacttgatttaccgatttatctaaatcaatcatcacaatatactcttgctaaattaataacattcattgagaccaataattctatttactctatttatagacctagttaacgggaatacgaatcaacttaccctgactaattcgacgagatagtcggaagcaagactacgggttccggttgacgtcatccaggggccttcttttcttcggtaatcaattgttgaagatcttttcctcgactgaatacttttgacgaaccgaacttgagtcgcgcaggatgtccgagatttttatcgcgcacttggtgaatattactcggctagcttcgtcttcacccgacgcacagaacgacgacgggattatgtctggagcgagctgacgaggtgggattgagcaggggatgacagaaggagggcgacataagagtgagctggatatcgacggcgaattcgcgaagatggggatccagtcgagctcgtgtaggtagaggtggtgtccgggcctatacgtgatgacggtcagcacaggcgaggtgcggcatctagcgaccagagccaggatacgacgtccacgagctagagcagattgtgcctaacaatggacggcgcgagggcgaggcgactgaacgacgacgacaagacagaaaacggggtgcgccgtggacgaacagggagctgagtattgagaggtcctggccgacggccagaccgaggcgatggcacgacagcaccacgaacgacgtgagcttcggccatcagcaagcgcagtatcgacggcgaggatccaccgaccgcaaacacctacactacacgcgacgctggctgatccagggacgcgcagggaacgcggtcgagcagtgagccggcaacgcacggccatggcaagggggaatctaggcgagcaaaggaacatcgagcaggaccgagcgccgtggcgagctggaagggcgcgcggccatcagagaagaagctgtgcgcggcgatgggagctccagcgagctggaggttgaagagagcgaaggctaggcggcagaatcctcattgctgcgcgcagggaaaacaacggagccgaggcacgacagccatggctcagcagagggaacgccgcgagctggagctagaagaaggagcacggacgggcgagacctcggccgactgggagaagcagggaaagaagctgctatgctgggcagagaggagcggccggcgcgccatgggagcaagggaaaagcactgcggcgagctcgagagagagaagcagaaagtgagcgccgccaagagaagggcacgcgcgccatcagagatccggccgggtgctggacgccggcaggggaggagcttggactgggcgcgacaggggcgagctccagggcacagacgagatccaaacagaggacggacttgggcagctgttggacgagcggacagggagcgccgtgagcagagaaacgcgcggacggccgacactccgctagagcgcacgccggcgagaaagaagggaagggagcacgtcgagggagcccgacgcggccagtgctccactcgccggacgagcagggagccagcgcggctgggcacggcagggagaagacgcagggcgctggtgagcttctgcgagctggactgaatgccggaatggctgggtgcacggggaagaagaagagagggaggagataaggccgagcgtcaggggagaacggcggcggaatcttcactgacggtgagcggcggccgtagaaaaatcagggtgagaacgatgacgacgcgtaggagataagctctcgtacagaaaaatctggtgaccagcagataagaaccggtcattggtaaaaaaaatctgagaggcagcaacaaaaaaatcaccacgggatagagatagagattggcgaccgaagatctttatatttttttttaatttctttcttctatcctttctacaaaataaatacagttacagaaactagtattttaaagatgaaaaatggtttgaaccaaaccgagactgacgacaatatttagatggcgtttaatttggtaaactttcacagaatcagataatctattgttaaatacttttatccgaatatgttgatcggagcgaattgtaatcagaacaattgagaacagtattccggattgtattccatttgatttgaaatcaataatttcatccgtgtatgaacacctggttccacagccacggataagttaccagtgaattggagctcaattagaatttctcggacgagctgtctcggttgtcgagtaggaaccgaattgtttaacaattgtttatatctgaagatttggatccggcgagaaacaacagaccgaaataaactgatttcggtattgacaatttgctccacgatttaactgaaatcagccggaaccatagctgcgaatgctcacgcgatttcgttgccaaaaccacgtgctgaaggaataaactgggtcataatctcgcgcacgatttttctcagacattgcacgatacagattattttcccccgacattttaatcgtcgagttcagctaatttgctcggaataaaatcgtccgagtggatcgagcttctaaatttcgtatccgcgcgagcgacgggttttaaataattatcggacgcaccgattttcggaacgacgatgttccgaacatcacgaaattttcggaagaccccggatggataaaaataaaaacgatgtcgcacttgcgacagacggaacagatgcgatcctaaaatcgcgatggcgaaaataattagaataaagcatctgttttattcactgatatttcgtgcgtaagtccatactcgttgtcgagcggaatataaacacctggggtgttaca

SEQ ID NO: 251 - DNA, 3024 bp, Zea mays
acgacatttagaaaagagtaatgaaagtggaaatataaattttcttccattatctattttttaattaatagaggccgtaactctgcaaaatagtttatcttgaaaaatctgcatattgcaattcaaatactttaaagttacctcattcttaaaaacactgaaattgaatcagcatgcgaccatctaaaaatgtgggtcccaaactcaagttattgagtgcgttgaattttagttgatggtggagcgtgtgaaacaacatgttggatcattctttaaatctacctcataatttagggtttcaaaaagcttcaaagtttttgcatggttcatgccacaatcttttcgaaaaaacatgcacgaaataatgaccctttactcacaaaacttgttgagtcatttttgtaaaaactactgttctaaacattacatcatttagggctttgaaccgcttcaaacttatattaatgtccatcaccatgaaacatttgaaaattttccacatatcttatgagataacatgcccaaacaagtgatgtttatggtttggcaatgaaaaaattgtaatgtaattttccttggttaaattcttttgtgataaatatcatgagtcccatacttgttttttgagtggccccaaaatatgcgttgttgtccataaccaagaatcattaaaaatagcgctacatatggtttaagatagcatgcctaaactgttattgtttatagtctagcatagcaaattgtaattaaaattggaatgaaattttttctttacttaattcttttgttataaatatcattgatataactgtaatagaataataacaaggaatcttaaaacatggatcgaaataaaagcagaattgcataaatatggctctcaactccggaaaattatcgatctaaaaaatatacatgttgcactttaaacatttctaaagttacctcattcttcatatctacacacgatagtgccagcattcaaacatccaatatctcgggccccaaactcattctataggttgtcttgcacttgggttgatgatgaagcatgtgaaacatgttgcatagctcacgactatagtaaattgatgatctgaaaaaaaatctacatgttgtgcttcaagcgcttttagagtcaccatccttcatatgaccaaatctagtgctagcatgtgacaatctagggtcgcatactcatgatatggttgtcttaaatatgggctaatgatggtgcatgcgaaaaaaacaagttgggcccatccataaaaaatgtctgtctaaacaatacaacatttagcgcttcaaaatgcatcgaagttgacgcacatctgaaatcgatatatcatgcagtaaacttgtacgaatataatacccattagtcccatactcatgttttgatcggccttaaacttgggttgatgtgttcacaactgagaaacattgcaaatagcacaatatatgttttaaggtaacatgcctaaacaagtgtgtcttttagagaagacaaattaaagtggaaatataaattttcttctattaactaattttccattaatagaggtcgtaactctacaaaatagtttatcttgaaaaatctgcatattgcaattcaaatacctttaaagttacctcattctttaaaacactgaactttaatcagcatgcgaccatctaatttgtgggtcctgtacacaagttattgattgtgttgaattttagttgatggtggagcatgtgaaacaacatgttggatcattctgtatatctaccccataatttagggctttgaaaagcttcaaagttttcgcatggttcatgccacaatcttttcgagaaaacatgccaaaaatcatgacgctttactcacaaatcagtgtattgcgaaaacattcataacaaaccttgttgggtccttttgtaaaaacaacagttctaaacattacatcatttagggttttgaaccgcttcaaacttacattaatgtccataaccatgtaacatttaaaagttttccacataccttatgagataacatgaccaaacaagtgatgtttacattttggcaataagcaaattgtaatgtaattttccttggttaaattgttttgtgaaaaatatcatgagtcacataattgttttttgagtggcctcaacacatgcattattgtccataaccaagaatcataaaaaataacactacatatagtttaagatagcatgcctaaaatattattgtttatagtctagcatagagcaaattgtaattaaaattggaatgagaatttttctatatttaattattttgttataaatatcattgatataactttaatagaataatatcaaagaatcttaaaacatggatcgaaataaaagcataattgcataaatatagctctcatctccggaaaattaccgatctaaaaaatatacatgatgcactttaaacatttctaaagttacctcattcttcatatctacaaactatagtggcagcattcgaacatacaatatcatgggccccaaactcaagctataggttgtcttgcacttaggttgatgatgaagcatgtgaaacaacatgttgcatagctcacgcctatagtaaattgatgacccgaaaaaaatctacatgttgttcttcaagcactctaagagtcacctcatcctttatatgaccaaatctactgctagaatgcgacaatctagggtcgcatactcatgttatggttgtctcgaacatgggttaacgacggtccatgcgaaacaacacgttgggccatctataaaaactgtctgtctaaacaatacaatatttagggcttcaaaatgcttcgaagttgacgcacatcagaaatcgatatatcatgtagcaaacttgtgctaatataatacccattagtccattactcatgttttgatctgccttaaacttgggttgatgtgttcacaactgaggaacattgcaaatagcattatatattttttaaggtaacatgcctaaacaagtatgtcttacag

SEQ ID NO: 252 - DNA, 3023 bp, Zea mays
gcaaagtagcctgttccggtagtgagcggctacgtgactccaaatgatgggtttgatagtttcggcctaaaaatcgcggacgacagatttcttggctcgagcctcaaaattagggagtgacagataaaccgacaagtggcaaataagttatcagcgaagcgaagtcttgaaaacatgaggaccgtaccgtcggatgcatatcggaaccatgagttagacaacgtctctaccatgagtttcatattttttttttggagttgacttgaattaattttaaaacatccagagaaagttcgcggctatatatatatgtgcatatcggatcgtctatatatatgggttgtgacccgtgttgtggaagtacgaggacctttacaaaatggagcgtcaaagtagcaatattttttttttacttagaacaaacccaataaagtcttgtttggacctctcgtatttatctaaatccacatgtattgtgatggattgaagcgtaaattaatttaagttctactcgaaaccattatcaatacaagtagattgaagtgaatactagagatccaaaggagttccaacggacgaagcactctacagttacagcagcaagcagttgtaaagacattatttgattagtttttccatgtacagtataagaaagtttgcttacgatataagcaaagggcgcaccgtaccaccaatcaccatagatagtgttacgtttaggtactgtacactacgtatatatgcacgtggtggtaactgcaggatgcccatggccatgcatgtggctattatattccttgcgtcgacacgtggcagttgccatttatttgtcacctatcggtacgtacgtgtacgtggcaaagcggtttgggtctggctggcgacatatatcgccgatagctttggtttctttccgcaaagcatatgcgctaccacgacggcggccacgtacacgtaaatatgtgtcaccagtgtacgcatgtgccgtgcatatgcagcttgacacgtggctgttatcttcagattaaagtcaactgtttaaactactgtagctgtaatctagcagcagcagctaggtatatatatacgtacgtatgcaaaccgagcacacacgcacatatctgacctggccttcataatgaataaactaaggcctcgtttgtcatagctctactccattattctctatctaattatgtagcaaaagtgacgaaaactgtttggcaaatagtatgtgaagtgattgctgatggactgaagagcggggagcaggaagcgacgagaaacaggttttttttttttggctcccactctttagtacaaaatagagactaggggtgttgtttagtttcacaaaatataacgtaaatagtgacggaaatgattcacactcgattaccaacgataacaagtttgaataagaccgtattagtttatagctagcgaggtatctgattacgatcggacttaaacaaatagagtttaacgttaccgggctaccgttcacgtcacaaaaaataggtgaaccaaacagcgcctctagctagattcactccgctcccaccgtttggatttgtaatgtttgactacgtacgtggaagtgattcgagagctgtcccgccctaaatggaaaaaaaaattaaaccgtggacggtatagaatgggttggacgccgtggcaagcaagcaacaccgaatgcctgcatgcatgatgcatggcacagtcaaaaggaccagctagcgagtgtaacgtgcctgcctggtgtactacggtttggcgatatgtatgcatgctaggacttacaggtgtatggactatggaggcttctcaccgccacatcgcattcaggctaaagcgaggcatcaagtcatcaacagctagctagctagctagtatagatgggacgcacgcgtacgagtgtcaacacgtgaacaattcagaatctacgacccccgggggccgggggctaaagcgatcgaggcatcagcatactctctctcggtttctttaagcatgtgtgataatgatcccgttattattgcatatataggagtgatgacgattccatttcaaagaaaagaccacacgtgcgttgaaagagatctgtgaatgagctagcagctagtagtctggaaaataaactttattcgattcgatcagagctcacgcacgcacggctgtcatcagccggatgtgcactgtaaaaagggaagccggccggcgaaagtccggtccgagtctgctctagcggcgctggctgcactgcacacatgcatggttcctgcttgcttgcgtctgctgcaggacgatgatgatgtgaggtcaattggattcgatcctcctcctccagtttttctttggagcagctagctgcaacaaaattccacagtcgcacaattgactacttatttttttggggaaaaaaagaagctcacttcaaatggtcatgggtcgcggtcggtcctgactcctgattctgctgtgtaagaaaaaggagggaacaaaaaaaggtaaaaactaaccaagtagacaagacaggtcgactctggctctctgaaacgctcatcacgcgccaagtggggaaaaaaacgcccgtggaactggaagatgcatggaccgtggttttaattttactttaccgcaggtgcattcgtcagctggcgtcgagcggcggcggcggcgtcgtccacctcggaaccgtccacagcagcctagccgccacgcagggagaaggagaagcactgcaccgagactcaactacgtacgagcgtgtagtcggcatccatgcactagtagcgcttatctctcccgttaattaattattaccatcaactgtagtgcgctagtagtgagtatagtggcaggaccagcgacagcgatcctacctgcccgaagttgaccatcgatcggcagaggcaccactagtagcaattcgcaagctactacgtacttgcgcagttgtgtacgtggcgtggctaggctggagaggatcacgtacttggtgcctgagcctgatgcaaacg

SEQ ID NO: 253 - DNA, 3021 bp, Zea mays
ggatcccggggtgttacaaaagagcaaattgtaatataatttttcatggttaaattattttgtagtaaatatcatgagtcccatacttgttttttgagtggcctcaaaacatgcattgttgtccataaccaagaaatatataaaatagcactacatatggtttaagatagcatgcctaaactagtattgtttatagtctcgcatagagaaaattgtaattaaaattggaatgaaattttttctatatttaattcttttgttataaatatcattgatataactataatagaataataacaaagtatcttaaaacatggatcaaaataaaagcgaaattgcaaaaatatagctctcaactttggaaaattaccgatctaaaaaatatacatgttgcactttaaacatttctaaaattaactcattcttcatatctataaactctagtgccagcattcgaacatctaatatcttgggcccaaactcatgctataggttgtcttgcagttgggttgatgatgaagtatgtgaaacaacatgttcgatagctcacatctatagtaaagtgatgatctgaaaaaaatctacatgttatgctttaagcgcttctagagtcacctcatccttcatatgaccaaatctagtgcaagcatgctgcaatctagggtcgcatactcatgttatgtttgtcttgaacattggttaatgatggtgcatgcgaaacaataagttgggtccatccgtaaaaactgtatgtctaaacaatacaacatttagggcttcaaaatgcatcgaagttgacgcacaccagaaatcgatatatcatgcagtaaacttatatgaaattaatactcattagtcccatactcatgttttgattggccttaaacttgggttgatgtgttcacaactgaggaacattgcaaatatcattatatatgtttaaggtaacatgcctaaacaagtatgtcttacagtacgacatttagaaaagagtaatgaaagtggaaatataatttttcttccattaactatttttccattaaaagaggtcgtaactctgcaaaatagtttatcttgaaaatctacatatagcaattcaaatacttttaaagttatctcactctttaaaacactgaactttagtcggcatgcgaccatctaattatgtgggtcccatactcaagttgttcattttgttgaattttagttgatggtggagcgtgtgaaacaacatgttggattgttctgtaaatctaccacataatttagggcttcaaaaatcttcaaagtttttgcatggttcatgccacaatcttttcgagaaaacatgcacgaaatcatgaccctttactcccaaatcagtgtactgtgaaaactttgatgacaaatcttgttgggtcctttttgtaaaaactaccgttctaaacattacatcatttagggatttgaagcacatcaaacttacattaatgtccataaccatgaaacatttaaaaatttcccacatatcttatgagattacatgcttaaagaagtgatgtttacagtttgacaatgagcaaattgtaatgtaatttttcctaggttaaattgttttgtgataaatattatgagtcctatacttgtttttgagtgggctcaaaacatgcattgttgtccataaccaagaatcatttaaaatagcactacatatggtttaagatagcatggctaaacttgtattgtttatagtctcgcatagagaacattgtaactaaaattggaatgaaaatttttctatatttaattcttttgttgtaaatatcattgatataactgcaatagaataataacaaagaatcttgaaacatggatcgagataaaagtagaattgcataaatatagctctcaactctgagaaattaccgatctaaaaaatatacatgttgcactttaaacatttctaaagttacctcattcttcatatctacaaactctagtgccagcattcgaacatgcaatatcttaggccccaaactcatgctataggttgtcttgcacttgggatgatgatgaagcatgtgaaacaacatgttggatagctcatgcctattgtaaattgaggatacgaaaaaatatacatgttatatttcaagcgcttatagagtcacctcatccttcatatgaccaaatctagtgctagcatgcgacaatctagggtcgcatactcatattatggttgtcttgaacatgggttaatgatggtgcatgcgaaacaagttgggtctatccgtaaaaactgtcaatctaaacaatacaacatttagggcttcaaaatgcatcgaagttgacacacatcagaaatcgatatatcatgcagcaaacttgtatgaaattaatacccattagtcacatactcatgttttgatcggccttaaacttgggttgatgtgttcacaactgaggaacattgcacatagcactatatatgtgttaatgtaacatgcctaaagaagtatgtcttacagtatgacatttagaaaagagtaatgaaagtgaaaatataaattttattccattaactattttccattaatataggtcgtaactctgcaaaatagtttatcttgaaaaatctgcatattgcaattcaaatacttttaaagttatctcattatttaaaacactgaacattaatcggcatgcgaccatctaactatgtgggtcccacaatcacgttattgattgttttcaatattagttgatggtgaagcttgtgaaacaacatgttggatcattctacaaatctaccacataatttagggcttcgaaaatcttcaaagttttcgcatagtttatgccacaatcttttcgagaaaacatgcacaaaattatgaccctttactcccaaatcagtgtattgtgaaaactttgatgacaaaccttgttgggtcctttttgtaaaaactattgttctaaacattacatcatttagggctttgaaccgcttcaaacatacattaatgtccataaccatgaaac

SEQ ID NO: 254 - DNA, 3017 bp, Zea mays
atttaaaataacactacatatggtttaaaatagcatgcctaaactaatattgtttatagttcggcatagagcaaattgtaattaaaattggaatgaatttttttctatatttaattcttttgttataaatataattgatataattgtaatagaataataacaaagtatcttaaaacatagatcgaaataaaagcagaattgcataaacatcgctctcaactccggaaaattaccgatctaaaaaatatacatgttgcactttaaacatttagttacctcatttttcatatctacaaactctagtgccagcattcgaatatccaatatcatgtgccccaaactcatgctataggttgtcttgcacttggggtgatgatgaagcatgtgaaacaaaatgttggataactcacgtctatagtaaagtgatgatctgaaaaaatctacatgttatgcttcaagcgcttctagagtcacctcatccttcatatgaccaaatctagtgctagcatgctgcaatctagggtcgcatactcatgttatggttttcttgaatatgggttaatgatggtgcatgcgaaacaataagttggatccatccgtaaaagtgtctgtctaaacaatacaacatttaggttttcaaaatgcatcgaagttgacgcacataaaaaatcgatgtatcatacaataaacttatatgaaattaatacccattagtcccatactcatgatttgattggccttaaacttgtgttgatgtgttcacaactaaggaacgttgcaaatagcacaatatgtgttttaaggtaacatgcctaaataagtttgtcttatagtacaacatttataaaagagtaatgaaagtggaaatataaattttcttccattaatagaggtcgtaactctacaaaatagattatcttgtaaaatctgcatattgcaattcaaatacttttaaagttacctcattcttgaaaacgctgaactttaatcggcatgcggccatctaattatgtgggtcccatactcaagttaatgattgtgttgaattttagttgatgcagcatgtgaaacaacatattgtatcattctgtaaatctaccacataatttagagcttcgaaaagcttcagagttttcgtatggttcatgccccttgtactcacaaatcagtgtattgcgaaaactttgatgacaaaccttgttgggtcctttttgtaaaaactaccattctaaacattacatcatttagggctttgaaccgattcagacttacattaatgtccataaccatgaaacatttgaaaattttccacttatcttacgagataacatgccaaagaagtgatgtttacattctggcaatgagcaaattgtaatgtaattttccttggttaaattgttttgtgataactatcatgagtcccatacttttttagtggcctcaaaacatgcattgttaaccataacaaagaatcatgaaaatagcactacataaagttaaaaaaatagcatgcctaaaccattattgtttatagtctggcatagagcaaattgaaattaaaattggaatgaatttttttctatatttaattcttttgttataaatatcattgatctaactgtaaagaataataacaaagaatcttaaaacatggatcaaaataaaagcagaattgcaaaaatatagctctcaactctggaaattaccgatctaaaaaatatacatgttgcactttaaacatttctaaagttacctcattcttcatatctacaaactatagtgccagcattcgaacatccaatatcttgggccctaaactcatgctataggttgtcttgcacttgggttgatgatgaagcaattgaaacaacatgttgcatagctcacgcttatagtaaattgatgatctgaaaaaatctacatgttgtgcttcaatcgcttttagagtcacctcatccttcatatgaccaaaactagtgctaacatgcgacaatctagggtcgcatactcatgttatggttgtcttgaacatgggttaatgatggtgtatgtgaaacaacacgttgggtccacccgtaaaaactatctgtctaataaacaatacaacatttagggcttcaaaatgcatcaaagttgacgcacattagaaatcgatatatcatgcagataacttgtacaaatataatacccattagtcccatactcatgatcggccttagacttgtgttgaagtcttcacaactgaggaacgttgcaaatagcacaatatatgttacaaggtaacatgcctaaacaagtatgtcttttaaaaaagagtaatgaaagcggaaatataaattttcttccattaactattttccattaatagagatcgtaactctgcaaaatagtttatcttgaaaaatctgcatattgcaattcaaatacttttaaagttacctcattctttaaaacactgaactttaatcggcatgcgaccatctaattatgtgggtcccatactcaagatattgattgtgttgaattttagttgatggtggagcatttgaaacaacatgttcgatcattcagtaaatctaccacataatttagggctttgaaaagcttcaaagttttcgcaaggttcatgccacaatcctttcgagaaaacatgcaggaaatcatgaccctttactcacaaatcagtgtattgcgaaaactttcatcacaaagcttgttgggtcctttttacgaaaactaccgttctaaacattacatcatttagggctttgaaccgcttcaaacatacattaatgtccataaccatgaaacatttaataattttccacatattttatgagataacatgcccaaacaagtgatgtttacagtttggcaatgagcaaattgtaatgtaattttccttggttaaattgttgtgtgataaatatcatgagtcacataattgttttttgagtggcctcaaaacatgcactgttgtccataaccaagaatcatttaaaataacactacatatg

SEQ ID NO: 255 - DNA, 3013 bp, Zea mays
gattgtctcgtgggctcggagatgtgtataagagaaagtctcaatgccacgctcaacacgatccaatgttccttccagcccgtcgccgtcagccttgaacaattgcatgtccgcgagattgagaacggctgcgcacggagcgtcggaatcattttgactcagtttgcgcggcagtgagtaagacctgagccgatcctgcgcggcttcgatttcctccaccgatacaagatccgcccacgtctcaactttcggccttacgcgattcagcttgttccatacgccgccgctggggtttgtcgtcacaccccagtcgaacgagaccttttctggatcctggcctttagcgcggatgaagttgcagaagtcctcatagccccacgcaacctcgctactgatggtgtacgaatcggtcagtggtcccgtgccagatgtggacacaacctcgttcgcagctttcttcctcagccgatcctctagcgctcccaagtgtgacccgccttgagcttttcgcgcatggtcttgaccattgagatgctggcatgatgcccaacggacttgagcgcttcggctatgacggtagggccaatagctagattctcgaccgcctcacgtagcgcttgcttatcgtcatcatcgagcgtggcgtaaatcttttccagcgcgcatagtgtgcggattggctcggcttgctttgcgagtgctgcttttaggctcatggtgtccctctcatgaaaaaggccgccctagttggacggcgcttttggtttatctaaagaatccagttgatattcggaaccgtggtgattccacaacttccgcaatatgcgatcaatgagcaatcaggtctagggtcatcgtcgccgtgatagtcatcatgcgagtaccacggattcatgcagtcccagcagcgtctagtaacgcccatcttcttgatctgccgatgctcgaagttgctcttggattgattgcagtcccagcacatgctcaccaggttgtctgacctatcggagatgaccggaacatcttcagcgaggaatgctgagcgcgggatgatgtgatcaacagcgaaccgcgcatgactcccacagtctcggcaaaactcaccgtcgcgctggtggatgattgcgcgcttcaccgagtcaatcggctctcgtagctcacgattccgaaccggccagcgcttcggagggtcaagcttcaggtcaagctcaccgaagaattgcacgtagtcaacgtcttggcggactctcgatgcgtcgtagtaagcggttatgtcttggatttcagcaatgagtggcatattccctacattccaaatctggctgcttgaccctcgcgggccatactgttgacggatgcgaagtgcggacggaacaccattcgcagattcgcctcttggccgtggcggttcttgcccacgatgaactcgatttccgattccttgtctgacgttcggtgaagcaagatgatgttgtccgcgaatgcctcgatgccgccagactctctaaggtctgacacaaccggcctcgcgtccgtcctgctcgccgaattcctgttgacttgagcaagtgccaacacatggatattgaagtccttagcgagcgccttgcagtctccagcaatgcgcgacacttgccgctcgcgtgcctctgatcggtcggcgggttcgacaagttggagatagtcgatgatgactaacttcaaatcgccctgccgcttccacgtccttacggcggcgcgaatcttggacatgctcatggtcgagttgtcttcgatgtacatgggccagcgcgatgacttctcacttagagcttcgagccgttgcagatcctcactcgtgagtcgtgaggttgtgaagtgctccaacatcactccctgagatgccgcagccattcgcgccacaacctcttcttcgcgcatctccagactgaagaagcccacaccgtgctcggcggcagctacggccgcgcaaccggcaacgagtgacttgcccacagccggtcgagcgcccaccacggttagctgtccaggtttccatccaccgttgagcgtgtgatcaagttcaggccagccggtgttgattccttgtggccgtggatttgtccacacgtctagcgatgacttcagcgcgtccgagaatgtgcgcacgcgaactccgccagtctttgatgcagctcggtcgagttcggagcgagcgttatctaggacttgttcggcggattcccattgcgccgtctcagatgcattggtgagtactccagcaacgtctccgatgcgtcgtaggctcgctagtcctttgacgatttctgcatagtgtggagccgctgcaaccgaggtgatcattccaaggcattggtgaaggtagtcggacttgatgccaccgatgccgtcaccgacaagctggttgctaatcgtgatcgggttgaccggcttgttattgcgccgctcttgggtgaatagcttccagagttgttcgtgggctggctgaaagaagtcatccggattcacggtgagttcatcgagcacacgttcatcgagtagcaccgagccgatcagcgcccgttctgcgtcaagatcaaacctctgttgcattctggcctccgatctttgctagtgcgagttggtagcgctcttcattgtgtttgcgtcgagactctttcatccatgcgacttcttcatggagtgggagaccttcgggtggattcggtttcgtccagtagtccacgccaagaatgctgtccacatcgagttccccagcttcagttccgggggttggcttccatccatccttttcgcgccactgttgctttttgagcatgtcgttcttccatgtggcttcccagttgattttcttgttgccgttctcgcgccagtagagagcgaactctgttgatgcggtgtggacgttgacggctggtgttgtcttagccgcccagatcttcatttcgggagtaatgagaaatggagttgggatcgagtggggttggcttggtactggtgtcgccctctcttc

SEQ ID NO: 256 - DNA, 3013 bp, Zea mays
cggaacagaaatgggccgaggggagaggggagcggcccaagcgccagtaacctttttttattcttttctgttttagatttctatttcaaatttgaattcaaatcagagtttcaaattctggtctaaatgcagcaaccaaaatctcgacataagtgcaatatatacttattattattacattttatattaactattgtatttcaaatgatacaaatgcattgcacacacacaaagaactttaattttcaagagatatattgtttgttcaattaaaatcttattccaaactcagtgttttatgtttatttattttgttaagtcttatgaagaatacttctgaacatataattcaatgaactattaatttaagtcttatgattatttattttgtatgattacccaaaatatgatttgagctgttatatcaccacatatgtcaaaataaagatcttcacactattgtcctcaggaggatcttcagactaaaacaaagtccccttcgttctctacacgtagtaccgacccaatacaacgcgggaggcccacgaccattaccgacgagaccaagtgcatggtctatggcggggttctgtggcgacgagggacggttccgacgagctcactgcagtagtagcaaacaaagcaataggtcggtgagctttcacgtccatggaggagggcaaaacgaggtacaaaagggatgcaacctaccctagttgacccggccacagagacgctcatggctcaccagtcaccactacggagccgagaacggcgatggggaagatgacacttctctggagtttctaaagggagtggactggtttgcacgagctctagggtgcgcaaagggatggggaagcattgccttggctcaatttaaaggagggcggtaggaatccgactgaatttcaaaaagatctcgtgctctcccgccgtgctggcgagcctacgaaggtgtagacgaccacgacgagagcaagtagtgaattcaccggccggaacggtgacaccgtactcatgtttgcatgcgccgtgtagctagaggaagatatttacccttgcacacggtgagagcaagtagtgaatggagtaacggcggtgtcattatccacggttcagggcccgttggttccatctggaaccagcggccgaaataattctggggtggaatgattcaaaccgttgatgatgtaaaacaaattttgcaattcgttgatgatgtaaaacaaatttttttggcaaaccaaactacggttactgatactgatctgtacgtgttcaacaaacagatggtccatctcagccagagccagccacaaaggaattcagaacacagattttgcccaaaatgcaaagcaaggaagatacttttgatggtgatggtactaaagaggactatgttcgtatctacaaagggtagtctaagtgacatgcagtcaaaaactctgaaggcaggcttcgtaagcttttggctgcacttggccgcaaacactattgttgaattttgtgatgttgcagtatcattttttttattatcttatatgaaaatagccaaactcaaaagtctactaaagaacataaactgagcaatgctgctgcttcaagaaaaagcttatcttcttatatgtgaatagtagttcgtgtaggttcaaaccaattcacaattttgcaaaagtaatgggaatggagccttcaaagatactactattgttcacccaaggttgctagatggaccaaatgaggagcagacgaagctcaatatgactgttcagcagctaaaaagaagagaagagcaatagaagagaaaaggtgatttgtcatccttcttgtactaaccagctggtagccacatttcacatggctacgtcaattctcacagtggcagcataaaaaaaagacgatacatttggtccatatataaaataacctattatagcatactttgtttaagaatattaatataaagcaaaatagaacaatgcatctagaagatacttcattggccttcttacaaaaaaaggggtgatcctaaggcgatcaaggtgcacagcaattatcaatacaaacaactcaatttgttatagaaagcccgaaccagaatatcggtccacgaacgaggcacccaccactacgttttttttttgcttcttttttgtgtaaagcttttttttttgtaaagctgatacaaaagaagcgtaaaactgtgtataatttagcgtaaactactgataacgttatagtggcaagagatccactattctagcgtaaaacacacgcacgatctgaggtggcgtaaagttgatataaaagaaatgtaaaattgtctattttggcataaaactaatacaaaagataaaattatgtataatttagcataaactatagctgacattatagcaagcaagagatccactatttagggcataaaagtcacgtgtctctcacttcgaaggaggttgccgtaaaatgcataagaaatgtcataaaacgcaacaagatgacatttagggtaattttagcataaaacataacaagtgtcataaatttagcattgatctgatacatgtttattcaacaattgccgatgtctatacagatgcgtacaatgaccagtggtttccacataaaatgcgccagcgttattagctgaccgaagagataagcaccctcttttttctcttgttttttctctcctctacctagtattgttatgatgtggtattccttttcgctagcagccttaatatacaagctccaataagaataagttgggaagataaaagtaagacttatgttctagaatctgaatatctattgaaacactgatattcgaagacttcttaacgtgcaaataaaacttcagatcagcactccatgaagcaaattaaaagaacaccaccagcttagccggatggtctggctctataacaatttcttcagaaatgtatcctgttcacgacatggtaaaaacagaaaacagaatcagaataacacatatgactgcattgcc

SEQ ID NO: 257 - DNA, 3009 bp, Zea mays
gtctccacaccaatggttttgctctgctcagcggctatggcactctgcggtaggataattattgttgcggggtgcagaggttggggatttatattccagggctgagaacttcaacaaatcacggcaagatctgttagaccttgttcgtttgtgttggattgatggtctctaattttaattagattccgggtccaatcccacaggcctggcctgatccgagcgggtccgccggctgaccccgacagatgcgcgcgcgcgggtgagcagtacccaagaaatatggctgaccccgacagatgcgcgcgcgcgggttagtattcttctgcatggagtgcgatgaacttcttgtggactacaagcagtggtgtttgtgttacctactggttaaatatacttcaggtgccattagtttgattatgatggacgatcaattaatgaacgtatttatgttatttttgtcatgacatggaaggatactaaaactaaccgtggaacattgtcctttggaaaatgctagaacattgaatctgccggacctttccttccaacacttaaccctcctcgtgttcccgatcatgtattgctaaaatggcacactagccacccgattccttccatgcatggctgctgcaagggctactcttgagctcaatagcatacaagggaagagctactcttgagatcaaactgaaattagtttaggctgggaaagcagtaactttagggttgcttggcaagaaatgtgaccttttggtgaacccgaagcccatgatcgtcccatcatggactgaggccggcgtacgatatatggtggcaaaaaatctaggcaaattcataaccattggtaacttcaggtgaggctgcttcaattctatgaactcgatcgtatataattaaaatccctgagaatgcatgattctcactcacgtcagtcttctctcttctgcacagcatgctcgaagatgggggcacttctcttagttttggcaaaatatgttttgcatgaagtcttaaggagaaacactatatcaaaagctcgtaaaaatatctctgcacactatgacctggtcagtggatttagttatttattttttgtctgaaaaaaaaaatattattgacatctctggttggaattttctgttactattctacttatgtgatggaatcaatatcataaatatctctaaatttgttctgtccgtccacatgctacaattaaatcagttgtacacgtttctagtgtaaatgaacaaagtactgtcttattttgaaacataactagtatttgtaatgatttctttgctctttttctggatccgacgatgacttactcttgtggtattttcaagctaaggtatggaattaattattgtggcgtagtatgttatgtagctagctcttcactcatgaacgtacatgtacatccctaaacatataccacgtgattggttactaggccgcccacgtctaggccgctcgcgcgcgcgttgactacgctccagtgtattgattgtatagtatatcctcacggagacaatataattattttttacatcacctagctgcatccacagagaagtgagcggagcgcgtttctacagatccagggtgtcgtttggttcacatatttgtaacacaatgggtaactgataacgttaaatcatgtttgttttagtccaaccgtaatcagatactatactaaaaattgataataccatagtaatcgatagtaaaccgttaccattaccatttgcgttacattttttgaaccaaacagcaccaggttccccgcgagccttgctcttcaggagccagcaaccaatcacgtagataccgtttgatatttgtaggcggaagatgagagtttagaagcagcgcagctacgtaaacttgacaatctaattaattagtaaggtaaattcatcgtaatatataatatgcatgggttgaactctgccatcataatttgctgatttattagataatttccatattaaccactgtgttgaaggctaaggtggatccccggattccggggcatcatgtccttgacattggctgtgaagagaactggctgcaagtgcacaggaattacattattatcggaggagcaactgaaatatggaaagagaaaggtgaaagaatttggattagaggtcagttaattacatttattccctaaatattaggtagcattaattaattggaaaagcaaacaccatcacatgtacgcacgtaagagaaaggtgaaagaatttttagtgggatgcagtactaataagctagctaggcctccgccatgatttatcagttatttattgagtactcgatcctctgcactgcagcatacaccacgttgagaatattgggtaccacactattacccgactctgattcactggagggagaactttgaggctaatgaagagtaagtagtactggccctaatataactcaacctcggctacaagctagtgatttatttacgtcattcaatcagtaatacttttaaccgagtgctgtatgtgtacaacatgcatgcatgcagatagtgtttgctcgcgcaggcgatgcgaagttgccgagctatatatatgtcgccatatattgcgtaaatggaggaggatgtcgtgtttatgtgagacagaacattgtattttctttgttagttaggaagtccagttgaacttattatcgtgccctcgtcaagtgagtgtggagccgacgatgcacgtatgtgtttctgttagtggtgatttgaatccctgtctgggcgccgcgggtgaccgatccgagcagtgatcgccgatgcatgtaccagtgttgcgcgtattcatgacaatgaactgaaagcgggactcagaattcctggacaaatcgagcacatttatgacagaaccagccgcataggagtgcaagccaaaaaaaaaacccaacacaaaccctcacctcctaacaacaaacaggggggccgccgccaggggggttcggggctagggcggggggggg

SEQ ID NO: 258 - DNA, 3009 bp, Zea mays
cattgatataactgtaatagaataataacaagggatcttaaaatatggattgaaataaaagcaggattgcataaatatagctctcaactccgaaaaattaccgatctaaaaattatatatgttgcactttaaacatttctaaagttacctcattcttcatatctacaaactatagtgccagcattccatcatccaatatcttgggccccaaactcatgctataggttgtgttgcagttgggttgatgatgaagcatgtgaaacaacatgttgcatagctcacgcctatagtaaattgatgatctgaaaaaatctacatgttgtgcttcaagcgcttttagagtcacctcatccttcatatgaccaaatctagtgctagcatgtgacaatctagggtcgcatactcatgatatggttttcttgaacatgggtcaatgatggtgcatgcgaaacaacacattgggtccatccataaaaaatgtctgtctaaacaatacaacatttagggcttcaaaaagcattgaagttggcgcacattagaaatcgatatatcatgcagtaaacttgtacgaatataatatccattagtcccgtactcatgttttgatcggccttaaacatgggttgatgtgttcacaactaagaaacattgcaaatagcacaatatatgttttaaggtaacatgcctaaacaagtatgtcttttagaaaagacaaatgaaagtggaaatataaattttcttctattaactaattttccattaatagaggtcgtaactctgcaaaatagtttatcttgaaaaatatgcatattgaaattcaaatacttctaaagttacctcattctttaaaacactgaactttaatcagcatgcgaccatctaatttgtgggtcccatactcaagttattgattgtgttgaattttagttgatggtggagtgtgtgaaacatgttggatcattttgtaaatcgaccccataatttagggctttgaaaagcttcaaagttttcgcatggttcatgccacaatcttttcttgaaaacatgcaaaaaatcacgacgctttactcacaaatcagtgtattgcgaaaacattcataacaaaccatgttgggtccttttgtaaaaacaacagttctaaacattacatcatttagggctttgaaccgcttcaaacttacattaatgtccataaccatgaaacatttaaaagttttccacataccttatgagataacatgcccaaacaagtgatgtttacattttggcaataagcaaattgtaatgtaattttccttggttaaattgttttgtgaaaaatatcatgagtcacataattttttttagtggcctcaacacatgcattgttgtccataaccaagaatcatctaaaatagcagtacatatagtttaagatagcatgcctaaaatattattgtttatagtctagcatagagcaaattgtaattaaaattggaatgagaatttttctatatttaattcttttgttatagatatcattgatataactttaatagaataatatcaaagaatcttaaaacatggatcgaaataaaagcataattgcataaatatagctctcaactccggaaaattaccgatctaaaaaatatacatgttgcgctttaaacatttctaaagttacctcattcttcatatctacaaactatagtggcagcattcaaacatacaatatcatgggccccaaactcaagctataggttgtcttgcacttaggttgatgatgaagcaagtgaaacaacatgttgcatagctcacgcctatagtaaattgatgatctgaaaaaaatctacatgttgttcttcaagcgctcttagagtcacctcatcctttatatgaccaaatctactgctagaatgcgacaatctagggtcgcatgctcatgttatggttgtctcgaacatgagttaacgatggtccatgcgaaacaacatgttgggccatctataaaaactgtctgtctaaacaatacaacatttagggcttcaaaatgctttgaagttgacgcacatcaaaaatcgatatatcatgtagcaaacttgtgctaatataatacccattagtccattactcatgttttgatctgccttaaacttgggttgatgtgttcacaactgaggaacattgcaaatagcactatatatgtttttaaggtaacatgcctaaacatgtatgtcttacaagacgacatttaggaaagtgtaatgaaagtggaaatataaattttctttcattaactatttttccattaatagaggttgtaactctgcaaaatagtttatcttgaaaaatttgcatattgcaattcaaatacttttaattctttaaaacactgaactttaatcggtatgcgacccgctaattatgtgggtcctatactcaagttattgattgtgttgaattttagttgttggtggagcatgtcaaacaacatgttggatcattctgtaaatctaccaaataatttagggcttcgaaaagcttcagagttttcaaatggttcatgccacaatcttttcgaaaaaacatgcacgaaatcatgacactttactcccaaatcagtgtattgcgaaaacatggatgacaaatcttgttgggtcatttttgtaaaaactaccgttctaaacattacgtcatttagggctttgaaccgcttcaaacttacattaatgttcataaccatgaaacatttgatatctttccacatatgttatgagataacatgcctaaacaagtgatgtttgcagtttggcaatgagcaaattgtaatgtaattttctttggttaaattgttttgtgataaatatcatgagtcccatacttgttttttgggtggcctcaaaacatgcatttttgttcataaccaagaattatttaaaataacactacatatggtttaaaatagcatgcctaaactaatattgtttatagttcggcatagagcaaattgtaattaaaattggaatg

SEQ ID NO: 259 - DNA, 3006 bp, Zea mays
cgattaaaactcttcttagtcaaaattaaatagaaaataatttaatactcctcgatctccaacccaacacagccattggtagccaggatcaactctaacgcacacatccacgaaacccgcgcacatctcaacgaagagaagcgttttttttattcctgtttaatgcaatgtaataacaagtcttatgtacagttgcaggctacaggcctactcccactgaaaagaatcgccaccgaaccatcacgactctgccaccgccagcgccacagccaccacgttctgcccggcatccagttcttctgacaccgcgttctggtcgatgaagttgaacagcgcgagccccgcggcccacacgtcgttgtccatcaccgactcctccggcgagtggctgatgccgccgcggcaccgcacgaacagcatcccgatctgcgaccacacaatccggagcgtgagcgagctgagcttcactattcagcacactagtcaccgccaacctcacattcgttcgcacgcatgcttcgtcttcttaccttggtgagcctggccatcgccatcgcgtcgtgccctgcgccgctcatcagcacgggcgtctcgccggccgccacggtgcgccccggcattgccgacacggtcgaccgcgccgcgcgcttcagctgagacgttaactccgggtcgcagtgcgtcgctgccgccgagtgctggtgcaagcgacatcaaggtcagactcagttcggcagcacaaactctacaccggcagatatcatgagccatgacaccaagagtgctgattcggtgctcctcctcaccttatgctcgaccttgcaatcgaccagtctgtcatcgcatttctggagaacaagcctcgagaagctcgtcacgatcgtctccctcacttggtcgtccatcgcgcggatgtccaccgtgaagtttacctgtcgtgggcacagctccaaggttcagctgactgatctgagccaccagttcatcagcagggccaagaagagtagtgcttggcaagcttacctggcccggaatcacgttgctcgcgcttggccacgtgttcagctcgccgacggtgcacaccaggccggccagggactcctcagtgaagcagctgcactcctcgtcgtaggtcagcaaactgttgggctctttacagaggcgttccagagtcacaacgagctctgcagctgcaaccatcggatcacggcgcaatttcattggaactgtgccagcatgcccttgcgaaccatctactattacctaggcaaacaaaaacaaagactaagcgctgtaactactttccttctcactcgaaagcttggtatacaaagggacttggaagcaacccagaattattaatgacagttgtcgtgggcagcttgagtatttaaatgtcaatgttaaactgaacaatcttggtgacagcaatgcctgtcttcctgaacattaattaactaagacttgttcttgcatcaaagatgacacatgacataggtgtgccaattattgaatgagatggatgttgactaataccccaggtgtttctctgattgattgtttatccattacatgcacatacttggttaacttaatattgaccactcataccctttgctaagagaacactcctatctagaattatttgattgcttacctgttgactgctatactgtcaccttatggttatctaatataaccggtacttcttttttctcagacacatatagtaggctctgatattgattgttttataaggaaagaatgaccttacggtaggaagccatgcagctagaccatattttagttttgtaaatgtagttcttgaatagatttcacaagaatagcagagaactccgatgcaccttcaatcgtgtctgtcctgcaattccttttacaacaccaagtggataatgaagggcttccaggacagggccttgctccatgtgtacctacagtttttaaaaatatatatatgtgatgtattctgtattaccaggcaactacatgaaaaaaggcatacgaaggcttcatacctcaacataactccccacagactccgggttgtacctggcttgactaatagcagtagaggtagcctcaaaagaattcattttcagaacatcttgtagtgtagtgccactgatgaaactcaatacaacaaatgaactgcatcagagacagttctgtaaaatagttcggttggttcacgcgaaaaagacaacacctcttatctgatacttgtaaaattgattcaggtagtgtaccagctacagcagcgcttcccagaaaagttgtctggaatctgatgccctcctcatcgctgaatgcaatgacctaagcttcaaaaaggaaaaatgagtgctaggctccgccatgatgatttttccaggtgacgataatgcaatctaactaatgctgattcataatttgataaaaaaaataatcttcaagccactttggattagagcgttgaagccatacagtgaagaataaaccatgatttggttcacaccaaaacatgccgaccttgatctatagatgatatctagacatttgtttactgaaatgcatgacacaacctgacaacttgtgcattttgattatcaggattgccagaataacaaaagatgaaccgtgcacagaatcttttcaagatctgtaggaggtacgtcgaactgattaaaggggcattataaaactagattcctccaggtttctatagtctttcctgattatattatgatagtaataaagaacctactaggtaccttgcagcttagctatccaatcagcatcaaaagtacaatatataattaaaactgagtaaaatataataactctatgcctgctactggcaataaaacaatgtgaaatattccaatcaaacaaataaaagagtagatggacacaaacaagatcaatgcagacaagtgcgggtctacaagacgtatgtggctcataacgccacttgtagagagcgagaatagtggacaagttgtcgcg

SEQ ID NO: 260 - DNA, 3004 bp, Zea mays
aacatcatcctgcggattagcctgtgcttggggtcgacttgggtcgtctttcgtatcgtgcgattaataagcatacctaaatgatttgcataatgcacatgaatgcatagcactgacttcactgcacaactaaaattcttcgcatgaaatgccgatagcgcctaccggcaaagcactaaaattactaagcaaataaatccagcttacccgcatccaacgtgacttaatacttgtgagaatgttgataaatcctggctcgacttgtcgttgaacatcttacgggtgtcgtgcggcttcactttcttctccataccttccgttgatttctctcaaacaagcgacgatcgacgaggatcgcgaacatgacgagagggcgaaaaccatctatcacaacaactctctctaccccgcaaacaacatctaaaacagccatatgaagcagtgttgagatcttccatccccatgacccagatggggctgaccatggagaggcgaaacacgacgagacgcatatcgaaagagttactgggattaaagctgacaacacgcatcaaggcgaggcggcatatggtagggaaaaattggaacggacgacgacgagggagcagcacgactgtgtgggacttggcgaggtggaggtgtgtagctgagtaacgctggtggagcttgctagtttgacacggggaggaccaacaaggtcgacagtcagtgagactagataatggagcgtagtccagcaccaaattgacgacggccacaagaagggcaaagacgaggtcgagcaaggtaaaacgggttcaacggctcgacggcagacgcgagcatgcgcgaaacccgatggatgagagcgggtgcgccgcagtgacaacgagcagacgcgcgagcgttaacgcgacccagcggcaagcacgagtgctgaggtacaaccgacaacactcggcaaggacgcaacgaagcacacaaccgcgacgactgtcgaatcggcaacagagtgttggcgaactcgacgaacacgaccacggtcgcgtactgacgcggataggacaacgacagttgacgagttggagcaccagcgagtagccgacgcgagaagcaaagcgaggtcactgtcgggcagacttggacacaagcacacacagtgtttcaccgtgtccagcgtgcgcgttacggactcgatgtcgactgcgagcagtttcgcgtgcacgacaacgcgacgaaggagaactgaacagggagcttcgcggcagcacgcgcgcacgaacaacgtaaggctacgcgcgcgacgaggaagcagaaagccacgacaagggagtgcggcaaaatcctgggcacgacacagggaaccggccacggcgagcatagggacaaggcaaggcggagcgcgcgtcagggagaaacaccggcgacctgcgctacaacaaagctggagcgagctgggcaggaagtcgagatccgagcagagcaaacgcaggggcgcggcaagaccaaatccgagctgaagcagggaagaccgcggcatgggaggaacggctggagagcgacccggagttaggcgcgcagggagctgcagccggccatggagatggcgtagggaaccgggcagacgccagggcgctggggctgggcagaacgcaaaggaactccaggagagagagaagctgctgggcaaagggagctacggaaggaccgcggcgagcagagggcttcacgcgctggaggagtaggagccaggggcgcggctggcgtccatggggaagaactggagggagagggaagcagggaggatgccacggctgggagctgctcgcagcagcaggcgcggtaccaagcacggccatgggagcaggccagacgcgcgtcgcgagtagagaaaaagaaagtggagggaggagagaggagcacggacgagagccgctcgactggggagcgcgcgcacagggagcgttgggcggcgagatctgggaagagggagcagaggacgccggcgccatgggcgagcgggggaagtaccgcgcgcagggaaggatcgagctgaaggaagatgacgcggtggagaagaaaatagactgggcagcgggattttatcccccggcggctggagatcttttctccgctgagcggcggccggatggctgaaaaagaatcggagaaggggatagaaatggaagaaggccagctgcgcgtgaagaagaacgacggcgggatttttctatccacgaactgaacggcggctgagaagatttttcccccgcagatgaatgcgcgcaggtaaaaatttggtgaagataagcttcacgcgagaaaaatcagcaggaggcggttagaaaaatattttcctttttttttcagattttcagaaattcatagatatttttgaatcgggatttttagcgacaaacaaatagtcgtatgcacattattttctcggatcacgaaacggaacatctgaggtttacgattctgactaaatttcgattagataatttttgtgactatttcggccacgatgtaaacggaccagattgacacgagttcggcttcggtattttaatctgcgtgattccactaatattagccgaaatcatatctgctgatgcacgtcaaaacagcctgcagaagggtaaattgaatcatatcctggcgcacgatttcactcagacgacgcgcgatcccaattattccgccccgaatattttagtcgtcgagttgaaatgaatttgttagggataaaatcatgaaagtgggcgggcttgccaattcgtattcgcgcgagcgatgaatttaaataatcaccggacgcaccgattttcggaacgacgatgttccaaacatcacgaaaatttaggagaggccggataaataaataaaaacgatgtcgcactagcgacaaatggaacagatgcgatattaaaatcgcgataggagaagatgtttaaaatttagcatccattttatccactgatattacgtgcttaaatccatactcgttgtcgagcggaatatg

SEQ ID NO: 261 - DNA, 3003 bp, Zea mays
gattattacttatggcaacactgcccttagcttttcaggttagtaaaatttcttgattcagtagcacatgttgatagtacaacaacatgattcagaatttattactgttgccactggtgtacagttgttcatattctacatatgtaatcacttcaatttgtaacgagttacctgttgtaaggtttcaaatatttgtgatcaccaaacaaaatgggacggagtgcacttacaaatatatcaaatgagaataacaaaggttcatactgatatgtttccatgtcttcgtttaatactgataatatcgagctatttaaatatcttaataaatctgcccccacaaccagtgatccgatgacgaagaacgtaagagggaggagaggaacagaaaacaaagagaatactatgcacggagaaaggctgatgaaaccacagaagaaagggagacaagaaataaaaggatgcgtgattaccgcgcatggaagaaggctgagacaggtatcccctatgatcttatactacattctattgttttttaacataattcatctgtctattgtagtgctatgctcgcccgaacagtcccaacgttttggttttggatcttcgatcgtaatgcaagctcctggaggggacaacacacatgtggcacaggctgagacgccgtatggtacgagttgcttgttgcagacaccatgttcaacaatttctcaggcatccagattgcaatacatggactcaattggtccaagtgatcccatggagtggctacataccaatgattactacgtccgacattatcaatgaacatacagtgaatatggtgacgaaatatgtagtacgccagttaaaatgggaacaagacgacagactgcgcttactgatatatctaaccaaattatcacaggttcatgcataatcaaaccaagtagcacagtcttttcattttattatttattactgatgtcgaacattttttaaatacagatatggccccacaaccaggtccgaccgatgaacatgagcgtcatcgggaggagagggatagaaaacaacgagaataccgtgcaagaagaaagctgaagaaaccaacgaagaaagggaggcgagaaataaaagaatgtgtgattaccgagcgaggaagaaggatgacataggtacttcctgccgagaattaacatcgtcctattttttagttactaatactcattcttcctcttgcagtactatactcgctcagacagacacaggcttatgctactggatcttcgatcgtaatacaaaccacaaccactggagacgataacaggaaggtggcagagccggtaacgcctgatggtgagaggggctctttgcaccaactgccaacatcaggggaaccatgttcaaccatttctcaacattcaacctataatcaatacggtaggaattcgttgttataattactacttacataatttattatttgatttccgtttgtctttagcaactactgcatctaccatgggcaacctcataatgaaccgagcgaggtacatcaatatggatgatgcggataaagaaattcgactgcataagcgacgtgaatacaaaaagtttagacaatgtggacaagatgacacgataattggtgagcacaagtgaatcattcaaaaaaatcaatgtgtctcctcttaaggcttaccatggctttctacgctgccagacactctatcaggtgctccattatcaattcatacacaacaacatattgtccatgacacacctacccatgagtctgaattgacagagtatgatactgtattaattgagcctacacaaccaagcttggaaggacatggtacctaactgtctaatacttcttttcctactaaatatggttattctgcgtatgatggttgcattgcatgtgtgagtagaaaataattagagatccttgagaaatggttgtttgggtcattttctttatgggggtttgcatcgttcaaactggacggttacatatgggtatatacttttatgctatatactagtatatacatcattaacacatttctaatgtctggtttacacatcagagcatccaatatcaccacatgatttcaatattgctcaacataatgaatatactagaagtcgagaatttcatggagaaggtaaccataaattatgatttatattattttacccggaaatggttcatttctgtttttaataactgcaaatagtgcatttgttttttaacccagatgatgcatttgaatcatatcgcctgcttgggtactccagtcataccgaagatccatatgactatgtctaccataagttgcccgatagacacaatgtattgcgaaaaatacctgactgttgttattgtggagccgtgaaatttcaatttgagccacacggaatgtgttgcagaaagggaaagattaaagtgcacatacatgatgtgcctactgagttgaaaaggttgttcaccagtcagggagatgatgatgcaaaatattttagaaaaaacatacggtacttcaactctcatttctccttcaccagtcttggagttacattggaccgacgagttagcacagcagctaatacgggtatatatacatttcgtgtccaagatgccttgtatcatcgtctcgaccatttagtgctagtttctcaaggccctcgtcatttgcaattttacttctatgatacaaaagatgctacattggcccacagggcacgaagatcaccagaccttgatattaatatcattaaaaatatcttgacaatattagagggaaatccatatgtacaaactttcaatacacttggatccattccaagtcttgatgactatgttattgaactcaacactaatgtaacgcctgaccaaagaaggtacttgactatgcatcacatttctttgttgtttacttgcagcacatttctttttgtaatacatgatttttaacatgtttctttctgcataaacaaggtacaatgcgcccactg

SEQ ID NO: 262 - DNA, 2996 bp, Zea mays
tatatttatgcaatttttcttttatttcgatccatgttttaagatactttgttattattctattacaattatatcaatgatatttataacaaaagaattaaatatagaaaaaaatttcattccaattttaattacaatttgctattttaggcatgctgttttaaaccatatgtagtgctattttaaatgattcttggttatgaacaacagtgcatgttttgaggccactcaaaaaacaagtatgggactcatgatatttatcacaatacaatttaaccaaggaaaattacattacaattttttcattgccaaactgtaaacaagacttgtttaggcatgttatctcataagatatgtggaaagatttaaatgtttcatggttatggacattaatgtaagttcgaagcgcttcaaatccctaaatgacatactgtttagaacggtagtttttccaaaaatgacccaacaagatctatcatcaatttttcgcaatacactgattgggagtaaagtgtcatgatttcgtgcatgtttttttgaaaagattgtggcatgaaccctgctaaaactttgaagctttttgaagccctaaatgattttgtagatttacagaatgatccaacatgttgtttcacacgctccaccaagaactaaaattcaacacactcaataacttgagtatgggacccacataattaaatggtcgcatgcccattaaagtttagtgttttaaagaatgagataactttagaagtatttgaattgcaagatgcagatttttcatgataaactattttgtagagttacgacgtctattaatggaaaaaatagttaatggaagtaaatttatatttccactttcattactcttttctaaatgtcgtactataagacatacttgtttaggcatgttaccttaaaaacatatatagtgctatttgcaatgttcctcagttgtgaacacatcaacccatgtgtatgggactaatgggtattatattcgtacaagtttgcagcatgatatatcgatttctgatgtgcgtcaacttcgaagcattttgaagccctaaatgttgtattgtttagacagatagtttttacagatggacccaacgtgttgtttcgcatgcaccatcattaaccaatgttcaagacaaccataacatgagtatgtgaccctagattgtcgcatgctagcagtagatttggtcatataaaggatgaggttaatctaaaagcgtttgaagcacaacatgtagatttttttcaaatcatcaatttactataggagtgagctatgcaacatgttgtttcacatgcttcatcatcaacctaattaagtgcaagacaacctatagcatgagtttggggcccaagatattgtatgttcgaatgcaaccactatagtttgtagatatgaagaatgaggtaactttagaaatgtttaaagtgcaacatgtatatttctggagttgagagctatatttatgcatttctgcttttatttcaatccatgttttaagattctttgttattattctgttacagttatatcaatgatatttataacgaaagaattaaatatagaaaaaaattcattccaattttaattacaatttgctctatgctagactataaacaacaatagtttaggcatgctatcttaaaccatatgtagtgctattttaaatgattcttggttatagacaacaatgcatgttttgaggccactcaaaaaacaattatgtgactcatgatatttatcacaaacaatttaaccaaggaaaattacattacaatttgcccattaccaaaccgtaaacctcacttgtttgggcatgttatctcataagatatgtggaaaatgtttaaatgtttcatggttatggacattaatgtaagtttgaagcagttcaaagccctaaatgatgtaatgtgtagaatgatagttttcacaaaaaggacccaacaaggtttgtcatgaaagttttcacaatacactgatttctaagtaaagggtcatgatttcgtgcatgttttctcgaaaagattgtggcatgaaccatgtgaaaactttgaagcttttcaaagccctaaattgtgtggtagatttaaagaatgatccaacatgttgtttcacacgctccaccatcaactaaaattcaacacgatcaataacttgactatgagacccacataattaggtggtcgcatgtcgattaaagttcaatgttttgaagaatgaggtaactttaaaagtatttgaattgcaatatgcagatttttcaagataaactattttgcagagttacgaactctattaatggaaaaatagttaatcgaagaaaatttatatttccactttcattactcttttctaaaagacatacttgtttaggcatgttaccatgtaacatatattgtgctatttgcaacgttcctcagttgtgaacacttcaacccaagtttaaggccgatcaaaacatgagtatggactaatgggtattatattcgtacaagtttgctgcatgatatatcgatttctgatgtgtgtcaacttcgatgcattttgaagcccgaaatgttgtattgtttagacagacagtttttacggatggacccaacgtgttgtttcacatacaccatcattaacccatgttcaagacatctataacatgagtatgcgaccctagattgtcgcatgttagcactagatttggtcatatgaaggatgaggtgactctaaaagcgattgaagcacaatatgtagattttttcagatcatcaatttactataggcatgagctatgcaacatgttgtttcaattgcttcatcatcaacccaagtgcaagacaacctataacatgagtttggggcccaagatattggatgttcgaatgctggcactatagtttgtagatatgaagaatgaggtaactttagaaatgtttaaagtgcaacatgtatattttttagatcggtaatttctagagtt

SEQ ID NO: 263 - DNA, 2993 bp, Zea mays
  misc_feature (1333)..(1340): n is a, c, g, or t
gatccatgttttaagattccttgttattattctattacagttatatcaatgatatttataacaaaagaattaagtaaagaaaaaatttcattccaattttaattacaatttgctatatgccagaccataaacaatactagtttaggcatgctatcttaatccatatgtagtgttattttaaatgattcttggttatagacaataatgcatgttttgaggccactcaaaaaacaagtatgggagatatttatcacaaaacaacttaaccaaggaaaatttcattacgatttgctcattgccaaactgtaaacatcacttgtctgggcatgttatcttagaaactatgtggaaagatttcaaatgtttcatggttatgaacattagtgtaagtttgaagcggttcaaagccctaaatgatgcaatgtttagaacggtattttttacaaaaaggacccaaaaatgtttgtcatcaaagttttcacaatacactgatttgggagtaaagggtcataattttgtgcatgttttctcgaaaagattgtggcataaactatgcgaaaactttgaagattttcgaagccctaaattatgtggtagatttgtagaatgatccaacatgttgtttcacaagcttcaccatcaactaatattgaaaacaatcaataacgtgattgtgggacccacatagttagatggtcgcatgccgattaatgttcagtgttttaaataatgagataactttaaaagtatttgaattgcaatatgcagatttttcaagataaactattttgcagagttacgacctatattaatggaaaatagttaatggaataaaatttatattttcactttcattactcttttctaaatgtcatactgtaagacatacttctttaggcatgttacattaacacatatatagtgctatgtgcaatgttcctcagttgtgaacacatcaacccaagtttaaggccgatcaaaacatgagtatgtgactaatgggtattaatttcatacaagtttgctgcatgatatatcgatttctgatgtgtgtcaacttcgatgcattttgaagccctaaatgttgtattgtttagattgacagtttttacggatagacccaacttgtttcgcatgcaccatcattaacccatgttcaagacaaccataatatgagtatgcgaccctagattgtcgcatgctagcactagatttggtcatatgaaggatgaggtgactctataagcgcttgaaatataacatgtatattttttcgtatcctcaatttacaataggcatgagctatccaacatgttgtttcacatgcttcatnnnnnnnncaagtgcaagacaacctatagcatgagtttggggcctaagatattgcatgttcgaatgctggcactagagtttgtagatatgaagaatgaggtaactttagaaatgtttaaagtgcaacatgtatattttttagatcggtaatttctcagagttgagagctatatttatgcaattctacttttatctcgatccatgtttcaagattctttgttattattctattgcagttatatcaatgatatttacaacaaaagaattaaatatagaaaaattttcattccaattttagttacaatgttctctatgcgagactataaacaatacaagtttagccatgctatcttaaaccatatgtagtgctattttaaatgattcttggttatggacaacaatgcatgttttgagcccactcaaaaacaagtataggactcataatatttatcacaaaacaatttaacctaggaaaaattacattacaatttgctcattgtcaaactgtaaacatcacttctttaagcatgtaatctcataagatatgtgggaaatttttaaatgtttcatggttatggacattaatgtaagtttgatgtgcttcaaatccctaaatgatgtaatgtttagaacggtagtttttacaaaaaggacccaacaagatttgtcatcaaagttttcacagtacactgatttgggagtaaagggtcatgatttcgtgcatgttttctcgaaaagattgtggcatgaaccatgcaaaaactttgaagatttttgaagccctaaattatgtggtagatttacagaacaatccaacatgttgtttcacacgctccaccatcaactaaaattcaacaaaatgaacaacttgagtatgggacccacataattagatggtcgcatgccgactaaagttcagtgttttaaagagtgagataactttaaaagtatttgaattgctatatgtagattttcaagataaactattttgcagagttacgacctcttttaatggaaaaatagttaatggaagaaaaattatatttccactttcattactcttttctaaatgtcgtactgtaagacatacttgtttaggcatgttaccttaaacatatataatgatatttgcaatgttcctcagttgtgaacacttcaacccaagtttaaggccaatcaaaacatgagtatgggactaatgagtattaatttcatataagtttactgcatgatatatcgatttctggtgtgcgtcaacttcgatgcattttgaagccctaaatgttgtattgtttagacatacagtttttacggatggacccaacttattgtttcgcatgcaccatcattaaccaatgttcaagacaaacataacatgagtatgcgaccctagattgcagcatgcttgcactagatttggtcatatgaaggatgaggtgactctagaagcgcttaaagcataacatgtagatttttttcagatcatcactttactatagatgtgagctatcgaacatgttgtttcacatacttcatcatcaacccaactgcaagacaacctatagcatgagtttgggcccaagatattagatgttcgaatgctggcactagagtttatagatatgaagaatgagttaattttagaaatgtttaaagtgcaa

SEQ ID NO: 264 - DNA, 2980 bp, Zea mays
taacatactctagtaactccagccttgtcgtaggatgtgaggcacgtaatcggactacaagttgtactccgggcccgtggccagcttcactgctttaatatggtcctgattcagtggacaatagtatgaatgagatgcttctaacgatgtcaagataactcatataacgctagtgcattctgcctctgcataggaaaaaaaacaacgctgagaggtgacacgctgaatgggccatcagtgtcgttcattgcagaaccgctgtttgtctcccgtaagtgacggaaacgagggggattgacttcagtatcatgcatattcctaccaccttttcggttttgggaaatactgagcgcattgtgtggcggtgagacccgttttccattgggtgaagtagtcttgacatggttgttagagaatttggttcttgtaggatatctctggcatctactcattgacaccactgacagcaagcttgtatgatttgcaaggttgtactgttgcaatagctttcgaagcagatggatgggagttcacactccgatgtttggacggtctggatggttttgcccttgagaaatttggcagtttgagcagagaactgcacaaaaaatacttgcttattacttaattaaatgcagaagcaaatatatatactaagcatactcaaggagcgaaatatgtaataagcaagcctgcaaaaatcaaaaggtggacaaggttcaggaggggctgatcttcgctcctgtacatttgctttttgtcgatcgttctccttttcttgttgagaattctctttgttcacagtatttatttcttgagacagcttgacttcttacaattgcatatcctctcttgtgacgagctgaagctggagtattattaggcttaaggtttagtcacattaaatatcgtttcctcgtcaatcataggcttaagctggttgccttcagtaccatcaccttttgctatgacattgcaaatccaagacttgagcctaggaaggaacaatttataacatggaaataaagatgccccagttagtgtgcagaaaggagagatgaaaaatgccttgatacagacaacagcgctagcaccaaaaacaagcaatggccctgccttgaggaatgaggaatgattggtgctagcgcataggcttcaagtagcttatgtgctagcacaacctgtgcctagctcctttcatcggacagtacttgctagagaaaagttccagcaatgtaacatttcatcagtaacatcagcagctagatcactgacaaatattaagtgatcagaaggtacttctgaccgcttttcacccatgtgatatgatgctcagttcaacttagatacctggtcagtgtttggcatcacatgatcataaaaatcctgaagagccttttctgctaatgcatgagaaaagaactcaacaaatccatacccctctaactgtcatgtttgcctattgcagataacttttattgtaatcacctacaaaaatataagatagcaaaatataataagattacaagtcaaaaagttttggaagcacaaacacacataaacagaaagaagaaatagtaagtgatgcttgattagcattaacctcatatctatctgattcctattagctaatactcctagctagtaaaaggatacatacaagtcgctttgtccatatatttttgtgcatgttgcttctcttgatttatcaccaccggcaccccgctacatagcagggtcagtggtggctctcgcgtagcatggaagttcactcacaactctaccagtaaactgagcatgctaaaccgttaatgaaaaaccaacaaacatgagattcagcatggaagctcactcacaattctaccactaaactgagcatgctaaactgttaatgaaaaacaaacaacatgagattcagcatggaagctcactcacaactctaccagtaaactgagcatgctaaactgttaatgaaaaacaaacaacatgagattcgcagataacatcagcaatcagcaacggataaatgtaatagtacagtgtccatacctattgtaattgtagtaaaacaaagacaaagaaaggagccaggatcaataaaacttacatgctgaaatagccctgccacttggcatcatgcacacagggacaaaaaacgaaaaaaaaacatgttagatttagtctccaatcaggcacatgaacagactactgatatgttaatattcatacaagttaagggatataactttaaaatacaatgttgtaacttctagtgttatttctgattctctccctagattgcaattgagtatctccataatcatcacgacaatctgcataccaataaccaacatctttttcttgaggaaagtcccatttaaatctcagatttcttgatgaattacactcattgcacaagaatgagcttagttcaatcaaacatgctaagatacacagaaaactaccaaaatttaacaaaactctatccacatgtactgaaatgtaagctcccaaattcataatatgtacttctagcttcacatcaaatgcaagagctctagatccatacatttcaagaccaagtcatcaaaacaagaaggaagtcacactgaagcacttccctacaagactgtaggatggactcggccactgcgaaatcgagcaatcgcagcccgacagtggccatgagctgcaccccgcaccttggtgttgtgcccctggccgtcgaggatggatccccgtcgacatgagccacccacgcagggaggaaagtgactccagaacaagagagctaagaagtggttggaatttctgtttctgttatttcatatctctaacgcttacagattgttccatttatatcctactggccataggtctacaaactccagctagattacaactaggacacagctggatacagctcagaactaatactaagcacttactgactcgggtgtcactatagatcaccacacct

SEQ ID NO: 265 - DNA, 2979 bp, Zea mays
tgtaacacccctggtgtttatatcccgctcgacaacgagtatggaattaagcacgtaatatcaatggataaaacggatgctaaattttaatcatctttgcctatcgcgattttaatatcgcatctgtttcgtctgtcgcgagttcgacatcgtttttatctaaccgggctcttcctaaattttcatgatgctcggaacatagttgttctgaaaatcggtgcgtccagtgattatttaaaactcatcgctcgtgcgaatacgaattggaagctcgacccactcggatgattttatcccgaacaaattaatttgaactcgacgactaaaatgttcggggcaaaataatctgaatcgagcattgtatgagaaaaatcatgcgcgagattgctaaccaaggaattataattgagatttgattctccaataaatcatctatggcagagtgatcaggagttcgagtggcagactaagttatctgatttcaagtcgtatcaaatatagtttaaaatatcagtcttgatctcgtttgggttcattctatttgcatcctatccgaacccgatattatccgagacaaagagattaacgtttgattttatagcagataatgctgggtccgaaagaatactccggatcgcttgcgttaccaagaaaccgtgcacaagattacaattgagattattcattagtgtgctattctaggtagagaaatcaaatcgattcggaaaaaagagaaatttttatctgagttcaactaaattaatagagtctcaagtaccgtatccggatagtgttttggtccttgtgtttctcggccagatccaaaacttcggatataaataacgggtgaaaattcatctaattccgagagtattcaccaaatcaaatcctatctaaatattgttgtcagtctcatttttgtttgatccttttgtatattttttagactctaatttcataccctaaaatatgtgtattttgttgtttttaaaaaaagaaggaaaaacagggaaaatccttctctaaatatttccaccgttccttggtatgattttcaacgtaattggatttttcactatagaaaatatctctctattgttgttttcttctcatgtacgtaaacttcctagaatatcattggtcgtcatcgatattttctttgccagcaatcgtattcgatgcatttttttccttgtctccgtcgccgcttaagtgggtaaccggtagaatatcttcttctacatgcgcatactctcccagccttatcttcttctgtagatttttttcctcaacattatctctcctctcgacacggcagtaggcgctcgttctcacatcttcctgctgcagccgcgccctggtcccagacatcctagcgccgtcccatctcctccctcccagtcgactctctgctcttccatggctgcttgctccactgcgcagccgctcagctcctcgacctcccctcaactttctccagccgtcggtgctcgccaagtcgatctcccatggaagcgggtcagccctactctccatcgcaagtcgcgctcctccatcgcgtcgttcttccgctcacccacctcgtccatggctgtcgtgcagagttcgccctgcgcgcagccggcgtttcttcctgacgtgctcgcacagccatctcccatggcgtgcgcctcccctgcgtgtccgtctccctgctccaccttcctgtcgcacctctctccgttgaagctccctcctgctcgccatggcgtcttccagtctctagctcgccctgctccctgttgccgcgaactccagctcggattcagcccagctcagatcttttccatggtcgctacgcactagccctgctcggattctcgttgtgcgtacctgggcactgccccagtggccacctgctccaatcgccgcgcccagccgagttcacccctgcgcacaacggtgggtttcgctgcgcagcgttcctgcaccccggcctccgtcatgctcggcagcaagtaattcatgtcgaagcagcagctgcgatcccatgcgtcgtgctcgccagatcgagtctcgcgtcgtcgatctgcgcagttcctgttcgggtatcggttccgcctacgtcgatctcctaattgccatggatcgtgtatcgacgtcccattacaacagcccgtcgtaaaactctagtgcttgtcgttgatatccggtcgtcgccaacctttgtcttgccgtcgtcgttcggtcacccgtcttgatgtcggtctctacatgatgcctctgagttggagtcgtgctgacaaaagaagccccaagagaagatgtccaaaggttggatggtgcggtgcgtgaagttcggatagtatctgccaagcgctcgacaaattgcctaaatcagagaatcattaccgatctcgcgggttgaagtcagctattggaacggtgagccgatttactatttttactattgattttatgaccgtgaaataagacgcttagtttgcgtataaagtttaagttaaagatgccagctatgcgaggtgtgctttgaggagtttagttgccgagtatattcgaactagttctattttgcagagtgtagtatttcggtgacgcgtaggttaaattcagtattttatacgattgtcgataaatctgtcgatggtaattgtgttcagtgcgcgtaagatgaagtcgatgtcctgcgctagtagttagtatcatctatgtttgtgatcgataatgttggagtagggtatgatcgacgatattcttatctagagagtggtgtgatgatgctctacttgataaattaagtatagtgtgatgttttattagttaggatattttaaggttagttcaaaagagtggtttaaatacttagttgagttgtttcggtccatacttcgaatttcgtgttccaaaataatgagtctaagtaattagtctttctgtattacgctttagtcaaataaaaaggtggaactcatatggtat

SEQ ID NO: 266 - DNA, 2979 bp, Zea mays
cgatccgaattcgaaaatcaacatcggcaatgatttttattaatccgactcgctttaattcgatgacgaatccgaagccgatcgatctcaattcattttatctctacttgtgcacaagaatttaatttcctagcgacacctaattaaaatgttttggttcattttattctgtggcctcgcgattcgtctggacgtcagctcgctccgttcctagcatcggtctcagccaacgagtgagcgctgcgcaaatcggctaaaagatgaccactcctctccaaccaataaattgccaccgtcttaatagacaactcatacaggagctcttgtctcagagaaataaaataaagattacttaggtcctaagtaatcagcccctcctcaattacaaccactttctctctccgttttcgtgcacacgccatatctccttcaccttattcttggcatattctgccactgccagcctctggccagtagatggctgccgcccaaggtggcaaatggattgcctgcgacgtctcgttaaaccaactagcatccttctatttaaattcccacctctttgctcctttctctctgttccttgacacagggcagacatggtcacgtggcttgctcgccgcccttgctggccagttcccaaccacctccgtgctcgtccaatgccggctgccgcccaatcccgaccaatggccgtagccgtcacaccgataaagctagcagctggcgcccctcaccttcagccgacactcccttctcccctctattccttagtgctgaagcatctcctggcgttttcccccttctcagcgcaggagcaagggcctcccatggccgcctccctggcgtacctcggcagcagcagggaaggccgcttccccatggtgctgctctccggcgttgccccaagtccggcgacccctccccacaatcccagagggattcttcctctcccacggaaatcagaagcccccttcttcctcaactcgaacccgtgtagcaggggctttcttccccacagtaggccgtcattctcctagccctcctccacggcaccgctcctccccaacgccggtgccctccctcagctggcttgtcggtgagccctgcccctccctcagcagcgggccacgaccctctttgctcgtgcgcgggattgctggcaggagtcctgccatggccggacttgccccctctagctcggtgcacctccctgctcccttccatggcgcgccatggctcctcctcatggtgcccccactccctgctacatctcctctcagcatcttctctgtagtagagagcataggtacatgctcggtgcttcagcgcccagccatggtggatgtacgccgagccatccctccccactggacagcaccagagtctgggtcttcggctcgcccaggcagcgatcccgcttcggcacctgctccttggaactcggtgcccagccttctgtaggagtagtgcactcccgcttctgaagcacctcgctggcgccctcattgtccatcgacagcatcccatggcgctgctacccccatggtctacaagatgcgagatttgcctcgtcgcactcgtcgtcgggctcgaatcgggtgtgtgcagcccgtccacgatagcattgacccccgcgacggccttgtactcgcgctgctcctctagccgagaccttgcatgcagcagcaaggcccggatcccctccgcatagagtgcttcgctcgatctgcgtagcgcctgcgcgtcgtcgttgaaacccttggtgagcctctcgctagtaccccactgtttttggatctcaggtggttaaaaaatgtttggaccactgggtgttgttaatcgcagctagatgttgccgctgcgcctcgcgcaatgcatgatttggtgaagcacctaaattgtggacgtatgcgcaactccaatcgggtttcggccagattgttcaccttcagtgattcgcgatttgttttatttacgtatttggtcgatgatgtgcatgtgtgaatatgtgtgggaaaatataattgtatgaatggaagcatgtagagaagaaaataaagtaaaaaaggactcggatgtttttatattttgataggaaaatatgcgatgcgttgtttgatgcaaaaactaagttacaaaatgcggattatgttttgggaaatgcaacaataggtgtttatgtgaaaagtgtatttgttttatgcatgtgatcggtgattgtgatagtcgatgtgaatgaggagtatgattaatcctgttggaatcacttgtgctgttgatgtcttgtgcgtaatatgggggacacgtatgtgtgtgtgtgtcatggtgtattatagtagtggtggcataagatatttgattgaggtgtgcgggtatatgccgtaatatggttatactcgcgacgaggaaagatgtatgaattgtgtaacacgacgcttaggtcgctattatataatcgtgtgaaggaagctcatgatggtggtgtagtggcaaagcgagaagtaagtttagtatttttaaacagttagttgatagcatctatcggtgtcgtcatgatttctgttgtatggcagatcgatgccttgctttgtcaattattgcattccattcccattggataaataaatatcttgttgattgattagaggtcttatatgagcgttttcgcagtccaataattattggaggcgagtagcattcataagtcggtccttgttaaaattgaagaacaatccgataagatatgcacataagtgctttaggtccttcagtagcaaatgtagtcttatggagttttatgccatgtgttaatgcctctatgttagacccccaaaaatgtgctattttaggtgacttgtgtgttaactaatttaagttgagcaatggttaagaaacactgattaatctgctccaacccatgtttttgagttgcgatgtctaaaatggttcgctaagtcttatactgtgattagccaa

SEQ ID NO: 267 - DNA, 2974 bp, Zea mays
ccaagtccccaatgaccagctttttctgctgtaatacacgcatgttccattacaagctttagaagcacatttctatcttcatttgatttaaagtaacatgggtcaaatcctgcgtagctagctgttctagatttagccctcttattgatcatctgttctagcttgttcactgttcttgttgggaatgtaacctcagtaacagggaatgaaagatgctttcttttggtccatataccgaaagtagttcctagtaccctttttgattggcttttgcttgctccatgagtgagtcattctggtgctatttcttttgcctaatttttttaatcattgttatgatgttaggtactctttttagcattttttcttcacctcggtcgaaagtgttactcggagctcttaattgatataatcatgtgcaggtctccaagacttagtatcctttcggtcaaaactagcccggcagtaaccgatcgatcaatgcttattgtcggagcatgctgccccatgctcacagaactggacatcagcaactgctacgagatttcatacaagtcactcgaggtgatcggccaaagctgccagaacctcagggtcctcaagcgcaacgtcttcaactggatcgacccatcggagcatgccggagtagttcctgaggactatctgagagaatgccccgaagacggcaacagggaagccattacgatatccaggttcatgccgaagctgagacacctcgagctgaggttctcgaagctgaccgccgtcgccctcggctccatccctgaaggatgcaaggacctggaggtcctggacctgttcggctgcgcgaaccttacgagccggggaatagaccaggccgctgctagtctgaagagtctggtgacgctggtgaagcccaacttctacatacctcgctcctccttccacatggggaggtacggccactggcagctctacgacgagaggttccagaccaatgtgtttcagatatgatcatagtctcaggtcaggtactcaggtgctccctttgacctatggtttatattctgtgtatgtgggcgcatatagtggcaccaataacgtgtggtttgaatcgtttctctcgacaacattttgtacagatggttatgctccagcggtttgtggagtgtggttggttttaatataaatgacttattgcctgcaaaagagatgttttgttttggctctctactttggttccaagaacgtgacataacatggttggcttattcgatcctgattgcaaggcatctttggtgcctggccctgggtgtcgtcttcctggccccatgttgcacttgcgcccgaccgtgaccgctcgctcgatggcgttaccagaatgccagccatgttcgtgtcatccgcaccgaaatccgatgcgttgtcgacttgtcgcgcatcacctttcgggcagctgcctgactgtctgcatcttttttttcccagcagcagagatgaggctatacagagtggctccaattatatctaatccccagaagtatttcctctagcttctgccaagggcagagctgagttgagacatggaaattgcacgcatgccttcctcgaaaaggctgaaaccttccctttaagatgctgtttggttcacgaaatgtaacacaaatggtaatagtaatggttacacttgattactgacggtaacaagtttgaatagactggtatcaatttttagtgtggtatctaattacagttggactaaaacaaacatgatttaacgttatcagttacttattacgttataaatatgtgaaccaaacggcacctaaaagaccagctttaccttccctttcgttcaacgacatcacactgtccttttcaaggttaacatatgcgtaacatacatgtggttgatctgcatttacagttcgtgaaaactacatatcagaaagagaaaaaaatagtggacaatgtatcccatccctccgtttgtaccagtcggtgactgacaagagatggaaatccagttggctggcttgatcctacactgtggttgagatctggcaagcaaaggccaatggtccatggagacggagcagcaaaaggccaccgaatccgcacattgctggttccatatgtctctcttttgcctagcagcacatcactagaacccaaagagagagaaaaacacaagtgccagaatcagcaacctctgctgggatttaggtcccattattaggcctggactgtccctaattttgtttctaaacgctatataatccaacgatgtgtaaaacaagaacagatgaacagctccattcacgtggtttcctgatctttttcagattgtttgccgtcgagagagagagagagagaaaaggtcataatggaatcaggtgccgtcttgccaaataaggtgcttgccttatcttggcacagcagtcagcaggatttataagaagagtctccggggagactccacgtccgagactcagacctgtgaactgcttctggtggcctgtccatcccaagatgaagagaggcaacaccgtcctcgccacctccatctccgtcttggtcctcctatcccttgcctcccaggtctcacggtgtgcagcagcagcagcatccgagggaagcgccggaggagtctccacggagcggcggcgggtcaggccttatctccaggtgcaagaacaattggatggtatggtcagcattgctctcttttttttttcttttctcttaattggtgcctgaaatattgccgtgtcgccatgcatgattgcacaacttatcctacggagaataactcgtctgcgacaaactgattggcttgttcgtgaactgaaggcgacatgaaagaccacctggaaaccgggagtcctagccggaggcttgggcctgggcatgaggcggcgggcacagtggagctggagcatcatcacaggaggattaccaccgggcacaagggtggcagcgcgggtggagt

SEQ ID NO: 268 - DNA, 2860 bp, Zea mays
gtggtatctaggcaacacccaggatcagcaagcatccagcctgctgccctctctctatccttctctctcttggatacctacggtatcgtggtgtcgttacccgacgacaacatcttagttcaatggtccatgtccagttcaaatatacatacagtaaaacaacctcgcatccaaataatgataattaaactaacgcagtctttaaatgtgccttgcatgctcatcttgcaaaatccttgagcatctatatagtaacggaaggggtgcaaatacggaacaagaaatttgtattgtaggcaacttacttgcattttatcttgattttcatccaatgccgcagacagagcctcagcagaagcaacacgaacattgtaatttttatgggaaagtgcattgaaaatatcagagtaatcggtgatgacatcaaaaccaaagcggtcccataactcctctgctaattcagcaaccacctagagaaggtacatgagccaaagaacaagaaaataaatataatttcttgctctagaaagaaaaaagttcaacatatttcactaacataaaaaaaagatcaatagttccaagttcaaagggatgttacaaaccttctcaggatcatgagcagcaatccaaaggctcgttgacacatgcaaatctcgttgcacagagtgcacaggaacacattttatagcagttaagcaggcaagcctaacgtgcacttcttttgcatatacaccaataaaagcctgaagaaagaaagaggtaagaatacatagcactagatgaaataaaatagaacaaaataagctgaagaacagaatacaaaataacaacctgcgctaactcatggcttcttagacctaggcatagctcattcagcataggcccaactgaaggatgataagcaggaacagtgcttagcacatgataaagaacctagccatagaaaaattaagatagtaaattctagaactaggagtctatgagaacaaaacaaggaacatcattaagtctgaaagaactaagaatgtttaactgataacatcctaggacgaggaagtggtagtattggatccatatgcaaagatagtacgtggagcacatcatcatgaagacacgtcttttttgaagatagaaggatcctttccatgatctgaaccaaatggtagcagcataaataaataaataaaaggacaaaaacaggttaaagtaaatgttggaagggaaatatcaaaaggaatagaaagtgaatttatggttggactaaagacagtggacaccataccggaaagacaaaagtaaacgaatctgctggaagaggacctgctttgcacgcaatagtcagaccatttactatttgttcaaagaggccagatgatggcttcttgctatcatcttccatgatcacaggggtaagatccaaaacgatttcaagatcaccaacagatatcacacgaattgcagcagcaatctcgggtgcccaattgcaaagaggaggggctgtgcaacgagctagcctcaacaatgtacaaaatgcagcatcgcttactattgcagaacttagcaaaggttcaacataatttacctgcatagcacaacatcaaattctgagccacaacagatatgataaatataaatgtagaaaatgcatcactactaatagcagtgtctcatgccaaaaaatgataacaagaggatataagaacctaaaaggtttctccaagatatgttccatttcactgataaccaaatacaaatttcactattttttgactggatatatgagggtcaattattacatacttgattatcatgatttggctgttcgtaaaagatactggtgcggaaacaaaataacatattggtgcatttattaagacataaatcataaacatttccaaaaacaaaaaaatgtaaacctcgctgcagacacaaaagaaaaggtcattttttgttcaaattaattcttatcgattattcgatttttttgggtagctttctaggtttaaaaaacgatcttaattaaacaagatatagccaatgtgttcaatatttactcctagatgtgcacattactccctctatctaacacccttcaatgttgtgatgaagttctgccaagcatggtctatgggctggcaacatagtaacagctaacagtaaaaactgaaagaaactacagagggaaggaaaagattgctaaccagagatggcagttgaccatgagtaaatataggattagcaatagccaattcgccaagagcatccaacattaaggagagattcttctgcacttgcccaaccttcatacgtacagatgcttcctccttcaagagcaactctctggcctcctctttagcagtcttagccttgtctataggagctggaaatattagaaaataaattttcaccaagcaacacactatgcacctattgtcagggctaagaggtcgaagtaccagtcttctttgtagatttcccagcttctcgcttgccagtgcctgaagattctctcttctcattctttgcaggaacaacagaccgagctgtctcctacaaattatagcaacaacaaaatttggcatatacaatagattaaagccatattcactggctatcaaataataatactagattgcacatttggtagattttctttctggcaaagacttagaagctacaagttcatcacaaactacaatcaaaatatttaaaaaaaacaacttgcaagaacaaaatattactgcatcttgatcatcatatgcacggaaacgcccctttgcaagtttagagtttttggaagcaacagtctcagcaatgtaaactccttgctcggttgacaactgcccctctggagtataga

SEQ ID NO: 269 - DNA, 2958 bp, Zea mays
tgtaacacccaaggtgtttatcgtttgctcgaccacgagtgcagacgttaacacgtgatagaggtggataaaacggatgctaaattttaatcatcttcgtccatcacgattttaatatcgcatctgtttctgtctatctaaacccttcctaaagttttcacgaagttctgagcgtatttgttttgtaaattaccaagtcttgtgcttattcaaagttaatgaagaagcgaatactaatctggaaggctcaactcactctgatgattttatccataaacaaatttatttagaactcaacgaataaagttttcagaacaaattatcagagccggaatcaatttaattcggtctgttgtttctcgcccaggtccaaatcttcgaatataagtgaatggtaaaaattcatttgaactccagggtgttcgctaaattagattctatctgaattttgtatctagtacagtccggatccaactcgtttatgtcttttttaacccttaattccaaatatatgcaattctctttataaaaaaaggagagaaaaagaaaaaaatctggaaaatatcttttatccctatatatgcgccgatctttctccctatctgatattttccaccgccctcaccgatttttttgtttctggccgattcttatctgcggactgccgctggcgtcggcttcctgggtattgttttttctctctcccgcatcttcttccccgcacggctcttcctcgtctcctctacaggttccgcgcccctcaagctcatctccctgtgcgcgccgcgcccctggctgggacctcggctcggccttctccccagcgcccggccagagctccctggcttgcccctccgcgcgcccctggccccagctcggactgctccctggacgagctccacgccatggcatctcccaggctcccagcccctcttctccctggcgagctctccctgccccctgtacggcgctcctcccctgctcctccagcgccgcaacttcctgctcggctccaagaactggtccacgtcctcggctcctcggctcggcatcccccgtgcgcgcgcgccctggttcctgcttctctctcttccttcatctctcctccatggcgctcggctttctcccatctcccatgccgcccggtcctccctgcgtcagctcggctaggcgggacatcgctccctgctgcagcttgctcggcgtccagtctccaactcggcgtcccaactttggtcgcacctggtccctactcgagctcggccctgccctctgctccagctcgcccctctctgcttgttctcactgttgggccggtccgcagattgccgtcgaccatggcacgctgcggccgtgtggaactgtggcggatcggggaccgggtgggctggtaggtgcgcttctccaagcgctgctcggggctcttcaagaaagcctacgagttctcccgactctgcaatgccgaggtcgccctcattgtcttcttccccaccggcaagctctgggagcgccaccacgtgtctttggtgctcgcttcccttcctaagccctttttgtacccgccgatagtctccagctcactctggccgcgggtaccgttgagcccgtcgttctcctcgtccagtgctcgcgcggtctcgcccgatccgcgctgtcgtcttccagccgttagcctttgcgtcaacgttggtgagctcgcttcgagctccatccatggctgccttctccgctgcttcagctctggtcgcgctcgcttagctactcgccatcggacgccgcacagcaacctcgccgttctttggtgccggacgcgcgttccctgtgcgtgccatcgacctcagtggctccatcgtccgaggctcaaccccaagtcttgctacgccatcggctcccctgtccgacgcgccgtcagccaactcgctggccgacctcgctgtggtctggctcggtgcgccatcgccccgctgctctccccaacgtcagtgttgtccctacgtgtttgcccccatatgccgcgggacactctccgacctcgccgtgtacaacacttggacacctcgtcgtcacttggccacgttttcgctcgtcaccatgccatcttcagtatcatggttctgtaagacttcgcgcattcgtcaacacccggctgtcgatctccaccacgcagcgtattttcggacctctggcctcgtcctactcttctccaacttgcgtctaagccttgggtcgagttcatacgccactgctcggtaaaataaagtgaaccggtgagcgccattgtttttgtgaattttgagctgaattactagctattattgatactatgtggtggttgcaagcgctcaaaatagaagaatggatttagataaagaaggaagcgaagccgcaccacgcccgtctgatgttcgacgacaagctcgaaccaggatttatcagcattcttacgagtattgagtcacgtttgaagctggtgagctgatttataattcttgtaagtttatttgatgattggattagctagacttattagtcgtaataattctcgtgtttagcaggcgcgtcgtgtttgtgttagatgtttgctaaaatacctcagcacctccggtaacgtaatcgtgtgaaataattgtgtaataaggtacaccttaggtctaaaatgcaggatttacgaagaatgttttagagaatgaataagttaagtatgcataaattggttcgtcgtttgtgaaaatggtcaagttaataatgtagattatctatcttatgctctttatactcgtgctcatacatgtgcatcgtgcatcttgcatctgatgaggtacgataattaatcatcttatgtggaggaaaagagccaaattgacctcaagacagtgcaaggagtggtcttctttgcacgacgatgtcgtcagtcggaccaacctgaagatggttaaatcaagcaagtgctcggccgag

SEQ ID NO: 270 - DNA, 2955 bp, Zea mays
gtaataaacactaggttagtgttgttaggtgacgtccacttgaccatcctttgtcctggctcttgatcaggcaggttcgtccatcagcatcgccatgcggagtagcccgcgcttggggtcgacttggcttgtcttccgcattacgcgattaattaacgtacctgaatgaaatacattatgcacatgaatgcataaaaaacaggaatagcacaaatctaactagtgctacgtgatagcgaatttaaacacctagcgacgaggtgttgtacaagatcatacggaaatactagttatcgatatacgactacgcacaataattacgcttctctaaattaaatgaacctaacgcaacacgaaacaacaaactatacacatgaaatacaattagcctaatcacaacttatcagttaattaattaaattctaaacgtatcccttgctttataaattatacttcatctttataagtgattaaaatatttcatcaacacacaggtctactaatattttactcggtacactaattcagctaagtgactggaatagcgaaatagctcgtcatagctgaatctggctcgataatcgcaagaattgtgaagtcgacgagagtttcatgacttacgcaatttattgagcaccttaatgagcatcgcactagcacattaattcattcaatgatcgaactattctgaataatttatcagcttaccgtttcaacagctgactcgaatccgcgggatcggtaatgattttccgatctaggcaatttgtcgagcgcttgtggaatatcacgctgctatcttcatcttcacccgattcttgggatttcttgatgacgcacggaacgacgatgagttggagacttgcagggtcgaacacgacaaagagcttcggatcccaacgcgcaattgaaagataaaccgtcgggggccacaagcatgtcgcggacgcgacgggtattggcgacaagaagcaagggggttgctgttgcgatggtgaaagatgaagggcactatggagcagggagacacgcctcggagccgagtattgagatgtcctggccaacggccagaccgaggcgatggccagggaactcagcacgggcgcgacgatttggcagacagggagaacatgatgacaaggagcaaagtttgcagatgccgcgacggggctgcccaaacacaaagacgacgacgtggagcgagtagcgcacacacacgtcgcaacaaaacaaaacgatggctgttcaaggcttgatatttcctggagcagagctaaggtgctgggagttcacagcggtgctccacgacggccatcaccggcgtcgagcaaggggcgatctagcgaggtcgacggcaaataacgtgacgacgagctggaataccagggtgacccgagcgcgacggatgagccgtagccaagcagtgggacgcggctgcgggcagaggagtaacagaggccgagcagagaaacgcaggggacgcgcgcggggtgaaagagtcgagccgcggcgcgcgcagacttcacggcgctcggcgcggcgagaacgcacgcgcacgagaagatgtagcagggagggagtacgcgcgcgcaaaggagctcgacggctgggcgagttaggaggagcaccatggctaaactgaggagtgcgcaaggacagagacgcgctatggcgacgagctggagaccgaatgtgagcatgtgctagcagcggagagccgcgaccacgaggttcgttgacgacggccaggggtccgactgagcgggctggagcagagggcagggccgagctgcacggccggcgagctggagcaccggtgagcagcaggcgcgggcgaactccatgggaggaaaatccgagctggtgcagggaggagcagagagaagaggcaatgtctcggaagaagtctgagccccatgggaggacgcgcacaggaaggctgaagcttgcaggggacccggcgcggttggggaagagagcgagccgcagggaaatcggctgggagggagcgcgcgtccacaggaagaaaccgagcggctgaggagagagagcaggaaatattccgcgacgggatgagaccgacggctggaactcggttgggggcttccgctggcgagctacgcgcatataaaacgaacaggggcggcggcaaaaatatcacatagtcaggtacggtggctggggagaggatgagaacgagtgagacacaggaaaatcttgcgccggctgaacggatgaaggagagaagatgagcacgacgtcaggaaatatcctacgaagaggataaagattggagagaaaacaaaaattcaacagaggaaatatttctcagtccttttttttcaacacaaaaatacaaatgacatgcttcggattagcgaaccaatttaatcgctaattacttatatccgaaaattcagatccgggcaagaaacgacggcccgaataagactgatttcgtcttcggtaatttgttcggtgggattcgactaaaattagccgaaaccaaatccgctattgtatacgcgattttgtcgccacaacagcaagctgaaggataaattgaatcatattcgcgcgcacgatttcactcagacgacacgcgatcctagatattttgccccgaataattctagtcgtcgagctcaaattaatttgcccgggataaaatcatccgagtgagtcgggcttccgaattcatatttgcgcgagcgaggtatgttaaataaccaccggacgcaccgatttttgtaacaacgatgttccaaacatcacgaaaatttagtacgagtctgaatagataaaaataaaacaatatctaactcgcgataaatgaaacatatgcgatattaaaatcgcgagagacgaagatgtttaaaatttagcatccgttttatccactgatattacgtgcttaaattcatactcgttgtcgagcagaatataaacaccagg

SEQ ID NO: 271 - DNA, 2949 bp, Zea mays
ctcgtagacgggccagcgctggcctctacgaggaggcgtcgtgtcgggctggccgtcgttcattcgggcggaccgattcttgggcgcgtgacgccaacgcgtctccggccttcagcgtgagccacatccgagaccaaaagcgtcagcgaggtgtcttcggtgctgccggccataggcggacgacggcaagaggcaaacgccgcgggaactctcgagccgacgagccgcacccggggggtgcgctcgacgaaggcaacgtgtatcgagtacggcttcccgtgggacgggtagcagcacgcaagcacttctcaacgcagcaggcataggatgtccgcacgaatgatgggacacgggcgccgagagtcggccgcacggcagcgggggtcctccaagcagtcacaggtccaagacaactcatgcgtcagcatagccgctatggtcgagccatccaaagcatccctccgcgctgggcgcagcgggtccgcctgcaaggacgacgactgaaggtccaccgagcccgggagaaacaaaaaacgcatcgagcaacaggccatcccacagtgcagccactcgtccagggcatctggccggcggtagccagccatagccggtcgtggctgcgtcatggccgaaccacggccggccagaccgccaacaatgcccagctagagctaggcgcggtagggtgccgaccggccacggctaggccgcgagggggtgcggggctcggccgaagagacctggaggagtcgctggaaacgctatggtttcagcagcgtttcgctcgggtttcggctgcacgagttccctaccccctattatacctgaggggcatcccccctcccaggacttcggggagttctgccttcagaaaaccagggcattttcccaggacgccacgaaacccatctaagatggccggacaccaggtttttgctcaaaatcaggggtttcgctagcgtgacccgttttccctcacgggtggacccaaacttccacatctcattcggaggaccacgggagggtcccgtacccttccacgtgtccgtttttgcggccgtggccgaaaatccgtttttggcccgcgcgccatggcgaacccctcgttttcagcccaaacgcaaggccgaacaaccctcccgcccgttgccttgtgcctccgagccgttttccctccattccaccatgcccttcaaccgagtcctacgtagcagcctcggtgtctttccacacgcttggacttagcccgttttcgcggccgtggcagaaccgccgtttttggcccgtgcgccatggcgaacacctcgttttcagcccgaaacgcaaggccaaacatcactgccgcccgtcgccgcgcgcctcctcccgttttccctccgtttcaccttgcccttcactcaagacatgccctttaggttcggtgtgtttcaacacgcttggacttagcctgttttctcgaccgtggcccaaccgtttttttcggcccatgcgccatggcgaacacctcgttttcagcccgagacgcaaggccgaacagcactgccgcccgttgccgcgcgactcatgttttccctccgttccaccttgcccttcactcaagacatgccctttaggttcgctgtgtttccacacgcttggacttagcccgttttcgcggccgtggcccaaccgttttttcagcccgcgcgccatggcgcacctcgttttcagccctgccgcccgtcaccgcgcgcctcctcccgttttcactccgttccaccttgcccttcactcaagacatgcactttaggttcggtgtctttccacagcttggacttagctcattttcgtggccatggcggaaccaccatttttggtccgcgcgccatggcgaacacctcgttttcagcctagacgcaaggctgaacagccctgccgcccgttgccgcgcgcctcggtgccgttttccctccgttccaccgtgctcttcacccaagacatacacattagcttcattgtctttccacatgcttgtacttagcttattttcgggttcgtgcccgaacctcagttttcggcccgtgcgccatggcgaggaacccctcgtttttagcccagacgcaaggacgaacacccatgccgccacgtcgtcgcgcgcctctgacccgttttccttctgttccatcgtgcccttcaccaaagacatacactttaggtttgctgtctttccacacgcttggacttagcttattttcgggttcatgcccagccaccgtttccagcccaagcgcaatggcgaaccacccgttttcagcccagacgcaaggccgaacagccccgcctcccgttgccgcgcgcctcctcccatttcccctccattccaccgtgcccttcacccaagacatacacattagcttgggtgtctttccacacgcttggacttagcttatttctaaggctgtgccccagccgccgttttcgggcgcgcgccatggcgaacctctcgttttcagcccagacgcaaggccgaatagccatgtcgcccgtcgtcgcgagcctccgtgtcgttttccctccgttccaccgtgccgttcactcaagacatacatacaccttaccttcagtgtctttccacacgcttggacttagcttattttcgaggtcgtgccccagccgccgtttgcagcccgcgcaacatgcgaaccccttgttttcagcccagacgctaggccgaacagccctgccgcccgttgtcaacgttccatcgtgcccttcacctaaggcatacgtagcagctccagtgtctttccacacgctgggacttagctttttttggtcgtgcatgaacccacggtgattttcggcctcttgccacgctgcgccttggccgtttccgttcggaagatcggtgcccctctccagtgggttcgtaacctagtcggtgggcgctgcgtagagtggcgggagggg

SEQ ID NO: 272 - DNA, 2947 bp, Zea mays
gtaagttgaacaagcaagtaatcacaatttctgttgcctcacttatgttgtattttctttggataagattggttctgagcggttcgacaaggaatatgcctatagcatcagacataattatggaaaagaaggaaaacggacagtaagtccctcctccatgtgtaacttgaaattgcaacggaattattacttactctcacacatgctactccaggattacactccatattcatgccaaaatatcatatctgcaacacctggtgttggagatcaccatggatgcccgtttcgacattttgggtacaatttcacccttagttttctatagatgggtactatgcgcttattatttagataggtgctctgaactttctgttagcaatatcagtttgcatttctgatccttttttcactagattactcctgaactttgagggggaagtaagatcacatttggaaactagaaaatctgaatggagcaagaggcctccaacttctagttttttctgattaaaaatgacacccaacaaaaaaagcttaatgtaccaaaaagaagtcatgcagttatgaatgagaagttaatgttttgtttactcatttggtacccaagttgaaccaaatagtacaatactaaactaccaagcagagaaatgagacattttgtcctatcctgccaatatggtttcatctagtctcatccatacttttctattgtatagttttaatttctttctcgattatggtcaacagcttctgttgtgatgtcacttggcatgtcagtttgtgatgtttcaagataaacatgattctaccttgctttgtacctgctgtttgctccaagcatttgcttctgctttactgtatctgcagcgaagaaaatttgcgggcagcactcaacaaaatgggcgttggtgggcatgcattggaagagataatagataaagtgaagaacaggcattaccaggtgctgtgcttcattgccatgggcttaaccgagcaatatgatacccttgaactgactggtttatctgtcataatgaattaattatacagctagcttgcacattaacatttgagaccacacacggtgtctcctgtgattctggaatcaaccatccaaaccaatatttcagtgaaagccagaaagttctgcgggccaaagtgagtgcagtggtttattatacacttgacatttgttcttacgttctgctggttctgtcaacatgagtcactgttccaatttaacatgtgtggctcaatgcacagaaccagaaaatggagagccaatcagcaacctaaattgtattgcagctggagaaactatgcatcttcaaaaatcttaccaggtcttgactccacccagcttttgctctacattttctctatgttaaccacaacttgttcatgatttgatgcttttctaatgtgcaatgatggacacaagacatgctgcgctccattttctgtttatggcatatgtggtttatacctctgctgaattttcttttgactgccatcttaattcctgctgaatttatacctctgctgagttacactggttaggccgttcaagtcctggggccaaagaaacccggtcaccatgttcaaagcctggcattcttcttaatgccagcatctttcccccttatctggtttcttttaattcccttctcacttccagcagtttcattagatattttctttcccttgttttattggaaccatgtcacatccattcgacaaaattcattttttgaatgatttaaaatgccccagaatagtgtattatttattttatgtatgatatttttgttttgccccatccaaggttgccctttattactggatttgcttatattattcatacagctctgaagtttaaggaggcttttgttaaatgtgtgcgaccttgtgaccgtcagtttttaactgatttgctggttaaaagtgtcatttctgtacatccattttttttatcaaacatgtgatttggtgcagcacgtgagattcatcaccacaattttcattcataaactcccaaattttatacacaagatactataagcccactaataatcttttggtcatgcagcaggtaagcactgaagcaatattcatccttgaagccaattatgttatcattactgattgttgaccattggcgtctacctggaatattgttgcttcctgctgttaccaaattccagctgctggcttggcctaaaaagaccaggctccagctgttagctgccatgccctacccaagtgatggcaccacactgtacactagaagtagaagtgttatctagtgctgcgaacagcagcaggtcaaatgcgtgtgtacatgtaattctccgaagaaccaagagtgaacattctgaatttgatgggatcagctgtgctgttatgttattgccaagatctttgggtagaatagagttctttacttctgattatgcccatgtattctttttaagtgactataaaagctttgctgtaattctattagaagaaaaaaagataggttggtctagttagggctagtttggaaaattaaaccctaaggaaaaaattaaactaattttcctctcaatccttgtaatcctgggggatttaagtttctagaaatttggacctaaaaatttgacaattcaacaaacaactaaacacaacataacacgttaccaatcaactagacaagacaactaaatgcatgcaagtggtgagcaaaatcaaaattgcacttgtggcaaagttttgcacgaaaatgagtgacatctgggaacaactgctgagaaagtgtggcgcaccatagctatgacattgaatcaaaaagttatgacagcgaatcgatggcggcacaatggatccgatggagagaagggtagcgaacggagggtagggagggggatgataggaactttcagggcttgtttgggagtaaagg

SEQ ID NO: 273 - DNA, 2829 bp, Zea mays
agttaatttagcgtatataaacagtaaagaaagtgatattataaatttatataagcaattcatagatatattaatatacgtggaagcaggtttgcgtctagaaattagcaagactttttgaataaattcagtggttatggtgaatataacattctaaattaatgtgttgtacttatttattatgcaagaaaataatatattgacatgtaagtacttacttatgcaaaaagaaaatattgtcatgcaggttgaacaattagatgacgtggcctgtgatttggcccactatttttgctactgagaggaccttgatagaggagtctagtaatcttctatatcaagcacggaaattgaggttatggatctaaattgacaatcatctcattttagtcagtatatatcactttccctagctggcatctgataaaatatggcactgatgcaataacaaattctaataacatcgatgagggaatgctgtttgaggagtgaagtgatgcaactaaaacaatacaaagcaaagtaatagaaggaagaaagattggggaaatacactatcaggtcgtttgttgaactgagtgaggtaacaacatgaatatttttgtcgctgaaaagttggaatgtacaaatgtagaatccaaatcatattggattttattttataaatggagcttagttgtcacaaaagagctatgtgctaaaatgaagtttacagggacttcgtgaactacgtgaactaagcgcaaggtcctgcataggatgtatgttcatatgtttatttatggatagcagcatatcgtcggtcatgtgtacttgaacacttactcgaagtgtgtatctacatgtacatagagggaaaagtatggtgattatggaggaaatatggtggtcatacctattgtagcagcaatggtgacctccgacaaaagaagtgatcaactttatatgtagtaaaaaggtatgcagagctagttatttcaatgaaacatgggtgatggagtaaaacacgaaacacaaatatgaaaaatataaaggtgtgcgttgtatcgaggaacatggaacaaacatcctatacttcaattggcagagtaaacacaccttaattggcagaataaacatgagatttatggtctataggtctaggagagacatgtattttgggatccttgtatagcaaagttccagtgatcaataggagctactggtcattttaactgctatggggcgagtaatagcaatagtaactcgctcctcctatatactgcagagtagcgaaacttatttaggactccatgtatagtagagtagcagtgatcagtttaactaacgatttctagtctttgtttgcaccacccaaccagctcacatcgtatactttaatttgccgaatgaacatgagatttatggtcataggtctaggagagacatgtattttggtgagtatggaaaggaataggtaatcatttgtttactgcaaaaccatactatctgttctgaatagaagttgtaggttgtccaaatgaattgctgccagacatcaattgtaggaatcaaattattcacatttattgtggcaataaactgcagaaggcaaaatgaatgcattggcgaaaggcaaggacgataactcagctaaaccaacgcggattctaggagtcagaaacaaaatcgaaatccaccaacgacaacactgaactgtcaaattggttcatatctgcacgtcgtttgactctttcatatagtaggtgaaaatcacaccaaaattgaaaggggagggggacaatgagccgtttccaaaggagtaaacaaattcgaaggagcatcatccagtaaagaatccaaattgactggtgcacagtaataaaagtaattccttgtacggccgaggacagcttgcctgtagatctgtcctggccaagacgttcggccgagaagggagagcgggcgggggggcggtgagtgtctgtccggtttgactacaggcctggcccggccgtgtggaggggcactgcgctggagcgatggagccgttgagtgtggctgtgacatgcggaggcgctgtgcagagcgggactgtgtgagagggtatgtgcatgcacccgtgtgagaggtaggaccgtaggagaagccgctagtgccgtcgagcctgagcgtcgccatctgtgtgacgagcgcgagtaagggagggagtggaagatgagtgccgacgttgaggaagatatagatgtgagatgcagaaacgcaccacgggcctgcgcctatgcgagagacgggagcgaaagtcgctggcgccgtcaagcatgagcgtcgttgccgttgtatgtgtgccgagcgggagaaaggaagggagcgcgagaaatgatggatgatgcagaaacctactacgcgcctgcgcctgtgcaagaggtgtgagggaaagccgttggcgccgtcgagcgtaggcgtcgccgccgtcgcctgcatgccgagggcgagtaaggaagggagcggaagttaagcgtcggcttcgtgccttcgctgtaaataaaagcgacgtgacgaaatctggacgctggacacatattgattttaccttggaagattctggtgtccggtagagaacacgaaaggcaacactcaagaggccgcgctcttatctcaccgtggatccaaaatctgatggccggtagaaatagagcatacgtggatatcctatccttaacggtttgcgtcgcgatctattatatagaattgtcgttttactgcagaggactaagccgccggagtcaattctttctctatgcatccacgtctcaaatgcacataatcgtcaatgtgaaacgataaggt

SEQ ID NO: 274 - DNA, 2931 bp, Zea mays
taacacctggggtgttacaacgacgacgagcgcgcaaactaatccgccgcatccataagtgattaatgatgatcctactttgataccactccaagattttacggatgctttgaatatagatggtaattgaactggacatgtcctaggggaggtagtaatggaggggtctctcgaaaaagaacatggtttggtttataggtggaggcttactgaaatagaccctgttgtttctgatgtaggagttggggatagaatgattgattcaagctctggtggtactaatcatgtctctgggagtaaaccaactggagcggcaaggaaacatgcagtactggagaggggatctcatagcaatactgattcaagtaatttcagagttaccagagatgcaattggtttcgaaatatgtattaaaaatggtaaactaatactgactattctctgtggatatctggttggacaccaagcatttttacccccatttgaatgcagagtcagagtatagacagctcaacaatgttgtcatatatttttataccaaattagagtgcacaatcgtttttctatttatgttcccagaaattcagttcactagggaacaccttacaggttggtcatgggtcaggattggatagcaagagttgtccgaagccggcagtaggtaaaaggaaaagctctataaaagcgaagaaatgaaatcgaaggatactagcacttctttctatacttgtaggctttctttcttatattcaacttcatgaattcgctatgctaggttcattccatccatctatcaggtttgagtaggtaggctctatccttaagaaaatgcacataaataagtgaatccgaaaagaccaagacttgaatgaagcccatttcccaggctagttgttgcccatgtagaataaccaaaagtgaagtgcataaagtgctattgtagccaatctttttctataaatggcaccacccgtctcgctaacttcacgtagaagcttcctttcccaggttatagagcaagtccttgttctaaagcttaatctacccctatgctatgaatgaacagatccacgagctgagaatcccaatccgccatatcagccttattgaacaacttaataatccggagagaagatgcttctcggaagacgatgaaaatgaggaacgaagttatcctaagtcgtgttttaaattggtgcccttagttttggtggtgtgctcacctatacccttagtcgtgttgagcacaccaccaaaactaatgcacgggctcaggttacgtacggattttatgcaacaaatacgatacataaggtgtagaatactttattgctactggcttttgcctttaacggatctcgctgcgcgcctcaatcgtatcttgtcttgcgcggagctagaagatcatcgactctttctttcgcatatgaataatactgggctacgcctatctgagtttatgcttaaccaaagaccaagcacttggaaaggacagaaaaggtcgttcctttactctattcctgacgttaggacagatacttaactagtgggaggccttacgagttgctcaaatcatctcttgatccggaatcacgggatcggtagatgtcacataacttgattagttagaaaatgattatgctatcggcttgatagaatacaaaatatgaataatacaagtgccggtcagctaatagcacctttggtgacatgttgttccccactagtcttcttcgtacatgcccatggggtcatccctaaggcctattcaacactgcacactgggtagcacgtaactagtggtcatgcttacttcagatgttctcagcctagctcagtctatcacttagacttctgatttcgtgctgtgttcaacaagctaggaacacaaaagaacgcttatcctcttagggtaggggccacattcttgcatactcttttggatctgacaacgtgagcatagagcaaatatctcttgataaaagagaaatagcaaagggaaatgtgctagctgataactcctactatttcgcttcgcgcctctgcctcgtttttagtgagatatgcccataatagggaatccaggactcctcacttgccttgccgcttcgcgcctacctcgttgactgatctcgtacaatcacttgcattttcctatgtggaaaacttagcaactactctacccttcccttagagtggaactcacagtgtacgtagcgagccacccataatcggcttggaagtgttgcagctcgaatccatcagacctggaattaatacgctctctttctggaagtcactggccaagtatgacatagagaaaatggatgaaattcaataaaagtctgaaggcgcacctcgaagcaaccgtctactactagtttatatgactagctcttatactatacgagttcttggtaaaccactacttgtgtaaagtaaagtgctccgctcgttcaacttgatgatgatcagtttgagcatgttcagcaagttcacccgttagctttctcgcctgcttgccaactaaagcaaggacaactatcatagatagaagcctacgtagggatactacagacaaactgctatatagagtggcaataatagcaagggaggactatttagtgaaaaagcggaaaaagccttgacaaccgacgtaatttaatgcgtattgcccttatagagtggattgtgctatttctacttaggtaattgcctttctttaagaagaaaataatagcccattggacttaccatgcattggaaaaacgatctaactatgcctatactctctgaagtctatattagctacaccaccaaacaaaaaacaaagtaagatacgtactaatcgactacacaaataaccataaataagcaaagaacgggactacacacaataagtaagaagctaaagtctgaagctatttgttg

SEQ ID NO: 275 - DNA, 2927 bp, Zea mays
tgtaacacccccggtgtttatattccgctcgacaacgagtatggaattaaacacggaatatcagtggatgaaacagaggctaaatttattttatcttcatctatcgcgatttttatatcgcatctgtttcgtttgtcgcgagttcgactttgtttttatctgtccaagctcttctgaaattttcgtgatattcggaacatcgtcattccgaaaatcggtgcgtccggtgattatttaaatccatcgctcgcgcgaatacaaaattcggaagtccgacccacttggacgatttttattccgagcaaattagtttaaactcgacgactaaaatactcggtgcaaaataatccgaatcgtgcgtcgtctgagtgaaatcgtgtgcgaggatataattcaatttattcttccgcacgctgttttggcgacgaaaacgcgtatacattgcggatctggtttcggctaatttcagtcgaatcgcgcaaaacaaattatcagtgccgaaatcattttatttcggtctgttgttctcgcccggatccaaatcttcgggtgtaaccaattattaattaattcggttcccactcgtccgccgcgaaatcgcgtacgaggatctgtaattgagtctcgactcactggtaaatcatccgtggccgttgaaccagatgttcagaccgcaggtaaatttatcagattttgaatcgaatcaactgtcgcagttactgtcgactcttttttctatcactagaaattccggttcaaaagtatctatgatttttcggctaaagaaataattaaaaaaaagagagaaatctgcaaatatccatttcttcttcctatccgccgtgcgctcttacgtttttatctctccatctgaaatttttttacgccgccgatggaagcctggaggccttatctcctcacggtatcttcctctgtgttctgctccccggcaagctgcaattcccagcgcgcgctctgcttcaaaaaaatctcccaaccgctcctccctatccgttcagccggcgcaagattttcctgtgtctcagtcgttctcatcctctctccagcgaccgtacctgactgcgtgatatttttttggccgccgctcaccgccggtgaagattccgccgccgttctcccctgacgctcggccttatctcttcccctctgctcactagcgcagttcgctgctcctccctcctcttcttcttccccgtgcacccagccattccggcgtccggtccagctcgctcgctcatcctcgagtccggccgtgttctcgcgcacgctccttctgctcgccggtcgcgagctcgtccatggcagctcccatcgtcgcgtcccggccaagtcctcagctcggccctgcctttctttccccctcggctcgccccgatggcgctcggccgagctcactggcgcatgtcccggtcgcagttcggatctccgtggcgccgcgtcttcttctctgccccgcaatccatggcacccggttggagcttcttcctgcccggcgcgcgcccgcctccctgctctccgcgtcgcgccgagctgccagctctggtgtccggccgagcttctccccgagcccggctctgccccaggtggccgcttgctccaatcgcacgcccctggtccaagctctgcgcgcgcggtcctctgccccctgcgcgcagccggtttctctgttcgccgcgaagtcctgcgcgtccagccgtcgaagccccagcttggccccatctccctgtgtcatggcgtcatccccaggcttctgcttgccgcgcccaggatctcatgtgtccatggccgcgcccaagctccttcctgccctgctcgcgccgtgctcttctgttcgtcgtgcgcgcaaagtttccctgctcgttggcgctcgaccaactccatcgtgccgcgtctctctgtcgcgtcgcatccgcagttcgccgctagcgtctggccgtcggtggtactcgttccctcgacgtcgaactgcgccttatgccgacttctccagtccaacctggcttggagcttagacaccgggtctaacctgctcgtctctctttcaagctgacgtagcgctccttcctgttcatcgcacctagtttgtgtgtgttaccgaaaccgttcgcctcaccctcgtgttcatggaaatgacgtgtcgtcgatcgttaagctcggctcagctgtctgctctcaacgccgcgagctcacctccccttgcacacatctctgcaaaccccgccaacatcgacttcgtctcaaatatcacctcgactttgcaacagcagtccggtgcttctgatgtcgccctgaacttattccgtgtgccacgacgtcttgtttacctccacgccaaagcatcaccgaggtaattgtgggtttcttagtgtgttataattgtgtctatgattatgcgtgtgaatcgcagtaatggatactcattaaggtgctcgataagttgcgtaagtcacgaaactctcgccgacttcgcagttcttgcgattatcgagccagattcagctatggcgaattatttcgctattctagtcacttagctgaattagtggaccgagtagaattgtggtaagcatgtgtgaggttaaaatattgtaatcacttataaagatgtagtataatttataaaacaagggataaagttagcatttaatcaattagctggtgagttgtgtaggctaattgtatttaatgtgtatagtttgttgttcgtgatgtttgcgttaggttcgagaagcgtaattattgcgcgtagtcgtatattaacaactagtgtttccgtacaaaattgtacaacgcctcgccgctaggtgtttaattcgctattgcgtagtactatttaggtttgaaatattccggtctatatgcattcatgtgcataatgcatttcattcaggtacgtgaattaacca

SEQ ID NO: 276 - DNA, 2924 bp, Zea mays
  misc_feature (61)..(62): n is a, c, g, or t
tatattccgctcgacaacgagtatgaatttaagcacgtaatatcagtggataaaacgaatnntaaattttaaacatcttcgtctattgcgatttttatatcgcatcggtttcgtctgtcacgagtgcgacatcatttttatttttatctgtccgggctattcctaaattttcgtgatgttcggaacgtagttgttccgaaaattggtgtgtccggtgattatttaaaattcatcgctcgcgcaaatacgaaattcagaagcccgactcactcggatgatttttgtcccgggcaaattagtttgaactcgacgactaaaatgtttggggtaaaataattcaaatcgcgcgaaatcttgcgcgaggctatgacccaatttatcctccaacacgctgttttggcgagcgcaagagtaataattaggcctctttttccagtatgttgtcttcggcagagaaatcgggtgcttgattaaggaatgagactatcaggttagacgagttaggcaccgactaaataccgaagccgaaatccgactaattcgatctatttgcatcctgtccgaagcaaaccaaaccaccgtaattactactgacagcaagtaattagtagatgatttagttcgctaaatcatcagaatgaaatgtgtagctgtacagcatgtcaacctagtgtatattcctaaaaatcgtgatcgaaatatctgtgattttcggttaaaaaaaagataagaaagagattaaaaaaactaccagccgatcctatcgtggcgtgagaatttttctcatcctcccgtcgctatcctctccctggatctttcttcaccagtgcttatctcctccagccgagcgctccaatcttcatctgtgcacacatttgttttccatcgccgttctctctccgtggatatttccttgcgcgcgggcatctccagccgcccagcttcttctccctggtgcacgctgctctagcccttcgctccctgggcgtgtcgcgccctggcccggcgtcctctgctcgccacggccacgtgagctccagcgccgtgctctgctcgcggagctcctccagctcgccggagttctctgccgcggcttccttcctcttccgctctagctcggagctcccctgcgaccccgcccatggccggcgcttagtccctgcgcacgcccttgtgcccctgccgcgcccagctccagcgccctggtcttgctggtcatctcccctagcaagccccagctcgatttggtctctgtctgcgcgcgcgctgtgttcagcgtcgtcccctgccgaagtttccctgtctaatggcgctcggcttcttctccgtggagctcgcccctgcccaagcccggctgcctgtgcgctctttcttcctcctcccctgccgcacctggcttgcctcgatgctcttgctccagctcgccgtggagctctgcgccgagcttatccctgatctccctcggcgcgctgttttctgtcagccgaggttcttccccatggcgccccagcccctgtttttttcccagcgcccgactctagctccctactgtcgcggctcccagcttctctcctctgctcgctctcccagttcatggcgcgagcaagctcccacgcgcgtcctggcgtctgcgccgtaagactccttgcgtcctccctctgcttgccacagctgccgagctcccttgccgtggctgtcgcgtccctgcgcccagcctttagctcagtccctgtgcgcgcgagctcgccggtgtgctgctgttctaactcggatctcgcccatgaccgccggtgttcgccctcttgcgtcgcgcagcggcccatcctgctcaccgtgaccgagcggtcgccctggtgtccttcccaagccaactcgccctgcgctgacgcagggttcagctcagccctgtccttcacgctccctactcgtcctcgactctctggtgtggactccctccgtcggcgatctcctctggcaccagctcgcgcgtctgctcgtcgtcaccgcgacgcggacgttctctgttcgcttcgccacagcacccagacctcctcttctgtgtcatcgacactagtctcgcagtccctccttcgatcttgctgatcgtcgatgcgttgcacatgtatggcaaggtaaagtcagctagctattggaacggtgagccgatttactatttttactattgattttactatcgtcaaataacatgcttagtttgcgtataaagtttaagttaaagatgccaccgatgcaaggtgtgcctcgaggagtttagttgttgagtatattcgaactagttttattttgcagagtatagtatttcggtaacgcttaggttaaattcagtattttatgcaactgtcgataaatctgcgatgctaattatgttcagtgcgcataagatgaagtcaatgtcctgcgctagtagttagtatcgtctatgtttgtgatcgataatgttggagtaggatatgatcgacgattttcttatctagtgattggtgtgatgatatattgtataaaatatgcttggtaaaaatatatgtagtaatatgattctgttaataaatcataaaagaaagtagagcgtgaatatatatatatatacactattgttttgtgatatatgaaatacctttgaataggctagagaagcgtaattattgtgtgtagtcgtatattaataactagtgtttccgtatgaacttgtacaacgcctcaccgctaggtgtttaattcgctatcgtgtagcactatttaggtttgaaatattcctgtctatatgcattcatgtgcataatgcatttcattcatgtacgttaattaatcacatggtacgaaagacaagccaagtcgaccccaagagcgggctactccgcatggtgatgctgatggacgaacctgcctgataagtgctaggacaa

SEQ ID NO: 277 - DNA, 2922 bp, Zea mays
caatccgattttaaaaatcaacatcgacgatgaattttagatgtcacgatttatctctttcaatcataaattcgaaagccgatcatatctcaagacgatttattttcgaatcatgcgtagggaattattgccgagtgaagtcagatcagactctcggccgagttaatcgctcaatcgtccgttcgtcggaactctaattcactctgttctccgtagagacaaattccgcgagagcatttttattctgggaaatatttagcgcagcccgattacgtgttttgggctaggccaacctagcccatttggaaccctaaccctaggactcctctataaatagaagtgcctccccttgcaaattggaaaatttgcatctaccccctagccaccatagccttcttcctcctctcccacacaaacgcagctctcttcttctatgttcatggcacaggaaatttcctccccgcccatggcgtccttccctcctcccccttcttcttcctcaagcaagtaggccaacctctcctcctatgctatttcccagcgccaccttctttttttcccctgtctctttcttcctcatggctgcagcagggagctcagctccttctcccatggcgctcggtgcccttgcagcagggcgccattcttccccagggacgcctttgctccagctggccttcttcctttcccccatccgagcgcccaagccagcgcccttccctgctccatgggcgcgagctccaccccctataatggacgctgcgcgagctcaccccatgggcgtgttccctgctccacgactagcaggaagctagcgcccctctcctactcggccacatcagcgcacagagagttcttccccacgccaccctctttctttctcacgaagcaagcagggaacacggccaacgttatcttcctcccgtggcttcctccctgccacgtctcacctctggtagacgccctgcacaacgccctctctcccatggcgagcaactttcctccctatggtcatggtctgcgacaggaagtcgcgcgctacatgtttgatgttttgcgcagcagcgccgacgtctccgcgtgctgcctgctcgctgttttgtgaagcccagtggacaacacaccgtcgacgctcaccggttgtttgctgtttttacgcagccccaacatcgatgtcgttcacccccggtgagtcaccccgctgcccttgctgctatcatatttttgtgctcggtaaaatgttgaactgttgtgtgtgtctaatcgcagctatctgtcaatgccatccatcgcgcacgcgtgttcgatacaaggccagtcggttgaaccacatgcaagcacaactcgaatccgatctagtccaggttgattgatttatagtttaccatacgcatgatttggttgatgtcatgcagtgcatgtatatgtgtagatgtgtgtaaaatgtttcggttatacacattagtagggtcgcatttgcggttggagaacaagaggttgtttgatgtgtgcgatttgtagtttgtctaattatgttttggtcgatgtggtgtatattggtgtttgaatatatgtggctgcgatggttcatttgtgtgtcacgaggatggttcgtggaggtattaattgtttattaaaatacttcgtcgtaaagcagtgtgttaattgtggtaaatctaataaagcgtaaagcaggcttggtggtttccatagtcggctaatgagttagtctatgttaaatatattttatgtattcatcttggtgtgggttagagtgggttgaaaatataaattatgtgatatgtgattagtgttttaaagaagagatgtgcgaataatcagttggtgtttcactcgtctagttgataagtgttgtcataattaattgtgctaaaatttggtcacaagaatgcagtgggcacgtggtgttggttggatgtgataagtagattggaagtgtgggtttgtctgagcactgtgttgtcgaacgtgtatgtcgaagcgcattgtagtaatgattgcgttaagtaaacagtaatgtctcgagtgcacgccacaatatggttgtatgcaatacggggttacgtgaatggtgagtttagtaaaattccatcggtgtcacttgtcttaagttgaggtttatttgtgcgtgggaagtagtaatgtatttaatccttagaactcttagtcgattgtagaaattgacttggcttaaatagagaggtggtgacatgtaaaggtagtcatcatttcctctatattaataagtcgagtcaatacgcattatgcgttcattaaatttcacatcgcccatagtgtatggttgtgttcatgacttcgaatagatgtttcgagttgacaagtaggtttgtaatgcaagatgtgtgatgaagttagtttgttgtagaatatttattgaaatgctccattcatgtgatagacatgtatggttaattcaaatcgagtcgatgtgtgtgatgatgatattcatgaattaagtagatgtcctgtaattttgtagtgaagcttaggttaagttgcaagtgatgtgagaatgtttggtaatgatatatgtgaaatgtgaacgagacatccaatgtattcggaatgtcgcgtagtggtggtatgaaaaatgggttagaaatcgatcggctaaatgccaagttcggttagagttgttttgttacttggatcctgtggtgaagggaaggcatgactgcgtagccatcacgtcatctattgggtgactatgcttaattgtttctttatataagttagaataattccagtctctagaacatggcaattcttgaattatacaacagctgaaaattattaattgctattttgggctgcatgcactgtttttgccacgctgtgtgtttaatgaaccaaatcatattttctgtagaaatgccatat

SEQ ID NO: 278 - DNA, 2916 bp, Zea mays
gatacattgtgggtgtccacacagttgcaccatgcccccgcctcgagaatcccgccctcgactaccaccgaccccgcggtaccgtagcgaccccgttcatcccgccgcccaccacgcacggactgcctccctccctccaccccggctgctgccgacagcgcgctaccctcgtgaccccgttcatcccgccacccccacgcacggactgcctccaggatgctcggccctaaccgcgccctacctccctcccccaccctgttcatcccgtgaacccatccctacgctcccctcccctaccccatccatctcgcctgccctgcctcccacgatggggagccccatccgcgacctccctcaatccccggtcacgccagcagcgcctcccagattcttccccgttcatcccgcccccgcccgtgatccctccccgcgctcccctccgtgaccatcggactcccttcgatggtgcggcccttccatcgacgccgacccgtactgctatttaaaaaatccaaagcgatgatgccaccccacccccatcctcctcggatgtgcagaaatatcaaacatcactaaggtgcgtcaactctattcttgatacttctgtttctgttgttctcaaggatttggattcaacattgtactagcagtttggaatcaccaggcagtgatgctttccatctagccttgtttagtagtgaagacaaaaacagtagtgaatcaggttatgtaatttttttcttttagattatgtgtaatatatttttgcttgaacgtctcggatttaactaatgttgtttctgttgtaatcaacatggtatcactgtttagggtttagggtgctccttactggcattgggcttcagttgaaacccatttaacatccgaactgttcggcattacaattcattgtatagtatcatgtggttgaagctccttactggcactgggcttgtttacaaactattttactaaacagttgaatccaattttaatttgaactcatagtatacatgattctatataaatcatgtctcattcacaagctttccggttcttcatttcagagctctaaagccgattacgtacacctcttcttaccacgtacgcactttaatctgctttctggtttagagcgcagtctcctcggcaacttcttctactgctaactcgggtgcaaggcaaggtacacatatatttcatatatagtagttgtattcaacatgatggtagctgcgaggaggattctattcagtatttatttggaaatgtagttctgaggcaatcccttggtgttggttgatttgtaaacctacaagttagacttaacacgcatcccacatctctaggctttccttattgcattgggcatgaactgattgctggtatgagttgatctttggagtgttttctaaaaggtttaagcacaatgggcatgggtacaaactaattggccaagggtttacactgttttttcatgataacacttgatacatagaaaatagacatatggtttttatgtttgaccatatttcggtaaaagcctcatgatggtagctgcgagcaggattctattcaggatttatttggaaatgtagttctaaggcaatcccttggtgttgtttgatttgtaaacctacaagttagacttaacacacatctcactgttggttgattttgtaacggtggatttaaacttaacgctatgagtagtactgatggtgtctcccattgtgggaaaagccctttcggtatcaacttttgacaacaaaaaatgacatttggtttacacatgatctagaatgccgattgcttcacatctagatgtccttgttagtggtgttatatgcttcacccatgatggtattgactaaaattgtgatgttgaacaatagtggctcttagttgtttctagtctagctacttggaatactgccaatagaaatcataatagtgccagtcagttattttggcaaaccattatccaacaattgttgcaggggtacggtcgatagtcatatgttttttgtgtttatcatttgtgcttgaaggtggtctgtttacagacaacgctcaactgccatataaatattcacactatgttccaaataaaactgacataaatatctgcactgttaggagatgaatcactaaacaccgtctatgatctgaccatacctatgctctgtttagccagtgcttgtcactgcgggcgaggttttcattatcataagagaattgcatcttcttttcattatcataagcatgtacctcggaaaacttgtatttaagaaacccaaatcaacgctgtctcaccactacgacgcaccctctagattttatctcccctgaagtttgtgttcctatagtttgtgttcctcgataactgtactactaaaaacagaccatatttctgatagtaatttgttctgtgacctgtgacacttgagggccatcttttgtgtcattcatgtctgttttgggtttggggtttttgtgtgggggataatagaaatacaaccagtcaagtgattccccatttgtttttgtttggagataatagaatacagttattctctagcttttttgtgttaatagaaataatagtttgcagtgggaaaagtgccacaacatgtcttttttttatgcaatggaatcaatctcgcttttttaataatagattgttgtgcggcaatagctgtgtaaaccagtcttagtctcttgtactaaaaacacatcttactaaaaaaggtactggatggagttcaaaaacagcagggaagataaaatatacagagtttagttccttttgtcacaacactatgaattattctttttgttaggtgtgttcatatgccatggacaatctaaaatgaacaatcttaatctcgttgtttctgaatgtgatgtgctctt

SEQ ID NO: 279 - DNA, 2914 bp, Zea mays
cctagcagcgaggcgttgtaccatttcatatggaaacactagttatcgacatacgactaagcgcaatgattacgcttctctagattaaccgaatctaatgcaaacatcacgaaacaacaaactatacacatttaacacaattggcctaaacacaacttatcagctaattaattaagttctaaacttatccctcgctttataaattataccacatcgctcataaagaactattttaattttatttcacacctcacatatttattcaatccatctaacaatgggactacaggaataacgaatcagcttgccatactaaaatcctacttgaacccataaaatcgatgacgcttctcggtccgcgcataacaccaaatacgtaacgagcgacgtactagacttcactattctacccgatcaaattttattctggcactaattcactactgcgatttacgcgcacatcaccggcccacattaatagcgtaagtataccaaactgacaagaaatattaaaacgaaaaacgagagcaacgacaactcaccaataatttaatctgtcttgaaagtcacgagcacagctatgatttatgattcaaccattacatcgggcacgtggtgagtaccacgcggatttcaccacccagctctcgggatttcttgatgacgcacggaacgacaatgagttggagacttgcaaggtcgagcacggcagagagcttcggaaaatcgacgtaggcagcacgcaattggaaaacaggtcatcggagtcgatgatcacgtcgtggacacaacgtgaattgacaacgaggagcaagggggctgctgcaaggtccgagcgcgttgggagggtgctgtagagctcgatggcgaacgacacgcgacggcgaggaacatagggtgtggggcacgtgacacggataaggacgagtgccgggactatcaactcgtcacacgaccgggtgacgacgacgaacagccgagcgcggtaagaagctcgacgacggttgatggcacggacagcaaaagagatggagacgatggcgttcgcagctgcaaggcgaggctgagtccgccgcgaaggaacagcccgcagccagagtgcccacgcgatgaacaggacgatgccgatgaatcgacgacgagcaccatcacggggggagccgcagtggctctcgacggtggggcacagtgaagaagctgcgtctggcagcactcaagtagcgtcgtacgtcgaactgtaggacggcatagggacgaagcttgcagggatccacgtgcgaagttggcggtcagtgctggagctgcagatcgaggagctcgatcggtcgcgatcgcacctgtaggcttggacgaagaacgcgacaggtgacagtccatggcgagctccagccaccatgtagccgagcgagcagagagggggtgctggcgagctggcgagctgggactgggagagatccgagctgggggctgggcacacggtggcttgagggagacgatcgtgggaggggcctcggccggacgggaggagcatagggcgcggcagccatggaaggggagctcggccgccatggagatgcgcaccgtggctggacgagtgctggcagcggcagccgacgaagttccaactgcggcatggaggaagaagtcaggcggctaggcacctgggagccgatgctgagcaccgctgctccacgggtgtgctactgcgacgacggaaggtgaagggcacgacatggcagggagacgtaccagggattagtgcctgtcatatacgtagaggagcagagaaggcttacggcattaaggaatctgaaggaggcggtggctgggataaagtgaaggcagtgagcggcggaaggataagaatcggagggagaaaaatctggttgggagcagcggtgcaaaaaaaaatctccaggacataaacatgagttggcagttagtaaatatccatctgataaacgacggtttagaattgtgaggagctggaacatgcgacgttgaagatatggaaaatttctttccaagaagctgaacgcgcgcatgcactggataggaatggatgacctatgcggtggaaatacttgagaaaaatattcttttttttattttcccactttttctttacaagagagcacagataatttagttatcagattgagtatgcacgagatgtaaaccagacgaaacaaaagatacaagataaactagtatagactgcgcctgatttaatttagagcagataattttatccatggtctgaacataaaaacaaattaattatgaatactcagttcggttctagttatctcggtccgatttaatttttgcatcaatattgttatcgtcgagttctaataatatttgtttaggacgacaatcactagtgggtcggggctccaaattcatgttctcttaatccataatttttaaactcgcactagactcgacatttcacgaaataaatatgcgagatttctgcggcatcgaaattataatcctttcgaaagcgacatcacgcatcgttcacgtgggcgaaaggttgtgcgctgtccagacaccggttagcaccagccacgcgccacgatgccaggccacagagagacaagtgcaacgcaagtgtgaaagaatttgaaacaaagtttaggaaccaaatccgatttcaagaattagagtttgggcaagatgtcgatggctcaacccaaacgatattggattcaatttttcggaagattactcaagtctaaattttgcaaaaataaattaggacaatttagacagatggagacaggcacaatataaaaatcgtgataaacgaagatgattaaaatttagtgacctttacattcaccgctatcacgtgttaaagtccgcactcgtggtcgagtagacgataaacacctggggtgttaca

SEQ ID NO: 280 - DNA, 2911 bp, Zea mays
ctgtaacacccaggtgtttatattttgctcgacaacgagtatggatttaagcacgtgatatcagtaaataaaacggacactaaattttaatcatcttgcaaaagttcgagtttggtgccgttttcatttcgataatttacacaattaaaaagggttcgagaaacttttggattatcgaatcttcgtttgctggcgaattttgaactgtttggatcgcgcgcgtaagtgaatacgaaaatcagaagacttctgattttatgtaaatttggagccccgcgctatccgaaaagaacaatgcgcacagcttctcgcccacatgtgcaatgtgtgacgtcgcttccggaaaggatcgcactttcgatgacgcatcgatctcgcgtacttatttcgcgaaatgtgagtctcgtgtctatttaaaaattatggattaagagaaaatgagattggaaatttagttcagctctccaatttcataccaaacagatttgatataactcaacgactaagttttttgtgtaaaataatttagtcctcttttgtcatccgtgacatcgcgtctatggatttttaattaaattgttctctaattgagtgttcgaatagcgaacggaatttgtctaaaatcaactgaatcaaatgcagattgaaataccgaagccgaatccgtttaatttagtctgttgcttttcgcctcgatttaaatcttcaaaagtgaattaacagtacgaatttatccgagttcagagaattcgccaaatcaaatcgaatccaaggatttataattgagatctgattctctaataaattctctatggtagagaaatcccatttctctcttatcctctacgtgcttatcccttctgtttcctagccgtaagttaatttctttggaaattttatccatcgctcatctccttgctttctccttacacgagcatttcttgggagttaagcagctgatcaggatttctccacgttatcttctccttatccccaccgctccttctctctcctctcgatatttcctgcgcgcgccgctcggctctggtgaaagaaaatcccgccgcccctgttgatcttttcagccgtcgcgggataaaaattgcgcgcacccggccagagctcctgcgcgccttcttctctgctggctcggccccttccccgcgcgctcgtgctcagcctccggtggaatctcctcgccgtctcctgctgcgctcggaccgcgcccctggcttcccatgcccccccccctcccccggctctgttgccgcgcgcaaccgcgcttctcccagcctccatgcgctagcgcgcgtcgttctccctgcgctcgctcggccttgaagctccctgacgcgcgctcctgtgccatggacccatggtcgccgtggagcttccccagccgcgccctgctcgcccctgttttcctttctctctctcccctgtgcgcagctcgccgagctctccctctcccatggcgcgctctgctctctgcgcgcagtgtgcacgtcgcgatctcccaagcttgccatggctgccgcatccatggtcctgctcagatttcgccaagccccagtgcccggctgctcggctcctcaacggcgacgatggtcgcgctcgcccagctcgcagagctcccttgtcgtggtcgtcgcgtccctgcgcccagcctctagctcagtccctgtgcgcgcgagctcgccggtgtgctgctgttctaactcggatctcgcccatgaccgccggtgttcgccctcttgcgtcgcgcagcggcccatcctgctcaccgtgaccgagcggtcgccctggtgtccttcccaagccaactcgccctgcgctgacgcagggttcagctcagccctgtccttcacgctccctactcgtcctcgactctctggtgtggactccctccgtcggcgatctcctctggcaccagctcgcgcgtctgctcgtcgtcaccgcgacgcggacgttctctgttcgcttcgccacagcacccagacctcctcttctgtgtcatcgacactagtctcgcagtccctccttcgatcttgctgatcgtcgatgcgttgcacatgtatggcaaggtaaagtcagctagctattggaacggtgagccgatttactatttttactattgattttactatcgtcaaataacatgcttagtttgcgtataaagtttaagttaaagatgccaccgatgcaaggtgtgcctcgaggagtttagttgttgagtatattcgaactagttttattttgcagagtatagtatttcggtaacgcttaggttaaattcagtattttatgcaactgtcgataaatctgcgatgctaattatgttcagtgcgcataagatgaagtcaatgtcctgcgctagtagttagtatcgtctatgtttgtgatcgataatgttggagtaggatatgatcgacgattttcttatctagtgattggtgtgatgatatattgtataaaatatgcttggtaaaaatatatgtagtaatatgattctgttaataaatcataaaagaaagtagagcgtgaatatatatatatatacactattgttttgtgatatatgaaatacctttgaataggctagagaagcgtaattattgtgtgtagtcgtatattaataactagtgtttccgtatgaacttgtacaacgcctcaccgctaggtgtttaattcgctatcgtgtagcactatttaggtttgaaatattcctgtctatatgcattcatgtgcataatgcatttcattcatgtacgttaattaatcacatggtacgaaagacaagccaagtcgaccccaagagcgggctactccgcatggtgatgctgatggacgaacctgcctgataagtgctaggacaaggataatcgtcaagcggacgtcgtctaacaaacac

SEQ ID NO: 281 - DNA, 2908 bp, Zea mays
tgtaacacccctagtgtttatattccgctcgacaacgagtatggaattaagcatgtaatatcagtggataaaacggatgctaaattttaatcatcttcgcctatcgtgattttaatatcgcatctgtttcgtctgtcgcgagttcgacattgtttttatctatccgggctcttcctaaatttttgtgatgttcggaacatagttgttccgaaaatcggtgcgtctggtgattatttaaaactcatcgctcgagcgaatacgaattggaagctcgacccactcggatgattttatcctaaacaaaattaatttgaactcgacgactaaaatgttcggggcaaaataatctgaatcacgcattgtgtgagaaaaatcatgcgcgagattgctaaccacggaattataattgagatttgattctccaataaatcatctatggcggagtgatcaggtgttcgagtggcagacgaagttatctgatttcaagtcgtatcaaatatagtttaaaatatcagtctcaatctcgtttgggttcattcaatttgcatcctatccgaacccgatattatccgagacaaagagattaatgtttgagtttatagcagataatactgggtccgaaagaatactccggatcgcttgtgttaccaagaaaccgtgcccaagattaacaattgggattattcattagtgtgctattctaggtagagaaatcaaatcgattcggaaaacagataaatttttatctgagttcaattaaattaatagagtctcaagtaccatatccggatagtgtttttgtccttgtgtttctcggccagatccaaaacttcggatacaaataacgtgtgaaaattcatctaattccgagagtattcaccaaatcaaatcctagctaaatattgctgtcggtctcatttttgtttgatccttttgtgtattttttagactctaatttcataccctaaaatatgcgtatttcgttgtttttaaaaaaagaaggaaaataggaaaaatccttctctaaatatttccaccgttccttggtatgattttcaacgtatttggatttttcactatagaaaatatctctctatagttgttttcttctcatgtacgtaaacttcctaaaatatcattggccgtcattgatattttctttgccagcaatcgtattcgatgcattttttccttgtctccgtcgccgcttaagtgggtaaccggtagaatatcttcttctacgtgcgcatcctctccgagccttatcttcttctgcagattttttttctcagcattatttctcctctccacacggcagcaggcgctcgttctcacatcttcctcctgcagccacgccctggtcccggacatcccagcgccgtcccatctcctccctcccagtcgactctctgctcttccatggctgcttgctccactgcgcagccgctcagctcctcgatctcccctcgactttttccagccgctggtgcttgccaagtcgatctcccatggcagccggtcagccctgctctccatcgcaagccgcgctcctccatcgcgtcgttcctccgctcgcgcacctcgtccatggctgtcgtgccgagttcgccctgcacgcagcccgcgtttctccctgacgcactcgcgcagccatctcccatggcgtgcgcctcccatgcgcgtccgtctccctgctccaccttcctgtcgcgcctctctccgtcgaagctccatgctgctcgccatggcgtcttccagtctctggctcgccctgctccctgttgtcgctagctctagctcggattcagcccagctcggatcttttccatggtcgctgcgcactggcactgctcggattctcgtcgtgtgagcttgggcgctgccctagtggccacctgctccaatcgccgcgcccagccgagtttaccccagcgcgcaactgtgggtttcgctgcacagcattcctgctccctggcctccgtcgtgctcggcagcatgtaattcatgtcgaagcagcagctgcgatcccttacgtcgtgttcgccagatcgactctcgcgtcgtcgatctgcacagttcctgttcggctatcgtttccgcctacatcgatctcctaattgccatggatcgtgtatcgacgtcccattacaacagcccatcgtaaaactctagtgcttgtcgttgatatctagtcatctccaacctttgttttgccgtcgtcgttcggtcacctgtctcgatgtcggtccctacgtgatggctccgagttggagtcatgctgacaaaagaagccccaagagaagatgtccaaaggtcggatggtgcggtgcgtgaagttcggatagtatctgccaagcgctcgacaaattgcctaaatcggagaatcattaccgatctcgcggattctagtcagctattggaacggtgagccgatttactatttttactattgattttatgatcgtgaaataagacgcttagtttgcctattaattttaagttaaagatgccagcgatgcgaggtgtgcttcgaggagtttagttgccgagtgtattcgaactagttctattttgcagagtgtagtatttcggtgacgcgtaggttaaattcagtattttatacgattgtcgataaatctgtcgatggtaattgtgttcagtgcgcgtaagatgaagtcgatgtcctgcgctagtagttagtatcatctatgtttgtgatcgataatgtttcttatctagagagtggtgtgatgatactctacttgataaattaagtatagagtgatgttttattagttaggatattttaaggattaattcaaaagagtggtttaaatagttagttgagttgtttcggtccatacttcgaatttcgtgttccaaaataatgagtctaagtaattagtct

SEQ ID NO: 282 - DNA, 2904 bp, Zea mays
ggctcggagatgtgtataagagacagatttaggtgacactatagaagcggccgcgacaacttgtccacaaaccactcttttgaattaacctttataatatccaaactaataaaacatcacactatacttaatctatcaagtagacaatcatcacaccacatatatatttaccaatatacttatcacataaacctaaaattcaactttaacctccgcatcaagtaatagacaagagaatcatcgcaatcgatacatctatttaatcgaaccatctatctagttgacgggaataacgaatcaactcaccataactaaactcgacccgaatccgcgaggtcaacgacgattctgcggatgaggacaacgaacttgaagggcggcgcggtgaaattattggaacggctgagtcatggacgtggttctgtcgaggcgagaacaagaaacaacgacgacgtccaaagcacgacttatgaagaacagaatggcgaccggcctaggcgcgatgggtgagttgagcgactccgacgacgtgcgcgagctcgttctgggcatggacgtgagttggagcagaggagaacacggccgaaggtccggagtggcgctgcgtggtggagattggcagccgggtgtcgacgagtgcgtggagtcctgcagaactgtgatgctgaagatggcgtggtgacgagtgaacacggggctgagtgacgacagcggtgtccgagtgctgtgaggcaacgacgaggtcgacagtcggtgtcacggatgaaaccgagatcggccatgacagcggagctacgacgactggatcgatgtcagttttgagcttgcagacgacggtgttgtccggcgaggccacacgcagaggtggccagcccaagtgcacgacgcgcagtgcggcgatggcggccaggatcgagtgttgctggccagtagcgtgacggcgaggtagtggtgaggcccggcgagctcggaacaggggctcgacgaacggcggtagggaggtcgagtacagctgaggataagatcagcgtgtgagggagatacccagcggcggctaggagaacgatgggaagggcacgcggccaggcacctaggcgaggggagcacgtggcttgctgggggctcctacagcctggacatgatagggagatgagcaggaaacatgcacgcggataaggaagaggatgtcgtaggaaagtttctagcgtctaggagatgtacgtgacctgtgaacttgtaccggctgaagataatatcaacagaaggtaaggctaaaagccttgggaggggatgacgtggggttgagaagaaaaggggattatcccccattttcttaaatgaatacataaagataattagatcataggaatagagggctgtgggatatttccggagaaaagcacggactcaagataaggaatgaagggagatgaacacgtaatttttttagcgatgattaaagggtcgatgatacgggctacatatctcattctaatgttttagcaaactaaatcatttaccaattacttgctgtcagtactaattatagtggtttggtttgcttcggacaggatgcaaatagaccgaattagacagattttggcgtcagtatttagtcggggcttaactcgtctaacctaataatctcatccactaatcaagcactcgattactctgccgaagacaacacactagaaaaaagaggcccaattattactcttacgctcgccaaaacaacgtgctggaggaaaaattgggtcataacctcgtgcaagatttcacgcgattcgaattattttaccccgaacattttagttgtccagttcaaactaatttgctcggaataaaatcatcaaagtggggcgggcttccgaattcgtattcgcgcgagcgatgaattttaaataaccatgggacgctccgattttcgaaatgactatgttccgaacatcacaaaaatttaggaagagcccggatagataaaaataaaaacgatatctcactcgcgacaaacgaaacagatgcgatattaaaatcgcgataaacgaaaataattaaaatttggcatccgttttatccactgatattacgtgcttaaattcatactcgttgtcgagcagaatataaacaccaggggtgttacattacactaggatcgaactgtgttgtgtgtggtgctgacgaccgcgccgtactagtgccaaacattgatatggatcaatagagagcctaagagatgaagcaccagcagtagcggctcgatcaaaagtcatttcctgctgcagcctttttcagatggagctacgaagagcctctggcctctagcacatacaacgggcttgaaagctctcgtgatctgctgtagctaggtgcaagaacaccagaaagggaaaggctagcaagctagctccacgaacaagcaagcacgactgatgtgtgaagcctacctaacatgcgtgcagcacatcagaccatcagtcctggatttcgaccggagtgccatgccatatactagtactatgcatgagtttatatgaaacctgctggagtttaacgatgagtacatgaaaaagtggagcggttcaggtggattgcagagccaaaggacgcgccccatatcatggagcaatggaggaggcgtgcgggctagcgccttgtgcatgcagaccatgcctccatttagtgcgagtcttgcgtccactagttgaagaacgcgctctagtgcagcctatgtttggagagacatgtacggttggcctgcagtagtgaccacttctcatggtaagacgcgtgcatcatgtggcccagacgagacgagaggtgtagtttctaggcatgtcgtcgtctacttctatttatttaatgggtgctagcgttgtatgtagggatccatcaatgatgtgc

SEQ ID NO: 283 - DNA, 2900 bp, Zea mays
aggtgtggtgatctatagtgacacccgagtcagtaagtgcttagtattagttctgagctgtatccagctgtgtcctagttgtaatctagctggagtttgtagacctatggccagtaggatataaatggaacaatctgtaagcgttagagatatgaaataacagaaacagaaattccaaccacttcttagctctcttgttctggagtcactttcctccctgcgtgggtggctcatgtcgacggggatccatcctcgacggccaggggcacaacaccaaggtgcggggtgcagctcatggccactgtcgggctgcgattgctcgatttcgcagtggccgagtccatcctacagtcttgtagggaagtgcttcagtgtgacttccttcttgttttgatgacttggtcttgaaatgtatggatctagagctcttgcatttgatgtgaagctagaagtacatattttgaatttgggagcttacatttcagtacatgtggatagagttttgttaaattttggtagttttctgtgtatcttagcatgtttgattgaactaagctcattcttgtgcaatgagtgtaattcatcaagaaatctgagatttaaatgggactttcctcaagaaaaagatgttggttattggtatgcagattgtcgtgatgattatggagatactcaattgcaatctagggagagaatcagaaataacactagaagttacaacattgtattttaaagttatatcccttaacttgtatgaatattaacatatcagtagtctgttcatgtgcctgattggagactaaatctaacatgtttttttttcgttttttgtccctgtgtgcatgatgccaagtggcagggctatttcagcatgtaagttttattgatccttgctcctttctttgtctttgttttattacaattacaataggtatggacactgtacttttacatttatccgttgctgattgctgatgttatctgcgaatctcatgttgtttgtttttcattaacagtttagcatgctcagtttactggtagagttgtgagtgagcttccatgctgaatctcatgttgtttgtttttcattaacagtttagcatgctcagtttactggtagagttgtgagtgagcttccatgctacgcgagagccaccactgaccctgctatgtagcggggtgccggtggtgataaatcaagagaagcaacatgcacaaaaatatatggacaaagcgacttgtatgtatccttttactagctaggagtattagctaataggaatcagatagatatgaggttaatgctaatcaagcatcacttactatttcttctttctgtttatgtgtgtttgtgcttccaaaactttttgacttgtaatcttattatattttgctatcttatatttttgtaggtgattacaataaaagttatctgcaataggcaaacatgacagttagaggggtatggatttgttgagttcttttctcatgcattagcagaaaaggctcttcaggatttttatgatcatgtgatgccaaacactgaccaggtatctaagttgaactgagcatcatatcacatgggtgaaaagcggtcagaagtaccttctgatcacttaatatttgtcagtgatctagctgctgatgttactgatgaaatgttacattgctggaacttttctctagcaagtactgtccgatgaaaggagctaggcacaggttgtgctagcacataagctacttgaagcctatgcgctagcaccaatcattcctcattcctcaaggcagggccattgcttgtttttggtgctagcgctgttgtctgtatcaaggcatttttcatctctcctttctgcacactaactggggcatctttatttccatgttataaattgttccttcctaggctcaagtcttggatttgcaatgtcatagcaaaaggtgatggtactgaaggcaaccagcttaagcctatgattgacgaggaaacgatatttaatgtgactaaaccttaagcctaataatactccagcttcagctcgtcacaagagaggatatgcaattgtaagaagtcaagctgtctcaagaaataaatactgtgaacaaagagaattctcaacaagaaaaggagaacgatcgacaaaaagcaaatgtacaggagcgaagatcagcccctcctgaaccttgtccaccttttgatttttgcaggcttgcttattacatatttcgctccttgagtatgcttagtatatatatttgcttctgcatttaattaagtaataagcaagtattttttgtgcagttctctgctcaaactgccaaatttctcaagggcaaaaccatccagaccgtccaaacatcggagtgtgaactcccatccatctgcttcgaaagctattgcaacagtacaaccttgcaaatcatacaagcttgctgtcagtggtgtcaatgagtagatgccagagatatcctacaagaaccaaattctctaacaaccatgtcaagactacttcacccaatggaaaacgggtctcaccgccacacaatgcgctcagtatttcccaaaaccgaaaaggtggtaggaatatgcatgatactgaagtcaatccccctcgtttccgtcacttacgggagacaaacagcggttctgcaatgaacgacactgatggcccattcagcgtgtcacctctcagcgttgttttttttcctatgcagaggcagaatgcactagcgttatatgagttatcttgacatcgttagaagcatctcattcatactattgtccactgaatcaggaccatattaaagcagtgaagctggccacgggcccggagtacaacttgtagtccgattacgtgcctcacatcctacgacaaggctggagttactagagtatgtta

SEQ ID NO: 284 - DNA, 2892 bp, Zea mays
cacgtaacagcaagtatggacttaagcgagaaatgctagtgtgagtaactatttcaatattatgtctatctccgattaccgagattattcgagaaatcccatttagcttggaatttaaccatctcacaaaagttcgagtttggtgtcgtattcatctccataatctaaacaattaaaaaggtttcaagacacttttggattatcaaatcttgtttgctggtgaatttggagatgttcgaatcacgtgtgtaagtgaattctaaaatcagaaaacttctgagccccgtgttgtccgaaaagcacaatgcgcttgttcagtaattgaattgttactctcagcatgttatccttggtgtcaaatcaaatgatcgatagctggtgagaatcgtaaaaattagacgcgattaaatatagtctaaaatatcaaagtcgatctcgtttggttcggtctatgtgtttcttgtctcaatctaaatcttcaaatagaaataatgggtacgaattaatcttacttcggagtagccatcaaatcagatcttgtccaaatattgttatcgatctcgttttgttcgaccctttatacatcgctaaaaatcctaattcgaaatatctgcaattttctttaataaaggggaaattggaaaaaatctgaaagaaaaatcttctgtcactgcccctcatccttctgatctttttttcactgccgcgcgcagcccacctcccagggccacgccctgcccggcgtttctggcgccagccaccgtgccatggtccctgctcccagctcggatcttgctcgaccccaagctaaagctcgatccatggcgcatctccttgggccctccccaatcgtggctcgcccctgccctcctgctggtgagttttccccagcgtcgtcagcttgtcggtcatctgtttgatggtagagtacgctatggccctggctgtcgtgccttcgcgctcactttatcagccacctcaagctcgcccctatgctcaggccttgctagctgccgagctccctctacgtcgtgcccttccggcccggtctcgcagacgccgagttcgctcaggtcgcaagcctatgtgtcctcgccgcgtccttactcggcttctctagcgcgccttccgccagctcagttcctcgcttacactacggacctggttctcctcttgtcacgcctgtcctctgtgcgcacgcgccatcgcctcatctagccattatgatcggccgatgactcactttgtgcccctgcttcgatgtatgcacaggcctgcgacgtccaaccttagctgtccttcagccctaccgtacgcctcgtgctatcgatggcggtccaggacttcaacatcgacctgaaccttgagtcagtgattgtatgtgtgtgtggtggtttggtgaaaatagtgttgtggatggagtaagggcgaagccccagattgacactggtcggatgctcgacaaaaaacccaaaccaagaattatgggcggtcttgcgaatctcaatccaggttaattgtggatggagctatggttaaagaagaaagtgaagtccaaaagcgacggcgtgcaacacttgtcaggtgttcggtgttgtgcgcggaccggatagcgccgtcgatttcgtggtttcaagtcggatttaattttggtaagctattttgttacccctatcagctaatttgattggtgaattaaatagatggtggtcgatgattcttttatttgtcgcaagatgtgctgtgatataccccattccatatagagatgtgattacgttcttgattgtaaagtagttgtgtcgttcagtgaagtttaggtttaaggtgtgtttgatgtagtcgatgctagagtaatagtgatattctatatttagtgataacaatcgctataatttgctgattgatatatatatatatgaatatatcttgatcattatgctgatattaccattggcttatgtctagagtggtagaaatgtttgtggcagtattagacatttgttaaaatgcttcatatatacggtgtgtggtttagttaaatatgcaagtataaatttgttagtggtgagtgtttgtggcgacggtttgattgttcgttggtgtaggcttctcgaagtggtttgcaggtttagttggaataagctaacgaagaaccaaattagtgcgatatttaacgtgtgatcgatgaaaagcccgaattagtattcgttaatcgatgtagtggattcgagctgaatttaatattggcgtgcatttttgttattcctattagccgaaatattagatgattgaatgggtaatgtcgtgataaatttcttaaatatataacaccgatgtgatggatgtccttgttaactgcatattgtagctttggtgctctaaatagtttgaaatgttaattcgtagacttgtatggtggtgatgtctggttagtatttttagtgttttattgataagtaatatccatattgctttggtgaattttgttgatatggtgacgttaatgcctggtcttagtaaatgacattttgagcatgtctagtgtttctaacggctagttaggaaattctattagacctgcttaattaaattgtgtaatgctctaattagttggcgtgctatgcaggttagtttggagaactagtttagacaattaattaaattgcttctatcaatcctatgaatatttggtgcaaaaaaatggcgaatctacgtttgttagccctttggtgtatactctagttaaagaaaatatagagcttatacatagttgtggtttcttgttcgaagtaggttcggttgagcaagaagaacatgagtgttgtacttagtgtgcctagtttattgtttcgtgatgtttgtgttagttttggttagtctataaaaacg

SEQ ID NO: 285 - DNA, 2891 bp, Zea mays
tacaataactgaggtatgacacgggataactgagggattggagtagaataactgagttctgtcactcgaataactgagtgatgaacatggaataactcaagacgcgcattagaataactgagtaccaacattagaataactgagttaggaacataactgagtgggcacattacaataactgaggtatgatacaggataactgagggattggagtagaataactgagtgcgtcgattagaataactgagtaatgaacgcacaataactgagtaacaaacatagaataactgtgggatcagaaccaaacaactgagtgccgacaccagaataactgagtctacacaccataataactgagttagcccacaagaataactgaggtattggaacagaattactgagttctggcaccagaataactgagtgcgtccattagaagaactgagttgttggaacggaataactgagtcatgaacatataataactgagtaggcacattacaataactgaggtatgacacaggataactgagggattggagtagaataactgagttctgtcactcgaataactgagtgcgtcgtctagaataactgagtaatgaacgcacaatacctgagtaacgtacagagaataactgagtgttgaacatggaataactgagggcgtgcattagaataactgagtaccgacattagaataactgagttaggaacatggaataactgcggtattataacataataactgagggtttagaataactgagttaaaaacatggaataactaaggtattataacgaaataactaagggattggagtagaactgagttggcccacaagaactgaggcatgagcagagaataactgagttccatcactagaataactgagtgatgaacacagaataaccgagtactgaaccgagaataactgagaaatgaacatggaataactaagtgcgcccactagaataactaagtaccgactccagaataactgagacatgaacatggaataactgagtgcgcccactagaataactgagtcatgagcagagaataactgaggtattagaacggaataactaagggatcggagtagaataactgagttggcccataagaataactgaggtattagtccagaataattgagtacgtccattagaataactaagttgttggaatgaaataactgagtggcgaacatggaataactgagttaatagaacgcaataactgactgtgaatagagaataacggagtccccactaccgactgattacaaagagaataactgagtaatgagcagagaataagtgagtaggcacacgagaataactgagtcatcacaccagaataactatgtgcgcccattagaataactgagttctgacaaaagaataactgattgacgaacatggaataactgagtcggcacatctcaataactgaggtattataacataataactgagggatcagaaccgaacaactgagtgccgacaccagaataactgagtctgtacacaataataactgagtgggcacattccaataactgaggtatgatgataactgaggcatcggaggagaataactgagttagcccacaagaataactaaggtattggaacggaattactgagttctgtcaccataataactgagtgcgtgcattagaagaactgagttgttggaacagaataactgagtaatgaacagataataactgagtagtgaacaatagaataactgagtgtgcacaacagaataactgagtaatgaacaatagcataactgagttacttgaacgcaataactgaatgtgaatagagaataactgagtaataaacaccgcataactgagtgggcacattacaataactgaggtatgatacaggataactgagggattggagtagaataactgagggatcagaaccgaacaactgagtgccgacaccagaataactgagtctgcacatcataatcactgagttagcccgcaagaataactgaggtattggaacagaattactaagttctggcaccagaataactgagtgcgtccattagaagaactgagttgttggaacggaataactaagtcatgaacatataataactgagtaggcacattacaataactgaggtatgacacgggataactgagggattggagtagaataactgagttctgtcacttgaataactgagtgatgaacatggaataactgcggtattataacataataactgagggtttagaataactgaggtattataacggaataactgagggattggagtagaataactgagttggcccacaagaactgaggcacgagcagagaatagctgagtttcgtcaccagaatagctgagtgatgaacacagaataaccgagtactgaaccgagaataactgagaaatgaacatggaataactaagtgcgcccactagaataaatgagtgctgactccagaataactgagtcggaacagtagaataactgaggtattagaacggaataactgagtaattagtagaataactgagttattagaacagaataactgagtgtgcacattagaataactgaggtagtagaacgtaataactgagttctgtcaccagaataacttagtactgacaccagaataactgagttattagaatggaataactgagtaatgagtagagaataactgagtgtgcacattagaataactgaggtagtagaacgtaataactgagttctgtcaccagaataactgagtactgacacaagaataactgagtcgccacactagaataactgagttactggaacagaataattgacttgtgaacagagaataaccgaggtggacaagttgtcgcg

SEQ ID NO: 286 - DNA, 2889 bp, Zea mays
caatctgatttcaaaaatcaacaacggcgatgaattttagatgtcgcgatttatctctttcaatcgtaaatccgaaagccggtcatatctcaagacgatttattttcgaatcatgcgtacggaattattgccgagcgaagtcagatcagactctcggccgagttaatcgctcaatcgtctgttcgtcggaactctaattcgttatgttctccatagagacaaattccacgggagcatttttattctgggaaatatttagcgcagcccgattacgtgtattgggccagcccaacccagtccatttggaaccctaaccctaggactcctctataaatacaagtgcctcaccttgcaaattggaaaatttgcatctaccccctagccgccacaaccttcttccttctctcccacacgcacgcagctctcttcttctctgttcatggcgcaggaaatttcctccccacccatggcgtccttccctcctcccccttcttcttcctcaagcaagcaggccgacctctcctcctctgccatttcccagcgccaccttatttttttcccctgtctctttcttcctcacggctgcaacagggagctcagctccttctcccatggcgctcggcgcccctgcagcacggcgcccttcttccccagcaacgcctctgctccagccgaccttcttcctttcccccatctgagcgcccaagcctgcgcccttccctgctccatgggcgcgagctccacctcctgcaatggatgctgcatgagctcaacccatgggcgcgttccctgctccacggccagcaggaatccagcacccctctcctgctcggccacatctgcgcacagagagttcttccccacgcctccctctttctttcccacgaagcaagaagggaacacggccaacgttatcttcctcccatggcttcctccctgccacgtctcacctctggtcgacgccttgcacagtgccctctctcccatggcgagcagctttcctcactatggtcatggtctgcgacaggaagtcgtgcgctacatgttcgatgttttgcacagcagccccgacgtctcctcgtggacagcacgtcgtcgacgctcactggttgtttgctgtttttacgcagccccaacatcgacttcgttcacccccgatgagtcacccctctgcccttgctgttatcatatttttgtgctcggtaaaatgttgaactgttgtgtgtgtctaatcgcagctatccgtcaatgccatccgttgtgcacgcgtgttcgattcaaggtcggttgggtgaaccacatgcatgcacaactcgaatctgatctagtccaggtttattgatttatagtttaccatacgtatgatttggttgatgtcatgcagtgcatgtatatgtgtggatgtgtgtaaaatgtttcggttatacacattagtagggtcgcatttgcggttggagaacaagaggttgtttgatgtgtgcgatttgtagtttgtctaattatgttttggtcgatgtggtgtatattggtgtttgaatatatgtggctgcgatggttcatttatgtgtcacaaggatggttcgtggaggtattaattgtttgttaaaatacttcgtcgtaaagcattgtgttaattgtggtaaatctaaaaaagcaaaaagaaggcttggtggtttccgcagtcagctaacgagttagtctatgttaaatatattttatgtattcatcgtggtgtgggttagagtgggttgaaaatataaattatgtgacatgtgattagtgttttaaagatgagatgtgcgaataatcagttggtgtttcactcgtctagtcgataagtgttgtcataaataattgtgctaaaatttggtcataagaatgcagtgggcacatggtgttggttggatgtgataagtagattggaagtgtgggtttgtctaagcactgtgttgtcgaacgtctatgtcgaagtgcattgtagtaatgattgcgttaagcaaaaagtaatgtctcgagtgcacaccacagtatggttgtatgcgagacggggttacgcgcatggtgagtttagtaaaattccatcggtgtcacatgtgttaagttgaggtttatttgtatatggaaagtagtaatgtatttaatacttagaactcttagtcgatggtagaaattgtcttggcttaaatagagaggtggtgacatgtcaaggtagtcatcatttcctctatattaataagtcgagtcaatacgcattatgcgttgattaaatttcacatcgcccatagtgtatggttgtgttcatgacctcgaatagatgtttcgagtggacaagtaggtttgtaatgcaagatgcgtgatgaagttagtttgttgtagaatatttgttgaaatgctccattcatgtgatagacatgtatgtttaattcaaatcgagtcgatgtgtgtgatgatgatattcatgaattaagtagatgtcctgtaattgtgtagtgaaggttaggttaagttgcaagcgatgtgggaatgtttggtaatgatatatgtgaaatgtgaatgagacatccaatgtattcggtatgtcgcgtagtggtggtattaaaaatggttagaaatcgatcggctaaatgccatgttcggttagtgttttttggttaaatgggattgtgtggtgaagggatggcatgactgcgtagccatcacgtcatctattgggtgactatgcttaagtgtgtcttgatataagttagaataattccagtctctagaacatggcaattcttgaattatagaggagctgaaaattattaattgctgttttgggctccacgcactgttttcgccgtgctgtttttttaatgaaccaaattatgttttctgtagaaactccat

SEQ ID NO: 287 - DNA, 2888 bp, Zea mays
attagtttcaaggtttttatgcttaataaatgagaacaatttttgcagtgcatccacaacaatggcatactatctttgacatttgtcgccactacttgtagtctaacaatttcatcatccttcatttgggcgtccacttgcagctcatcaacattatgcaaaaggttttgagctacttcagtagcccgctttacctgtaagttcttcctcttaattgtcccacggtaacattctatcattgtcttaagttgtttccacacaaaattctttttcgtttgttatgctgaaatttcattgtgcttatgtaatcttaggatcttgtaagctttatttagtttcttaatctcttctataatatcttctccatttttttggggatccaaattgtcaatactaatctatgaaataaagtttagtcccgacaattcggatcgccaaaaaagtgaggaagatattaggtaacagataaggaaactaaagaacgcttccaagatcatgagatcagataaggacaatgaaaattcagcataactagcggaaaagaattttgtgtggaaccagcttaagtcagtggaagaagattacattgggaccattaagaggaagaacatataggtaaagcaggctattaaagctgctaaaaagcttttgcataatgtttatgagctgccattgggtgcccaaaagaaggatgatcaaatttttagactacaaatagtggcgacaaattccaatgagaggatgtcatttcttgaagatgagctacaaaaattgtcgtctttggtcaaggataaagatcttgaaacttataaaaataaaatcaactagagactaaaatgcaagatatagttgtagtccagattaacaatccaaatgaggcctaactatatgaacaggtggttagcaggttactgggttctttttgggtgagaaacttctgatgttggtggatttttctatgtgggtaaacgtaaatcatgtcacatctactcttctagagactaaacacaagagttaggtgcagtttagtttaactaatccaattgaggttagcaggttactggggtgttattggttgagaaacttctgaggctggtcgattttttatgtgtgtaaaacctcaatcatagcacatccactcgtaagaagactcggttgtattcctattaatagaaatgggtgtctctaagaaatgtggactaacttgatatttatagacaagtttggtggtctcgtgggcaatttactctagcaggccccaaaagtgaaacaacaagttacctacttctccacaagaaagtagcaatcaataacatgcatgtttgtcaaactgaccactgcgacccgattgcagcaagagcgcacgacagttcctaatgcacgagacccaatttgcacgatacaccataagggtgaaaattaagtcagatgtatgatcgcatgtaaaagcgagattaatttccaggcctgctctgacggtataaacaagtgacactatattttttagacctgctaaccacctgtcataaaggtgatatagttaggcctcatttgaatcagctaaactcgactgtagctaactcttgtgttttagtgtctttgttgatcttaatttttattagtttcaagatctttatgcttaacaaaagagaacaattttcgcagtgcatccacaacaaatggcatactatctttggcatttgtcgccactacttgtagtctaacaatttcatcatcctttatttgggctcccacttgcagctcatcagcattatgcaaaagtttttgagctgcttcagtaccccgttttacctgtaagttcttcctcttaatggtcccaccataacattcttccattgtcttaagttgtttccacacataatttttttcgtttgttatgctggaattttattgtgcttctctaatcttaggatatggtaagctttctttagtttcttaatctcttccctaataactattctaattttctggggatccaaattgtcaatactaatatatgaaataaagtttagtcccaacaattcggatcaccaaaaaagtgaggaagatattaggtaagagataataaaactaaagaaagcttccaatatcatgagatcagaggacagtgaaaattcagcataatagacaaaaaagaattttgtgtggaaccaacttaagacaatggaagaagattacactgggaccattaagaggaagcaaatagaggtaaagcaggctactgaagccactaaatagtttttgcataatgttgatgagttgcaattaggtgcccaaaagaaggatgatgaaattgttagactacaaataatggcggcaaatgacaaagagaggatgtcctttcctctttaggatgagctgcaaaaattgtcgtctttggtcaaggataaagatcttgaaactttataaaaataaaatcatccagggactaaaatgcaagatttagttgtagtccaaattaactaatccaaatgaggcctaactataagaataggtggttagcaggttactaggttcttattgggtgagaaacttctgatgctgatggattttgctatgtgggttaaacctgaatcatgtcacatccactcttctagagactaagcacttgagttaggtgcagtttagtttaactgcggcctatatataaaaaatgtggactaacttggtctctatagacaagtttttagtgatcttgtgggccaaaagttagacaaaaagttaccttcttctccatgagaaattagtaatcaataacatgcatgttggtcaaactatccactgagacccgattgcatcaagatctggcacacggacgaacttcagacagaaatgcaccatcaggactcacaaaatcaataggcctg

SEQ ID NO: 288 - DNA, 2886 bp, Zea mays
  misc_feature (2686)..(2692): n is a, c, g, or t
ccccgacccgctaggttcttttccactgcggcgaattagagcttgccagtgccgctgcgcgtcagtccgccgcacctccatgacgtgcggctgatacagctccactccttgcccaagttgtggccctagatgtaacaaacccctcacccgagcccgcgctttcttcggtgtgctcgatcgccccactttgtggctcggattgctcaccagagtacccccgacccacaaggttcttgtccactacggcgaattagagcttgtcggtgccactgcgcgtcggttcgccgcacctccatggcgtccgaccgatgcaactccaccccttgcccaagttgtggccctagatatcccaaacccctcaccggagcccacgttgtccacggtgcgctcgatcgccccactccgtggctagggttgctcgccagagtaccccctacccgcctggttcttctcctctacgtaaattagagcttgccggtgccgctgcgcgtcggtccgccgcacctccacggtgtgcggccgatgcagctccaccccctttcccaagttgtggccctagatgtcccaaacccctcaccggagcccgcgctatcctcggtgcgctcgatcaccccactccgtggctgggattgctcgccagagtagccctgacccgcccggttcttctcctctacgtcgaattagagcttgccggtgccactgcgcgtcggtctgcagcaccaccacgacgtgcggccgatgcagctccatcccttgcccatgtagtggccctagatatcccagagccctcacctgatcccgcgctatcctcggtgcgctcgatcttcccactcagtggttgggattgctcgctagagtacccccgacccgcccggttcttgtccactgcggcgaattagagcttgccggtgccgctgcgcgtcggtccgccacacctccatggtgtccggccgatgcagctccaccccttgcccaagttgtggccctagatgtcccaaacccctcatcggaacccgccctatccatagtgcgctcgatctccccattccgtggctaggatttctcgtcagagtacccccgatccacccggttcttctctacagtgaattagagcttgccggtgcctctacgcgttggtccgccccaccttcacgacgaatggccgatgcagctccaccccttgcccaagttgtggccctagatgtcccaaaccccgcactggagcccacgctttcctcggtgtgctcgatcgccccactccgtggctaggattgctcgcaattgtacacccaacccgcctggttcttctcctctttggtgaattagagcttgccagtgccgctgcacatcggtccgcagcacctccacggcctccggtcgatgcagctccaccccttgcccaagttgtggccctagatgtcccaaacccgtcatgggagcccgtgatatcctcggtgcgctcgatcaccccactccgtggctagattgctcgccagagtatcctcgacccgcccggttcttctcctctgcggcgaattagagcttgttggtgccgctgcgcgtcggtctgccgcacctacacggtgtccgactgatgcagctccaccccttgcccaagttgtggccctagatgtcccaaacccctcaccgaagctcccactgtcctcggtgcgcttgatcgccccactccatggcttggatttatctccagagcacccccgatccacccggttcttctcctctgcggcgaatgagagcttaccagtgccgctgcgcatcggtcggacgcacctccacaacgtccggccgatgtagctccaccccttgcccaagttgtggccctagttgtcccaaccccctcaccggagcccgcgttgtcctcggtgcactccatcgccccactccgtgactgggattgctcgccagagtacctccgacccacatggttcttctcctctgtgacaaattagagcttgctggtgccgctgcgcgtcggtccgccgcacctccacagcgtcggactgatgcagctccaccccttgcccaagttgtggccctagatgtcccaaatccctcaccagagcccgcgctgtcctcggtgcgctcgatcgccccactatgtggatgggattgctcgccagagtacccccgacccgcccggttcttctcctcttaggcgaattatatcttgccagtgccactacgcatcggtccgccgcacctccacggcgtccggccgatgcaactccaccccttgcccaagttgaggccctagatgtcccaaacccctcaccggagcccgcactgtcctcagtgcgctcgatcgccccactctgtggttgggtttgcttgctagagtacccccgacccgcccagttcttctcctctgcggtgaattagaactagccagtgccgctgcacgtcggtccgtagcacctcctcgacgtccgtccaatgcagctccaccccttgcctaagttgaggccctagatgtcccaaacccgtcaccggagcccgagctggcctcgctgcgctcgatcgccccactccgtggatgggattgctcactagagtagccccgacccgcccagttcttctcctctatggtgaattagagcttgccggtgcctctgcacgtcggtccgccgcacctccatggcgtccggccgatgcagctccacccctnnnnnnngttgtggccctagatgtcccaaactcctcactggagagcccgtgttgtcctcggtgcgctcgatcgacccactccgtggctaggatttctctatagagtaccctcgacccgcccggttcttctcctctacggcgaattagagcttgtcggtgccactacgcgttggtctgtcgcactgtcacacccggttttgg

SEQ ID NO: 289 - DNA, 2881 bp, Zea mays
gaataacggagtccccactatcgagtgattacaaagagaataactgaataattcagttatgactgcgaaataactgagtaatgagcagagaataactgagtcatcacaccagaataactatatgcgcccattagaataactgagttccgacaaaagaataattgagtgacgaacatggaataactgagtcgcacatcgcaataactgaggtattataacataataactgagggatcagaaccgaacaactgagtgccgacaccagaataactgagtctgcacacaataataactgagtgggcacattccaataactgaggtatgatgataactgagggatcggaggagaataactgagttagcccacaagaataactaaggtattggaacggaattactgagttctgtcaccataataactgagtgcgtgcattagaagaactgagttgttggaacagaataactgagtaatgaacagataataactgagtagtgaacaatagaataactgagtgtgcacaacagaataactgagtaatgaacaatagcataactgagttacttgaacgcaataactgaatgtgaatagagaataactgagtaataaacaccgcataactgagtgggcacattacaataactgaggtatgatacaggataactgagggattcgagtagaataactgagtaatgtcacacgaataactgagtgcgtcgattagaataactgagtaatgaacgcacaataactgagtaacgaactgagaataactgagggatcagaaccgaacaattgagtgccaacaccagaataactgagtctgcacaccataatcactgagttagcccacaagaataactgaggtattggaacggaattactgagttctggcaccagaataactgagtgcgtccattagaagaactgagttgttggaacggaataactgagtcatgaacatataataactgagtaggcacattacaataactgaggtatgacacaggataactgagggattggagtagaataactgagttctgtcactcgaataactgagtgcgtcgtctagaataactgagtaatgaacgcacaatacctgagtaacgtacaaagaataactgagtgttgaacatggaataactgagggcgcgcattagaataactgagtaccgacattagaataactgagttaggaacatggaataactgcggtattataacataataactgagggtttagaataactgaggtattataacggaataactgagggattggagtagaataactgagttggcccacaagaactgaggcacgagcagagaatagctgagtttcgtcaccagaataactgagtgatgaacacagaataaccgagtactgaaccgagaataactgagaaatgaacatggaataactaagtgcgcccactagaataactgagtgctgactccagaataactgagtcggaacagtagaataactgaggtattagaacggaataactaagtaattagtagaataactgagttattagaacagaataactgagtgtgcacattagaataactgaggtagtagaacgtaataaccgagttccgtcaccagaataacttagtactgacaccagaataactgagttattagaatggaataactgagtaatgagtagagaataactgagtgtgcacattagaataactgaggtagtagaacgtaataactgagttccgtcaccagaataactgagtactgacacaagaataactgagtcgccacactagaataactgagttactggaacggaataattgacttgtgaacagagaataaccgagtgggtacgttacaataactgagttattataacggaataattgagggattggagtagaataactgagtcacgagaagaaaataaatgagtcggcccacaagaataactgaggtattagaatggaataactgagttctgacaccagactaactgagtgcgtccattagaataactgagtggcacataaataacttgcacatattacaataactgagttgcacatattagaataactattcagaataaaataactgagtggcacataaaacaactgagcgttcatcatagaataactgaatttggaacataaataagtgagcatccagtacaatataatcgagtggtggatctcgtcgaggtccaaatgacatcaccctacaaactctaagtagcctgacttggtagcagctgaggcagcctgtcatctgagccgactagtcctccttgcagcaatgaccaaccttttggccaggagagcgtcacggcggatggtggaggtgtgcccaatatgctgatggttacttcctccgtgctactacttgtgcgtagttgccacaatggaggtaaccaccagcacattggtcactagcaccccaagcccttctcagcataaaaagaacaaagtataaataactgacatggctacaaaagagaaataggcagaaaacaaaataagggcttactgctaaggctgcatgaacacgactacaccttcactccaaattcaatagctgcatcataccttccaaagagtccttaagttcttgttccttattttgtaatgcatcaatctccttcgtcagttcatccactatgtctcgcaagtcccccaacaaattcgtgatatattgaggaaaaaccggatgatgccattgaaagaaatcgcatctctctaggtcagactaatcacatctctctaggtcccgaccctaggttcccatctgcattcgacacgggagccctccttctagcgtggcttgtggccacttccgcatgtacctgtcggtagcctggacccgtggggaatccagaagggttt

SEQ ID NO: 290 - DNA, 2880 bp, Zea mays
caattcgatttcaaaaatcaacatcggcgatgaattttagatgtcgcgatttatctctttcaatcgtaaatccgaaagccggtcatatctcaagacgatttatttttgaatcatgagtagggaattattgccgaacgaagtcagatcagactctcggccgagttaatcgctcaatcgtccgttcgtcggaactctaattcgctctgttctccatagagacaaattccacgggagcatttttattctgggaaatatttagcgcagcccgattacgtgttttgggccaacccaacccagctcatttggaaccttaaccctaggactcctctataaatacaagtgtctctctttgcaaattggaaaatttgcatctacccccctagccgccacaaccttcttcctcctctcccacacgcacgcaactctcttcttctctgttcatggcgcaagaaatttcctccccgcccatggcgtccttccctcctctcccttcttcttcctcaagcaagcaggccgacctctcctcctctgccatttcccagcgccaccttcttttttttccctgtctctttcttcctcacggctgcggcagggagctcagctccttctcccatggcgctcagcgcccctgcagcacggcacccttcttccccagcgatgcctctgctccagccggccttcttcctttcccccatccgagcgcccaagcctgcgcccttccctgctctatgggcgcgagctccacccgctgcaatggacgctgcgcgagctcaccccatgggtgcgttccctactccacggccagtaagaagccagcgcccctctactgctcagccatatctgcgcacagagaattcttccccatgccaccctctttctttcccacgaagcaagcagggaacacggccaatgttatcttcctcccatggcttcctccctgccgcgtctcacctctggtcgacgccctgcacagcgccctctctcccatggcgagcagctttcctcccaatggtcatggtctgcgacaggaagtcatgcgctacatgttcgatgttttgcgtagcagccctgacgtctccgtgtgctgcctgctcgctgttttgtgaagcccagtggacagcacactgtagacgctcaccggttgtttgttgtttttacgcagccccggtgagtcaccctgctgcccttgctgctatcatatttttgtgctcgataaaatgttgaactgttgtgtgtgtctaattgcagctatccgtcaatgccatcctccgcgcacgcgtgttcgatacaaggccggtcgggtgaaccacatgcatgcacaactcgaatccgatctagtctaggttgattgatttatattttaccatacgtatgatttggttgatgtcatgcagtgcatgtatatgtgtggatgtgtgtaaaatgtttctgttatacacattagtagggtcgcatttgcggttggagaacaagaggttgtttgatgtgtgcgatttgtagtttgtctaattatgttttggtcgatgtggtgtatattggtgtttgaatatatgtggctgcgatggttcatttatgtgtcatgaggatggtttgtggaggtattaattgtttgttaaaatacttcgtcgtaaagcagtgtgttaattgtggtaaatcttggtggtttccgtagtcggctaatgagttagtctatgttaaatatattttttgtattcatcgtggtgtgggttagagtgggtttaaaatataaattatgtgacatatgattagtgttttaaagacgagatgtgcgaataatcagttggtgtttcactcgtccagttgataagtgttgtcgtaaataattgtgctaaaatttggtcataagaatgcagtgggcacgtggtgttggttggatgtgataagtagattggaagtgtgggtttgtctaagcactgtgttgtcgaatgtgtatgtcgaagtgcattgtagtaatgattgcgttaagtaaacagtaatgtctcgagtgcacgccacaatatggttgtatgcgagacggggttacgcgcatgttgagtttagtaaaattccatcggtgtcacttgtgttaagttgaggtttatttgtgtgtggaaagtagtaatgtatttaatacttagaactcttagtcgatggtagaaattgtcttggcttaaatagagaggcggtgacatgtcaaggtagtcatcatttcctctatattaataagtcgagtcaatacgcattatgcgttcattaaatttcacatcgtccatagtgtatggttgtgttcatgacttcgaatagatgtttcgactggacaagtaggtttgtaatgcaagatgcgtgatgaagttagtttgttgtagaatatttgttgaaatgctccattcatgtgatagacatgcatggttaattcaaattgagtcgatgtgtgtgatgatgatattcatgaattaagtagatgtcctgtaattgtgtagtgaagcttaggttaagttgcaagcgatgtgggaatgtttggtaatgatatatgtgaaatgtgaacgagacatccaatgtattcggtatgtcgcgtagtggtggtatgaaaaatggtttagaaatcaatcagctaaatgccaagttcggttagagtttttttgttacttgggattgtgtggtgaagcgatggcatgactgcgtagccatcacgtcatctattgggtgactatgcttaagtgtgtcttgatataagttagaataatttcagtctctagaacatggcaattcttgaattatacaggagctgaaaattattaattgatgttttgggctgcacgcactgttttcgccgcgctgtttgtttaatgaaccaaattatgttgtccgtagaaaagccat

SEQ ID NO: 291 - DNA, 2880 bp, Zea mays
atggatattctacagaaaacatgatttggttcattaaacaaacagcgcggcgaaaacagtgtgtgcagcccaaaacagcaattaataattttcagctcctgtataattcaggaattgccatgttctagagactggaattattcttacttatataaagacacacttaagcatagttacccaatagatgacgtgatggctacgcagtcatgccatcccttcaccacacaatcccaagtaacaaaacaactctaactgaacttggcatttagccgatcgatttctaacccatttttcataccaccactacgcgacataccgaatacattggatgtcccgttcacatttcacatatatcattaccaaacattctcacatcgcttgcatcttaacctaagcttcactacacaattacaggacatctacttaattcatgaatatcatcatcacacacatcgactcgatttgatttaaccctacatgtctatcacatgaatggagcatttcaacaaatattctacaacaaactaacttcatcacacatcatgcattacaaacctacttgtcaactcgaaacatctattcgaagtcataaacacaaccatacactatgggcgatgtgaaatttaatgaacgcataatgcgtattgactcgacttattaatatagaggaaatgatgactaccttgacatgtcaccacctctctatttaagccaagccaatttctaccgtcgactaagagttactttccacgcacaaataaacctcaacttaacacaagtgacaccgatggaattttactaaactcaccatgagcgtaaccccgtctcgcatacaaccatattctggcgtgcactcgagacattactttttacttaacgcaatcattactacaatgcacttcgacatagacgttcgacaacacagtgcttagacaaacccacacttccaatctacttatcacatccaaccaacaccacgtgcccactgcattcttatgaccaaattttagcacaattatttacgacaacacttatcaactggacgagtgaaacaccaactgattattcgcacatctcgtctttaaaacactaatcatatgtcacataatttatattttaaacccactctaacccacaccacgatgaatacaaaaaatatatttaacatagactaactcattagccgactacggaaaccaccaagatttaccacaattaacacactgctttacgacgaagtattttaacaaacaattaatacctccacaaaccatcctcatgacacataaatgaaccatcgcagccacatatattcaaacaccaatatacaccacatcgaccaaaacataattagacaaactacaaatcgcacacatcaaacaacctcttgttctccaaccgcaaatgcgaccctactaatgtgtataaccgaaacattttacacacatctacacatatacatgcactgcatgacatcaaccaaatcatgcgtatggtaaactataaatcaatcaacctggactagatcggattcgagttgtgcttgcatgtggttcaaccgactggccttgtatcgaacacgcgtgcgcgatggatggcattgacagatagctgcgattagacacacacaacagttcaacattttaccgagcacaaaaatatgatagcagcaagggcagcggggtgactcaccgggggtgaacgacatcgatgttggggctgcgtaaaaacagcaaacaaccggtgagcgtcgacggtgtgctgtccagtgggcttcacaaaacagcgagcaggcagcacgcggagacgtcgtggttgctgcgcaaaacatcaaacatgtagcgcgcgacttcctgtcgcggaccatgaccatagggaggaaagctgctcgccatgggagagagggcgttgtgcagggcgtcgaccagaggtgagacgtggcagggaggaagccatgggaggaagataacgttggtcgtgttccctgctttcttcgtgggaaagaaagagggtggcgtggggaagaactctctgtgcgcagatgtggccgagtaggagaggggcgctggcttccggctggccgtggagcagggaacacgcccatggggtgagctcacgcagcgtccattacagggggtggagctcgcgcccatggagcagggaagggcgctggcttgggcgctcggatgggggaaaggaagaaggctggctggagcaaaggcgtccctagggaagaatggcgccctgctgcaggggtaccgagcgccatgggagaaggagctgagctccctgctgcagccgtgaggaagaaagagacaggggaaaaaaagatggtggcgctgggaaatgcagaggaggagaggttggcctacatgcttgaggaagaagaagggggaggagggaaggacgccatgggcggggaggaaattacctgtgccatgaacatagaagaagagagctgcgtgcgtgtgggagaggaggaagaaggctgtggtggctaggggggtagatgcaaattttccaatttgcaaggggaggcacttctatttatagaggagtcctagggttagggttccaaatgggctaggttggcctagcccaaaacacgtaatcgggctgtgctaaatttttcccagaataaaaatgctcccgcggaatttgtctctacggagaacagagcgaattagagttccgacgaacggacgattgagcgattaactcggccgagagtctaatctgacttcactcggcaataattccttatgcatgattcgaaaataaatcgtcttgagatatgatcggctttcggatttatgattgaaagagataaatcgtgacatctaaaattcatcgtcgatgttgatttttaaaatcggattg

SEQ ID NO: 292 - DNA, 2877 bp, Zea mays
gttaggtgcagtttagcttaactgatccaaatgaggcccaactatatgaactttgtgacatatagttagcaggttactggggtcttattgggtgagaaacatcttaggctggtcaattttttacgtgtgtaaaacctcaatcatgtcacatccactcgtaagaagactcggttgtattcctgttaatagaaatggttgtttcctctctaaaaatatgttgactaacttggtctccatagataagtttagtgacctcgtgggcaatttactctagcaggccccaaaagtcaaacaacaagttacctacttatccataagaatgtagcaatcaataagatgcatgtttgtcaaactgacaactaatacccaattgcagcaagaccgcgtgacagttcctaacccacgagaccaaatttccagtagaaaagcatgcataagattttgttgacacaaagttgatatagttaggcctcatttggatcagctaaactcgactacagctaactcttgcgttttagtcttttgttgatcttcatttttattagtttcaagatcttcatgcttaacaaaagagaacaaatttcccagcgcatcctcaagaaatagcatattatctttggcatttatcgccactacatatcatctaacaatttcaacacctttatttgtgctcccacttgcagctcctcaacattatgcaaaagcttctgagctgcttcagtagcccactttacctgtaagttcttcctcttaatggtccaaccgtaacattcttccattgtcttaagctgtttccacacataattctttttcgtttgttatgctgaaatttcattatgcttctctcatcttaggatctagtaagctttctttagtttttaatctcttccctaatctcttctccaattttttgggatccgaattgtcaatactaatatatgaagtaaagtttagtcccaacaattcggatcaccaaaaaagtgaggaagatattaggtaagagataagaaaactaaagtaagcttcaaagatcatgagattagaggacagtgaaaaaagaattttgtgtggaaccagcttaaggcaatggaagatgattacactgggaccattaaggggaagaaaatagaggtaaagcaggctactgaagccgctaaaaagtttttgcataatgttgatgagttgcaattgggtgccaaatgaaggatgatgaaattgttagactacaaatagtggcgacaaatgccaaaaagaggatgttgtttcttgaggatgagctgcaaaaattgttgtctttggtcaaggataaagatcttgaaactttataaaaataaaatcaaccagagactaaaatgcaagatttagttgctgtctagattaactaatccaaacgaggcctaactatatgaataggtggttagcaggttactaggttcttattgggtgagaaacttttgatgccggtggattttgctatgtgagtaaaccctgaatcatgtcacatccactcttctcaagactaaacacaagagttaggtgcagattagtttaactgtggcctatataaaataatgtgtactaacttgttctctatagaaaattttttagtgatctcgtggaccaaaagttagacgaaaagttacctacttctccacaagaaagttgcaattaataacatgcatgttggtcaaactgaccactcagacccaattgcagcaagatttggcacacggacgaactgcaaacataaatgaacagtcaggactcacaaaatcaataggcttgtgctattgctctctctctctcactcaccgagaagacatgtacacaactctctatcttgtgagtattaggagcatcgtcttgctagctttctcctaccagagcaccacactttctcatagcactagatggcacatcattgatggatccctacatacaacgctagcactcattaaataaatagaagtagacgacgacatgcctagaaactacacctctcgtctcgtctgggccacatgatgcacgcgtcttaccatgagaagtggtcactactgcaggccaaccgtacatgtctctccaaacataggctgcactagagcgcgttcttcaactagtggacgcaagactcgcactaaatggaggcatggtctgcatgcacaaggcgctagcccgcacgcctcctccattgctccatgatatggggcgcgtcctttggctctgcaatccacctgaaccgctccactttttcatgtactcatcgttaaactccagcaggtttcatataaactcatgcatagtactagtatatggcatggcactccggtcgaaatccaggactgatggtctgatgtgctgcacgcatgttaggtaagcttcacacattagtcgtgcttgcttgttcgtggagctagcttgctagtctttccctttctggtgttcttgcacctagctacagcagatcacgagagctttcaagaccgttgtacgtgctagaggccagaggctctccctagctccatctgaaaaaggctgtaggaggaaatgacttttgatcgagccgctactgttggtgctacatctcttaggctctatattgatccatatccatgtttggtactagtacggcgtgatcgtcagcaccacacacaacactgttcggtcctagtgcaatgatggcaccttgatcgtctttctacgtctccgtcaaaaatgaactaataataatattcaagaaaaacaaactttatatacggtcggtcgtacttacttaaagctaatagttaatgtaataaataaagcaacaaattcaaaaaagggattacattatttgagtatttagttcgtgaataagttggtcccgatcaagtcgacctt

SEQ ID NO: 293 - DNA, 2876 bp, Zea mays
gatacattgtgggtgtccacacagttgcaccatgcccccgcctcgagaatcccgccctcgactaccaccgaccccgcggtaccgtagcgaccccgttcatcccgccgcccaccacgcacggactgcctccctccctccaccccggctgctgccgacagcgcgctaccctcgtgaccccgttcatcccgccacccccacgcacggactgcctccaggatgctcggccctaacagcgccctacctccctcccccacctcgttcatcccgcccccattcatcccgtgaacccatccccgcgctcccctcctctaccccatccatctcgccgtcgtcctcgcccgccctgcctccaacgatggggagccccatccgcaacctcccgcagtccccggtcacgccagcaacgcctcccagattcttccccgttcatcccgccgcccaccacacacgtactgcctccctccatccaccccggctgccaccgaccgcgcgctaccctcgcaaccccattcatcccgctgccccacacacggattgcctccaggatgctcggccctaaccgcgccctacctccctcccccaccccgttcatcccacccccgttcatcccatgaacccatccccgcactcccctccgctaccccatccatctcgccgtcgtcctcgcccgccttgcctcccacgatggggagccccatccgcgacctccctcagtccccaatcacgccagcagcgcctccctgattcttccccgttcatcaagccgcccaccacgcatgtactgcctccctccctccaccctggctgccgccgaccgcacgctaccctcgcgaccccattcatcccgccgccctcacgcacggactgcctccaggatgctcggccctaaccgcgccctacctccctcccccaccctgttcatcccgtgaacccatccctacgctcccctcccctaccccatccatctcgcctgccctgcctcccacgatggggagccccatccgcgacctccctcaatccccggtcacgccagcagcgcctcccagattcttccccgttcatcccgcccccgcccgtgatccctccccgcgctcccctccgtgaccatcggactcccttcgatggtgcggcccttccatcgacgccgacccgtactgctatttaaaaaatccaaagcgatgatgccaccccacccccatcctcctcggatgtgcagaaatatcaaacatcactaaggtgcgtcaactctattcttgatacttctgtttctgttgttctcaaggatttggattcaacattgtactagcagtttggaatcaccaggcagtgatgctttccatctagccttgtttagtagtgaagacaaaaacagtagtgaatcaggttatgtaatttttttcttttagattatgtgtaatatatttttgcttgaacgtctcggatttaactaatgttgtttctgttgtaatcaacatggtatcactgtttagggtttagggtgctccttactggcattgggcttcagttgaaacccatttaacatccgaactgttcggcattacaattcattgtatagtatcatgtggttgaagctccttactggcactgggcttgtttacaaactattttactaaacagttgaatccaattttaatttgaactcatagtatacatgattctatataaatcatgtctcattcacaagctttccggttcttcatttcagagctctaaagccgattacgtacacctcttcttaccacgtacgcactttaatctgctttctggtttagagcgcagtctcctcggcaacttcttctactgctaactcgggtgcaaggcaaggtacacatatatttcatatatagtagttgtattcaacatgatggtagctgcgaggaggattctattcagtatttatttggaaatgtagttctgaggcaatcccttggtgttggttgatttgtaaacctacaagttagacttaacacgcatcccacatctctaggctttccttattgcattgggcatgaactgattgctggtatgagttgatctttggagtgttttctaaaaggtttaagcacaatgggcatgggtacaaactaattggccaagggtttacactgttttttcatgataacacttgatacatagaaaatagacatatggtttttatgtttgaccatatttcggtaaaagcctcatgatggtagctgcgagcaggattctattcaggatttatttggaaatgtagttctaaggcaatcccttggtgttgtttgatttgtaaacctacaagttagacttaacacacatctcactgttggttgattttgtaacggtggatttaaacttaacgctatgagtagtactgatggtgtctcccattgtgggaaaagccctttcggtatcaacttttgacaacaaaaaatgacatttggtttacacatgatctagaatgccgattgcttcacatctagatgtccttgttagtggtgttatatgcttcacccatgatggtattgactaaaattgtgatgttgaacaatagtggctcttagttgtttctagtctagctacttggaatactgccaatagaaatcataatagtgccagtcagttattttggcaaaccattatccaacaattgttgcaggggtacggtcgatagtcatatgttttttgtgtttatcatttgtgcttgaaggtggtctgtttacagacaacgctcaactgccatataaatattcacactatgttccaaataaaactgacataaatatctgcactgttaggagatgaatcactaaacaccgtctatgatctgaccatacctatgctctgtttagccagtgctgtggacaagttgtcgc

SEQ ID NO: 294 - DNA, 2872 bp, Zea mays
caaagaatcttaaaacatggatcgaaataaaagcataattgcataaatatagctctcatctccggaaaattaccgatctaaaaaatatacatgatgcactttaaacatttctaaagttacctcattcttcatatctacaaactatagtggcagcattcgaacatacaatatcatgggccccaaactcaagctataggttgtcttgcacttaggttgatgatgaagcatgtgaaacaacatgttgcatagctcacgcctatagtaaattgatgacccgaaaaaaatctacatgttgttcttcaagcactctaagagtcacctcatcctttatatgaccaaatctactgctagaatgcgacaatctagggtcgcatactcatgttatggttgtctcgaacatgggttaacgacggtccatgcgaaacaacacgttgggccatctataaaaactgtctgtctaaacaatacaatatttagggcttcaaaatgcttcgaagttgacgcacatcagaaatcgatatatcatgtagcaaacttgtgctaatataatacccattagtccattactcatgttttgatctgccttaaacttgggttgatgtgttcacaactgaggaacattgcaaatagcattatatattttttaaggtaacatgcctaaacaagtatgtcttacaggacgacatttagaaaagagtaatgaaagtggaaatataaattttctttcattaactatttttccattaatagaggttgtaactctacaaaatagtttatcttgaaaaatctgcatattgcaattcaaatacttttaattctttaaaacactgaactttaatcggtatgcgacccgctaattatgtgggtcttatactcaagttattgattgtgttgaattttagttgttggtggagcgtgtcaaacaacatgttggatcattctgtaaatctaccaaataatttagggcttcgaaaagcttcaaagtttttgcatggttcatgccacaatcttttcgtaaaaacatgcacgaaatcgtgacactttactcccaaatcagtgtattgcgaaaacattgatgacaaatcttgttgggtcatttttgtaaaaactaccgttctaaacattacgtcatttagggctttgaaccgcttcaaacttacattaatgttcataaccatgaaacatttgatatctttccacatatcttatgagataacatgcctaaacaagtgatgtttgcagtttggcaatgagcaaattgtaatgtaattttccttggttaaattgttttgtgataaatatcatgagtcccatacttgttttttgagtggcctcaaaacatgcatttttgttcataaccaagaattatttaaaataacactacatatggtttaaaatagcatgcctaaactaatattgtatatagttcggcatagagcaaattttaattaaaattggaatgaattttttctatatttaattcttttgttataaatatcattgatataattgtaatagaataataacaaagtatcttaaaacatagatcgaaataaaagcagaattgcataaacacgactctcaactccggaaaattaccgatctaaaaaatatacatgttgcactttaaacatttctaaagttacctcatttttcatatctacaaactctagtgccagcattcgaatatccaatatcatgtgccccaaactcatgctataggctgtcttgcacttggggtgatgatgaagcatgtgaaacaaaatgttggatagctcacgtctatagtaaagtgatgatctgaaaaaatctacatgttatgcttcaagcgcttctagagtcacctcatccttcatatgaccaaatctagtgcaagcatgctgcaatctagggtcgcatactcatgttatggttttcttgaatataggttaatgatggtgcatgcgaaataataagttgggtccatccgtaaaactgtctgtctaaacaatacaacatttaggttttcaaaatgcatcaaagttgacgcacataaaaaatcgatatatcatacaataaacttatatgaaattaatacccagtagtcccatactcatgttttgattggccttaaacttgggttgatgtgttcacaacgaaggaacgttgcaaatagcacaatatgtgttttaacgtaacatgcctaaataagtttgtcttatagtacgacatttataaaagagtaatgaaagtggaaatataaattttcttccattaatagaggtcgtaactctacaaaatagattatcttgtaaaatctgcatattgcaattcaaatacttttaaagttacctcattcttgaaaacgctgaactttaatcggcatgcgaccatctaattatgtgggtcccatactcaatttaatgattgtgttgaattttagttgatgcagcgtgtgaaacaacatattggatcattctataaatctaccacataatttagagcttcgaaaagcttcagagttttcgtatggttcatgccccttgtactcacaaatcattgtattgcaaaaactttgatgacaaaccttgttgggtcctttttgtaaaaactaccgttctaaacattacatcatttagggctttgaaccgattcaaacttacattaatgtcagtaaccatgtaacatttgaaaaattttcacgtatcttatgatataacatgccaaaacaagtgatatttacactttggcaatgagaaacttgtaatgtaattttccttggttaaattgttttgtgataaatagcatgagtcccatacttgttttttgagtggcctcaaaacatgcattgttatccataaccaggaatcatttaaaatagcactacatatag

SEQ ID NO: 295 - DNA, 2863 bp, Zea mays
tatattccgctcgacaatgagtacggatttaagcacgtaatatcagtggataaaacggatgctaaattttaaacatcttcgcttatcgcgattttaatatcgcatctgtttcatttgtcgcgagtgcgacatcgttttcatttttatctatccgggctcctcctaaattttcgtattgttcggaacttagtcatttcgaaaattggtgcgttcagtggttatttaaaattcatcgctcgcgcaaatacgaatttggagcctcgatcgactcttgagatttttatcccgggcagattaatttggactcgacgacagaaatgttcggagcgaaataatgtgtatcgcacgttgtccgagaaaaatcgtgcgcgaaattattatccaatttattcttcggcacactctgtaaaataataaaatcaattatgtttaggcatcggataaatttttatccgaattcgactaaaccagtattgtctcagattaatgtatctgatatccagtccgtttccgtattgcccgaaacagtcacgaaagctatccgaacgagatttagtcagaatcgtatacctcggattttccgtttcttgatttgaaaaataaagtgtgtagccaattgtcatctagtgcattgatccttttgttgtcgctaaaaatctcgatccacaaatatctgagatttttcggtaaagaaattaaaaatctgaaaaaggaaaaatatcctacgttcctatcctgaagccgctcaagctccggaataaatcctgcgcgtcgttcttatctccctcacgcgcgcgtcttcttctttccctctgcatgctgctgcttctccaccgcgccccagccccagtgcccaggccaaccgcgccaggccttcctctcccctggctcgcggtttcctttctcctccttccatttctctccagccgaagcccctccctgctcggagctccttggggccgcgccccctctgctcgccggcagaagctcccagccgcgcgtatctcccaggcgagcttccctgcttcccagccgtcgctccctgccggatctctgctctgcgcgcgccgtgattttccccatctccatggccgcgccacagccgcccagctgcttctctctctctctgctcgcttcagctcggcgattcctccctgcccagtccgtctccaagctctcggcgccgggattttctgcggactcgcctcactgaccgcgcacagctgagcggttccccacgcgtgctgccgttctctgctcggagcttccctacgcgcgcgcctgtgcccagccgagctactgtttcccctgctccatcttcctgtcgcgcgttcctcatgctctctgcgccggtcgctgcttccatggccgtgccttgccaagatccgtgctgagctcccctgccgctcgctctcctccatggcgcccggacctccctgttccctgcgcccaagttccattttccccagccgactctgctgcttgctcccctgcgcgctgtgctcctctgctctctgtctgcgcgcgctgtgctcgacgtcctcccatggcgctcgatgctcctctgttggccgcatcgtgaagtctctgcgtgccgtgctttttcctcctctaatcggtgctcctgcttcagctcgcccctgcgctcgccggcgcttgcttctggagtctccttgccacacgtctagatcgccctgtctgcgcgccgcgctcccttgtcgtggttttctgcttcctcgtcgcgcgcgtagcgttccattgttcctgcgcgtgctgccgcgaagccccctgtttagttctcctccgtagcgttgtcatgcgcgcgaaactgctcgcagtcgacattgagtctgtgacgcgcgcgttggacacgatgaaatgctacgtgtgtttgtgtccgagcccgaccgtgacctcgctttgctcctcgcgttactgctcgtcgagtctttcctcagtccgcgtcgttcgtcgtcgtgtgtgcagcaacatcgctgattcctccatggtgcctatcgacgaacttcgcttcatcagtttctcgccttcggttcggctcaggtgagaccgccgaacgcgttcgccgtttaacctcgtgtcgttagagctcgtgatctcgctgtggtcagagtcctcactggattcgtgtcctcgctagctcacttcagactcaatctcgtcgtcgttccacgcgtcatcaagaaatcccaagcgtcggatgaagatgaagctagcagcgtggtgttcaccaagtgcgcgacaaaaagctcggacatcctgcgcgactcaagttcggttcgtcaaaattattcagtcgaggagatcttcagcaattgattaccgaagaaaaaaaggcccctggatgacgttaaccgaaaaccgtcgtcatgcttgcgactatcgcgtcggattagtcagggtaagtaaatttgttaatcgtgttagtgaattggtggatggtttaactaggaatgatattctatgtatgttgatcgatttggataaatcggtaaaacacgtaattaagatacacaatctaaagagttaataaaaagctaggaataaaaatagattttctggtgttattatgtccatttggttaattgatgtagtcgataccctgcttaattagtcagattgttctaggtttggcgtttaattcgctgtcgtataagtattatttaggtttgcgatattcctccttatatgcatacatgtgcattatgcatatcattcaggtacgttaattaattgcgtgatgtggaagacaacccaagtcgaccccaagcgtgggctaatccgcaagatcatgttgatggacgaaccggaagatggataatctgaacgagtgcgtgccaggaca

SEQ ID NO: 296 - DNA, 2857 bp, Zea mays
agataaagctacccaaagaatattaaacatttatatcaagacatcgcaactctaatacaaaaacactaggtgtcgatatcacataaagaactatagctatggtattctaacttaatcgaatcaaccccgaacatcatggaacatcaaactatacacaaactctatatatatataccaaactacaactttagaactaaaagacctaaagtgtttatacgcatcatttatcatgcagaccctagattctagttgaaacaaatatatcgatgttacttgatcctaaatattcgaagtagcaatcaacatccattcaaatcatgaaatcgaccaacagacatagaataccctgccttgtttagagagcacactaaacgactttcaaatttagcttcacaattcttggacacctaacacttataaaattgatagaagaacttttattaactttctaaactgatttcccggctaacctgtgtatcacacatattaataaaacatcaccttttttacctagtcagcatagtatgaccactatcatagaattccacaagattacaactttaacacctacagtcctacaaacactgagacctattgaaacctctttcaccacacgacatcgaccaaatcaccataaacgacttaggcattctaataaatattatacctacaaccacgaaacacatatgcttaaggcaagaggaccaatataattagtatatctagcaaatcccatcatcgaaccaatagcagaaataacaattcgactcaccacataatcatcacgattaatatacctagtcagaccatttatcaatccaactaacacgattaacaataaattggcttaccatgaccaatctaacgcgatagtcggaagaacgtcgatggttttcggttgacgtctttgaccacacccacctggcgagcgatgcacacaatctcgattcttgatcaattattcataggattcattttgtcgagctggtggcgcgtggctagcacaagagcgtcttcacggcttgctgtcgacacaatggaagcagattggtttaatgcgacgagcggaagcactcgtgacgcaaagaagtccccacaacaatgtcgtggaagcggcaacagggtgtggcaacgagctacacggacttggcgaagacgaggatggcgatcaacgatatcgacgtatcagcacgacgatttccattcgacgaagaagatggagcagcaactcctaattcaggcttttcgttgagcacatggggagcatgggtccgggcattgatttcttcttccatacagtcatacaccctcctcgggcgcgacgcaaggaataggcggcacacggggatagcagggtgtccacaatgacagaagagaagttgtgtccatggtggtgacgaggacacacgacgtccatcgtcaaggcgtggccgagcactgcggaccgatgaagtgaagtttgacgacaagaaccatggaggaatcagcaacgttgctgcacacatgacgcggagacgaacgacgacaacccatgacggcgccacgcatacggcatcaacaccatgagcagcggttgtgcttccgtggcgaggagactggagtcagggctaggcgtcggcgtcttggcgagctaatcgaaggcgaacacccaggccatcagcgagctgggcgatgacttaaacatcggcaaacgcacagcagcacgagaggatgtgataacctaggcgaggtcaacggccagtgaggaggcaaggagaatggcggctggcgagcccatgacggcgccgcggatcggaggcagaggaggcggccaaaaccgagcacagaaagccatggctgctgctccgacggcttggggtcggactgggcgagcgcagcagggagccaaggcgaggtcgcggcctgggcgagctctatggtgggaagggcgtcggccatggagtggagcaggggaggagcgcgcgtgggagggacctcggctgggcgcggctggggaagatggagcagagacgcacgccatgggagggacctcggctggggcttcctgggagatggagaggaggccgaacaagccagggagatgaagaagcagcgatggataagtcctgcgcggtggtgaaaatatcagaagggagaggggcggttgtagataagaatggaaaagatattttctttccagacttttttccactttcccatttttttattaaagaaaattacagatattttagggtataaaatgaggtctataagatatataaatgggttgaacaaaataagatcgacaataatatttggaccatatttaatttggtgaatacttcggaatcagataaattttcacccgttatttatatccgaacgtttggatctgggcgagatgcaatcggaacaaaccagaacgatgttaacaacgatattttagactgtgttcgatttgatttaaaatcaaataatttcatccgcagcctcaacatccgactccacggccacagataatttacgtggagaatcgaatctcaattataattccttagacgtgacttctcagttgacgattggagacggaattattttgcaccgaacactttagttgtcgagttttatttaatttgttcagggtgaacatagagggttgaactaaattttcaaattcgtctttgcgcgatcgatgaattttaaataatcaccagactcgccaattttcagaacaattatgttccgaacatcacgaaaatttaggcaaaacccggatagataaagattaaaatgatgtcgaactcacaacagacgaaacagattaagatagagactgttattatcccatgcttaaatccatactcgttgttaaatgtat

SEQ ID NO: 297 - DNA, 2857 bp, Zea mays
tggccttagtcgattggctattgccagcatctgctaagtagcaggtcccaggatcgattctccgtggctgcttgtttttgccgggtgaaggattttgcatgtgtttgcatggtactgtggcggacgtgaaaggtgttcggtgtcgcgtttgggcgtgcatttttttcattcctggcgctcggtgccgcggtctttttttgtttcgtgagttttgggcgcgcattttttcatcggttcggtctttttaccgtgggtttttcattgtttcgttggcgcgcatccgttttttgcgagttcctgtacgcgcggtaccgcctgttgccttctctataaacgctggacaagccatctcctggacagcaccaaagcaacaccacactccccaagctagctccaatggtcgaactggacttgaatgtttcgatggaggaagaaggagatggatggcttgatctaaacattccattagaacatggattcgacctcaatgttcaacaagaagaagccaatgttcctggtgagtactgagcactagtactgacttcaactctcgtttgcaatttttgtgtcaacactcacatttcatgcttccttttttaacagaatttgatctcaacctacctgtggatgagtttggtgcagtcaatttcgacttcgttcaaaacatgacaggtaaagaacatgtccaagtttgttttgcagacttctacagctcgcacacttgctcatgtccatgtttgttttgcagaacatgttgttgaggctccagttccggtgaggcaccgacgtaaagagatggaagaagctatcagaaaacaagtttatcaagcattgttggctagaagcaataatgggacactccacaagaaagatacccaaattgtcgcagatcaatttgatcttcatattaggtcagttcaacgcatatggaagagaggtaaaatacaacttgcaaactctatcccggttgtggtctctagtctaaaaaagggatgagttggtcgtaaggcaattcctattgatttggaagttttgcgtaacattcctctaaaggataggatgacattagaggatgtttgtgccaaacttgacataagcaaatggaaggtgctaaggtatttaaaaagagggttgcttaggcgtcattccagtactatcaagccttatctcacagatgttaacaaaaagactagattgaagtggtgtattgacatggttaataggccggtgaatggtgatccaaggtttagggatttttttgacattgtctccatcgatgaaaaatggttctacttaaaccagaagtctgaaaggttttatttgctccccgacgaagatgatccacataggactgcaaagaacaaaaactacatccctaggcttatgtttttgtgtgttgttgctcggccgagatttagacatggagagtgcatttttgatggcaagattggttgttttcctctagtcacgtatgaaccggctataagaagtaatgcaataactggccgtgtacggggagatatggttatgaagcctattcaaagtatcacaagagatgtcgttaggggattcatgattaatcaagtcttgccggccattagagccaagtggccaagagaagatgtgggcaatcctatttatattcaacaagacaatgcaccttcacatctaaagttagatgatcctttgttttgtgaggctgcaaagcaagatgggtttgatattcgcctcatatgtcaacctccaaattcacctgattttaacattttggatttgggattttttcgagctattcaaagtatccaatacaaaaagaatgcaaaaactctcgaacagctacttccagcagtacaacaggtattgtgttcacacattctttctcaaattgttcacacattcttcatcattcaacaactaatttcatcactgtttttcctctaggccttcatggagttctgtcctcgtaaagcaaatcgcatctttgtaacactacaaactgttttattggaatcaatgaagaagaaaggttgcaacaactacaaaattccacacatgaataaggaaacattagaaagacaagagagactgccaacttgtattccttgtccgccatcgttgctacatgatgctgaggctacacttgctgtgttgtaacatgaacatttcaatattaccgtgaacttaccgatgttttggcgtcgcactcgggtacacagtcccactcttgtgcaccgcgaagaagggcgccgattaggttctccttgttgacgacaccgcagcgagagcatggacgaaatatcgagtgtacacggttccacgatgcacgattctcatgcacgacgttgcacctaccacataaaaatgggccgagctccagctcgccagacttggcctccagcacgacctcatcgtttgagtccagcacgacctccattgcttctgagtccgacacgagctcgaacgtctctgagttaggcacgatggagtgcagtgccatctcggagtctggcgaggacgagacgtggaccttggccacggcgtgcagagagtcaaagtgtggcgcgagctcctcctccatggagtccggcaccaaggactccatcaccaaggagtcagacagggactccttgtccagcgaggccacgatgagcgcagaggagtccgacgaggccacagcgtgcggagaagagtccgacgaggccacggcgagcagagcgtcggagtctggcgaggtcatggcgagcagagcgttgaagtccggcgaggtcacggcgtgcggagaggagttcggcgaggccatggcgagcagagcgtcgaagtccagcgaggccacgacgtgcggagaggagttcggcga

SEQ ID NO: 298 - DNA, 2857 bp, Zea mays
ggccttcagcgtgagccacatccgagaccaaaagcgccagcgaggtgtccttggtgctgcctgccatagacggacggcggcacgaggcaaacgccgcgggcgctctcgagccaacgagcggcacccggggggtgcgctcgacgaaggcaacatgtatcgagtacggcttcccgtgggatgggtagcagcacgcaagcacttctcaatgcagtaggcacatgatgcccgcacgaacgatgggacacatggcatggcagcgggggtcctccaagcagtcacgggtccaagactactcatgcgccagcgtaggcgctacggtcgagccatccaaagcatccctccgcgctgggcacggcgggtctgcctgcgaggatggcgaccgaaggtccaccaagcatgggagaaacaaaaaacacatcgagcaacaggccatcccacagtgcagccactcgtctagggcgtctggccggcagtagccagccatagccggtcgtggctgcgtcacggccgaaccacagccggccaggtagccaacaacgcccagctggagctgggcgcggtagggtgccgaccggccacggctaggccgcaagggggtgcggggctcgaccgaggagacctagaggagtcgttggaaacgctatggttttagcagcgtttcgcccgggtttcgtctgcacgagttccctaccccctactatacctgaggggcatcccccctcccaggacttcggggagatctgccttcagaaactagggcattttcccaggactccacgaaacccatcaaagatggccggacactaggtttttgctcagaatcaggggtttcgctagcgtgacccgttttccctcacgggtggacccgaacttccacgtctcattcgggggaccacgggagggtcccgtgcccttccacgtgtccgttttcgcggccatggccgaaaatctgtttttggcccgcgcgccatggcgaacccctcgttttcagcccaaacgcaaggccgaatagccctgccgcctgttgccttgcacctccgagccgttttccctccgttccaccgtgcccttcaaccaagtcctacgtagcagcctcagtgtctttccacacgcttggacttagcccgttttcgcagccgtggcggaaactctatttttggcccgcacgccatggtgaacacctcgttttcagcccaaaacggaaggccgaacagcactgccgcccttcgccgcgcgcctcctcccgttttccctccgttccaccttgcccttcactcaagacatgccctttaggttcggtgtgtttccacacgcttggacttagcccattttcgcggtcgtggcccaaccgtttttttggcctgcgcgccatggcgaacacctcgttttcagcccagacgcaaggctgaacagccctgccgcccgtcgccgcgcgcctcctcccgttttccctccgttccaccttgccattcactcaagacatgcactttaggtttggtgtctttccacacgcttggactgagcccgttttcgcggccgtggcggaaccgttgtttttggtccgcgtgccatggcaaacacctcgttttcagcccagacgcaaggccgaaaagccctgccgcctgttgccgtgcgcctcctcccgttttccctccgttccaccttgcccttcactcaagacatgcactttaggttcggtgtctttccacatgcttggacttagcttattttcgaggtcgtgcccgagcctcagttttcggcccatgcgccatggcgaacccctcgttttcagcccagacgcaaggccgatcagccctgtcgcccgtcgttgcacgcctcggtgccgttttccctccgttccgccgtgcccttcacccaagacatacacattagcttcgctgtctttccacacgcttggacttagcttattttcgggtttgtgcccgaacctcagttttcggcccgtgcgccatggcgaggaacccctcgttttcagtccagacgcaaggatgaacacccatgccgccacgtcgccgtgcacctccgacccgttttccttccgttccaccgtgcccttcaccaaagacatacactttaggttcggtgtctttccacacgcatggacttagattattttcgggttcatgccctagccaccgtttccagcccgagcggcatggcgaatcacctgttttcaggccagacgcaatgccgaactaccccgccgcccgtcgccgcgcgcctcctcccattttccctccgttccaccatgcccttcacccatgacatacacattagcttgggtgtctttccacacgcttggacttagcttatttccgaggccgtgccctagccgccgttttcggtgcgcacgccatggcgaacccctcgttttcagcccagacgcaaggccgaacagccatgccgcccgtcgtcgcgcgcctccgtgtcgttttccctccgttccaccgtgcccttcactcaagacatacatacaccttagcttcggtgtctttccacatgcttggacttagcttattttcgaggtcgtgccccagccaccgtttgcggcccgcacgccatggcgaacacctcgttttcagcccagacgctaggccgaacagccctgccgcccatcgccaacattccatcgtgcccttcacccaaggcatacgtagcagctccaatgtctttccacacgctgggacttagcttttttttggttgtgcacgaacccacggtggtttttggcctcttgccacgctgcgccttggccgtttccgttcggaagatcggtgcccctctcccatgggttcgtaaccttgtcggtgggcgctgcgtagagtggggggaggga

SEQ ID NO: 299 - DNA, 2850 bp, Zea mays
caatccgattttaaaaatcaacatcgacgatgaattttagatgtcacgatttatctctttcaatcataaatccgaaagccgatcatatctcaagacgatttattttcgaatcatgcataaggaattattgccgagtgaagtcagattagactctcggccgagttaatcgctcaatcgtccgttcgtcggaactctaattcgctctgttctccgtagagacaaattccgcgggagcatttttattctgggaaaaatttagcacagcccgattacgtgttttgggctaggccaacctagcccatttggaaccctaaccctaggactcctctataaatagaagtgcctccccttgcaaattggaaaatttgcatctacccccctagccaccacagccttcttcctcctctcccacacgcacgcagctctcttcttctatgttcatggcacaggtaatttcctccccgcccatggcgtccttccctcctcccccttcttcttcctcaagcatgtaggccaacctctcctcctctgcatttcccagcgccaccatctttttttcccctgtctctttcttcctcacggctgcagcagggagctcagctccttctcccatggcgctcggtacccctgcagcagggcgccattcttccctagggacgcctttgctccagccagccttcttcctttcccccatccgagcgcccaagccagcgcccttccctgctccatgggcgcgagctccaccccctgtaatggacgctgcgtgagctcaccccatgggcgtgttccctgctccacggccagccggaagccagcgcccctctcctactcggccacatctgcgcacagagagttcttccccacgccaccctctttctttcccacgaagaaagcagggaacacgaccaacgttatcttcctcccatggcttcctccctgccacgtctcacctctggtcgacgccctgcacaacgccctctctcccatggcgagcagctttcctccctatggtcatggtccgcgacaggaagtcgcgcgctacatgtttgatgttttgcgcagcaaccacgacgtctccgcgtgctgcctgctcgctgttttgtgaagcccactggacagcacaccgtcgacgctcaccggttgtttgctgtttttacgcagccccaacatcgatgtcgttcacccccggtgagtcaccccgctgcccttgctgctatcatatttttgtgctcggtaaaatgttgaactgttgtgtgtgtctaatcgcagctatctgtcaatgccatccatcgcgcacgcgtgttcgatacaaggccagtcggttgaaccacatgcaagcacaactcgaatccgatctagtccaggttgattgatttatagtttaccatacgcatgatttggttgatgtcatgcagtgcatgtatatgtgtagatgtgtgtaaaatgtttcggttatacacattagtagggtcgcatttgcggttggagaacaagaggttgtttgatgtgtgcgatttgtagtttgtctaattatgttttggtcgatgtggtgtatattggtgtttgaatatatgtggttgcgatggttcatttatgtgtcacaaggatggtttgtggaggtattaattgtttgttaaaatacttcgtcataaagcattgtgttaattgtggtaaatctaaaaaagcgtaaagcaggcttggtggtttccgcagtcggctaatgagtaagtctatgttaaatatattttatgtattcatcgtggtgtgggttagagtgggttgaaaatataaattatgtgacatgtgattagtgttttaaagaagagttgtgtgaataatcagttggtgtttcactcgtctagtcgataagtgttgtcataattaattgtgctaaaatttggtcacaagaatgcagtggcacgtggtgttggttggatgtgataagtagattggaagtgtgggtttgtctgagcactgtgttgtcgaacgtgtatgtcgaagtgcattgtagtaatgattgcgttaagtaaacagtaatgtctcgagtgcacgccacaatatggttgtatgcgatacggcgttacgtgaatggtgagtttagtaaacttccatcggtgtcacttgtgttaagttgaggttaatttgtgcgtggaaagtagtaatgtatttaatccttagaactcttagtcgattgtagaaattgtcttggcttaaatagagaggtggtgacatctcaaggtagtcatcatttcctctatattaataagtcgagtcaatacgcattgtgcgttcattaaatttcacatcgcccatagtgtatggttgtgttcatgacttcgaatagatgtttcgagttgacaagtcggtttgtaatgcaagatgtgtgatgaagttagtttgttgtagaatatttgtgaaatgttccattcatgtgatagacatgtatggttaattcaaatcgagtcgatgtgtgtgatgatgatattcatgaattaagtagatgtcctgtaattgtgtagtgaagcttaggttaagttgcaagtgatgtgagaatttttggtaatgatatatgtgaaatgtgaacgagacatccaatgtattcggtatgtcgcgtagtggtggtatgaaaatgggttagaaatcgatcggctgaatgccaagttcggttagagttgttttgttacttgggattgtgtggtgaagggaaggcatgactgtgtagccatcacgtcatctattgggtgactatgcttaattgtttctttatataagttagaataattccaagctctagaacatgacaattcttgaattatacaggagctgaaaattattaattattgtttcggg

SEQ ID NO: 300 - DNA, 2849 bp, Zea mays
actgatgacttccatttttttctttacatgccaggcaatataccacaattactaagggcagtgcaattgcaaatatacaataagcagttaataatagtaacctctacctttcagtgtttgatgaaccacctagaggagtcgagtgcaaggtaaactcccggtcatacagtggaacagaaccatcatctactgtatcactttcccttgcttggttatccacccaaaaggacttgtcagaataagaaaaacaagaaaacaaaacaaagtgaataactatattccagttaagtatcccacaaaaagcagaaataaaccatagtacaatacagcaatttgtttaaagattacatgaaatgttagatgcatattatcaatcagtacagtaacaaagaacagaggactatgcccatgtcagaatatgtagcatagttgttaaggcggtaaggcgagataaggcggccgacccctttttaccttttaagcggtaaggcgtaaggcgtaaggcaaggcgacgcctaactaatatataaatataggaatatgatcttaaataggtagggatggtagtacaaataagggtacaagttcaacctaaaccaacataatagaattaaaatattaacataactaatagatagtagtagaagattaggaaaaaatgaatacataactgatagatttactggtttaatagagaagtaaaaagaagagaaaaaataagagtttaaagacatatgggccatcagactgctatttcccggcccagtcagcccacttattgacctaactccatccctcagctgcaccttgcagcagccttcagccgccaccctgcagttgccagagaggggagagggagtcgccgccagagagagaggagagtgagcaggggaggtcaccgcccgcacacctgagagagagagggagggagaggacgtgcgcgaccatctccgacccgcgcgacgctgccgcgacctacgccgaccagcgcaacgccgccgcaacctgcgccgacccacgggacgccacgtcttccccgtacaacaccccaaggcgtcctcatagcgtcaccttatacctctccaaggcgccggggcgacggcctaatggccaaagcggatgccttaggctcccaggcaaggagacgcggacgccttatggccagagcacgccttagcatttaggtgtcgcctaagcatcgccttagggacgccttaacaactatgatatgtagtactaaaatgaggtgtttcaaatgaaaataataaaagcatatggctgcaagtgggaagtaacactgcattcagattccaaagtttatttctgttgaatacgaacacagttgtagcatatttgccattctgaacgcgtaagattgatttagtttccaacatgtcctcaaaggctaagcgtatctgaaggaagaggctaatgtcaccagataaatagaaaaatggaacaaggaccaaaacatggaagtccctactgcaaaattaaggcttacacatgggattatggggaaaaactattttcaaattagcacagttagatgcacatgcactatcatatgccaataaaggacatactcactttaccaggtaggtagctaagtcaagagtgatagcttaccaagaggcggtggaatacttttggcaatggaaagaaaaaaaacatttaaaacaaaaaaataggaaaatgaaaatagaaagcaacaatacattagagcatctccaagagtctctgcatggctatttatcacaaattacaaaatttcaaaaaaaatcaggttccaatagactttctaaccactctttcaactctccaaaaccactcttgttgctctgcactagcgaagaatctacatcactctttaaattccatatatagtagttctatcataaatttttgacacaaggaaagttactacaagtcattcgagtatagaactatagataatgaaattaagagagtccatgggaaataagagatacataaaagagaatattcatcggatggctctccaactagagataacagagatagaattttagagaagctctttgagttactattagttatcacatcaatcaatttgattttttatagtacctatagctaatttgacacatgttgcaagaaactagaacttccggggaccattccagaaacctacaacttcctcaccagaaacattgaaacatgagaccaccagtgacatgctacaggggctgacatgtgggttcacggttagaaagttatagtgatggtcttctgcaacaaggtgccaagaactcaaaataattgtaggtttctgcaatgagcaccagaagttgcttcctacaaatgtgtcaaagtagttgtcaatttttaaattttacttttaaagaaatcgttttagaaaaaagaacaaaatagacactaaaatgcatgcagtcttcataagtcaaaaagtatgaccacctctgtacatttagtttcttagattgcaaataattaagataggttttacgttaaagatggtgttaatgcccaactgtccaagtaacacccagctgaagccagagcataacgagaaaaagagaacacaagataaatcaccaatcatatattcaaagtaatcatataatattgtttctggacattgtcaggtcaacttcaacataatgacatacataccacggcacaagatttctcagaaccaacatgtaatgcaggataataagtctcttcaccactttctaaggtcacttccacagcttcctgttatttccagaaggaaaataaatgtcaagaaacttcaattatatcatttctaaataattctttctgaatgcaatatcttcttgtac

SEQ ID NO: 301 - DNA, 2847 bp, Zea mays
atttttaattaaattgttctctaatcgagtgttcgaatagcgaacggaattcgtctaaaatcaactgaatcaaatgcagattgaaatagcgaagccgaaacccgtttaattcagtccgttgcttttcgcctcgatctaaatcttcaaaagtgaattaatagtacgattttgtccgagttcagagaatacgccaaatcaaatcgttagtcctcggatttccgttttgagattccgggaatgaaatgcgtagttgaatagcgtgtcgactcagtgtacattgctaaaaatctggattcaaaaatatctgcgaatttctttaaagaaattaatgacaaaagagagaaatgtctacggatcctcatccgctcgccgcccctgggctgatttttttgccgccccctgctcctatatcttcacgcgtgggcgtccatctcctctgctctttcttctccgcgcgtcccttcccagccgatctctctacgcgcggtgcttctgctccagctcctacgcgcgctcctctctccttcctccactctctctccctctgctcgtcacgcacgcccggccagctcccatggccgcgcttggtcctgcgcccttccagttctctctgcccggcggccagttcccttcagcccagcgtttctgccgtcgctcagttcgccgcgcccctggtctctgcgctcgccagcgcctgctccctggagtcccctgcgccgcaccctgaagccccctgcgcgtcccgctgcccatgccaagctctctggccaccgcgcctgctgtttccccggcgcgcgcgaagtttgcaaccctgcgcacgtcttcttcctccatcgcgccgcagctctctctgccgagcgcggcctctgcagctcgctgctccagcccatccccttcctggcgctcgcgcccagccggagctccctcagctcgccgcgctctgccgaggcacctgctcctcgcggcgccctctctagctattgctctctgcgcgccgccgttctcctgtacgcagcggcgctcccagccgagttcctccccggccccttgttttccccatggccagagcctcttccagctccagcgtcggccgctcctccctggccaaaccgcgcccctgtagccgcggcactccctctggtcgcagggacgcgcatgccccatccccaatggcgttcggtcgcccagctccctgttcctcccactcgcccagctcggatctcgacttcctgctcggctcgtccttggcgctcggctccctgtttcagtttgccgtgccgcgtcctcatctttctgtcgcgagctcgatccctgttgtcatcgcttcgccgtgttctcaggtagccgccccgtcgtgctcgtctccggtgctcgcttcggtcgcggatgcggtcgagcccgtcgtcctccctgtccggtgcttgcgtggctttctgctcgccagcgcgccctctcggctcactcggccataatccccatcgcgtcgtcgacctcgccgattgtcgtcgttcgtcgtcgcgtcgtgcgtgcagcagccccggatctgtgcagccccggtcttgttgtcgacattgcttgccgtggctcagcttgctagctcgtcgttgtttcgtcgtctcgtcttgatgccagtccctacgtgacatctccgacttgtgttcgcgccgacaaaagaatcccaagagaatgtggaggagcaagctccaaatcgatgcccaccaaatgctcggtgaaaggcttgaacaaggatcattgtcgtttgtttggattgctagtcaatatggtaatcgtactctgattcactattctagctaattaatttgatagatggattagagggatattaatcgtgatgattattctatctatagcttagacgcgtcgtgggtgtatttcatgtatgataaaggtcgtaattgtgtgctgtttggttactgtcatgattgggaagtagtcgcgaggtgtgttaaagtataggttgcagtataattcatatgaagaatgcattagtgggcatgtgccgagtataattgtattggtgctacatagatggatttaatagttcaaatgcttagccgataggttctgtcaatcttgtaggtgttaagtttgtttatttggggaaatggtgtcttgcctaatagttttcacatatgccgtgtctatagaattggttgatgttatagactttggaataggagtttggatgttttgttgtttgatctttatgctagacccggttaagctgaaagaatgtaattgtcaagattgcagttttgcagggatccatgcttttgctaatgtgttatccattggatctaggaatattgttatgtatatgatagcttggagtggtatgtaatttagtccggtcacgtggtctagaaagttgatgtgcttatgttcttgttttagatttaaatttcttagaccaatgagtttaaaattattaagtttttggtgttgaactttaactaagacacgtagagcttacgcatagttatcatttcttaatgattgagttagatcgggttaagctagaggaacatgatttttatatttagtgagttaaagatatctagtattgcttgagtgttgtaatgtctctcctctaagtgtttaatccccttccatgtggccatatttagtcattgctattcctgcttctattcactcatgtgcattatgcatatcatttagctacgttaattgatcacgtgatgtggaggccaaaagctggattgatctcaagacgatgctgatgggtgaacttaaagatggatgacttgaacaagtgtcagaccaaaagttgatcgtcatgtaacaacactaacttagtgttatccc

SEQ ID NO: 302 - DNA, 2847 bp, Zea mays
atttggtgcagtttagtttaactgatccaaatgaggcccaactatatgaattttgtgacatatggttagcaggctactggggtcttattgggtgagaaacatcttaggctggtcaattttttacgtgtgtaaaacctcaatcatgtcacatacactcgtatttctgttaatagaaatggttgtttcctctctaaaaatatgttgactaacttggtctctatagacaagtttagtgacctcgtgggaaatttactctagcaggccccaaaaatcaaacaacaagttacctacttctccataagaatgtagcaatcaataacatgcatgtttgtcaaactgacaactaagacccaattgcagcaagagcgcgtgacagttcctaacccatgagacccaatttgcagtagaaaagcatgcataagattttgttgacacctacaggagacggttcctacattgttcgactccagtgcacctaattgggcctataaataaaccaacaatacaccttaagggagaaaattaagttgggtatatgaacacatgtaaatgcgacattaatttccaggcctgctccgacggtgtaaacaagcgaaactatatttttcagacctgctaaccacctgacacaaagttgatatagttagtcctcatttggatcagctaaactcgactacaactaactcttgcgttttagtcttttgttgatcttcatttttattagtttcaagatcttcatgcttaacaaaagagaacaaatttcccagcacatcctctagaaatagcatattatctttggcatttgtcgccactacatgtcatctaacaatttcaacacctttatttgtgctcccacttgcagctcctcaacattatgcaaaagcttttgagctgcttcagtagcccgctttacctgtaagttcttcctcttaatggtcccaccgtaacattcttccattgtcttaagttgtttccacacataattctttttcgtttgttatgctgaaatttcattgtgcttctctcatcttaggatctagtaagctttctttagtttttaatctcttccctaatctcttctccaattttttgggatccgaattgtcaacactaatatgaagtaaagtttagtcccaacaattcagatcaccaaaaaagtgaggaagatattaggtaagagataagaaaactaaagtaagcttccaagatcatgagattagaggacagtgaaaattcagcacaacaggcaaaaagaattttgtgtggaaccagcttaagaaaatggaagaagattacactgggaccattaagaggaagaaaatagaggtagagcaggctactgaagccgctaaaaagtttttgcataatgttgatgagttgcaattgggtgcccaaaagaaggatgatgaaattgttagactacaaatagtgatgacaagtgacaaaaagaggatgttgtttcttgaggatgagttgcaaaaattgttgtctttggtcaaggataaagatcttgaaactttataaaaataaaatcaaccagagactaaaatgcaagatttagttgctgtccagattaactaatccaaacgaggcctaactatatgaataggtcgttagcaggttactaggttcttattgggtgagaaacttttgatgctggtggattttgctatgtgggtaaaccctgaatcatgtcacatccactcttctcaagactaaacacaagagttaggtgcaaattagtttaactatggcctatataaaataatgtggactaacttgttctctatagacaattttttagtgatctcgtgggccaaaagttagacgaaaagttacctacttatccacgagaaagttgcaattgataacatgcatgttggtcaaactgaccactcagacccaattgcatcaagatttggcacacggacgaactacaaacataaatgaacagtcaggactcacaaaataaataggcttgtcctattgctctctctctctcactcaccgagaagacatgtagacaactctttatcttgtgagtatcaggagcttcgtcttgctagctttctcctaccagagcaccacactttctcatagcactagatggcatatcattgatggatccctacatacagcgctagcacccattaaataaatagaagtagacgacgacatgcctagaaactacaccactcgtctcgtctgggccacatgatgcacacatcttaccatgagaagcggtcactactgtaggccaaccgtatgtgtctctccaaacataggccgcactagagagcgttcttcaactagtggacgcaagactcgcactaaatgcaggcatggtctgcatgcacaaggcgccagcccacacgcctcctccgttgctccatgcatatggggcgtgtcctttggctctgcgatccacctgaactgctccactttttcatgtactcatcgttaaactccagcaggtttcatataaactcatgcatagtactagtatatggcatggcactccggtcgaaatccaggactgatggtctgatgtgctgcacgcatgttaggtaggcttcacacatcagtcgtgcttgcttgttcgtggagctagcttgcaagcctttccctttctgttgttcttgcacctagctacagcagatcacgagagctttcaagcccgttgtacgtgctagaggccagaggctctccctagctccatctgaaaaaggctgcagcaggaaatgacttttgatcgagccgctactgctggtgcttcatctcttaggctctctattgatccatatccatgtttggtactagtacggcgcggtcgtcagcaccacacac

SEQ ID NO: 303 - DNA, 2843 bp, Zea mays
gatgtacctctgccaggtacctgtaacacccctggtgtttatattccgctcgacaacgagtatggaattaagcacgtaatatcagtggataaaacggatgctaaattttaatcatcttcgcctatcgcgattttaatatcgcatctgttttgtctatcgcgagtttgacatcatttttatctatccgggttcttcctaaattttcgtgatgtttggaacatagttgttccgaaaatcggtgcatccggtgattatttaaaactcatcactcgcgcgaatacgaattggaagctcgacccacttggatgattttatcctgaacaaattaatttgaactcgacaactaaaatgttcagggcaaaataatctgaatcatgcattgtctgagaaaaatcatgcgcgagattgctaaccaaggaattataattgagatttgattctccaataaatcatctatggcagagtgatcaggtgttcgagtggcagatgaagttatatgatttcaagtcgtatcaaatatagtttaaaatatcagtctcgatctcgtttgggttcattctatttgcatcctatccgaacccgatattatccgagataaagagattaatgtttgatttaatagcagataatactaggtccgaaagaatactccggatcgcttgcattaccaagaaaccgtgcataagattaacaattgggattattcattagtgtgctattctaggtagagaaatcaaatcgatttgggaaacagataaatttttatctgagttcaactaaattaatagagtctcaactaaatcaaatcgatccggatagtgttttggtccttgtgtttctcggccagatccaaaacttcggatataaatatcgggtgaaaattcatctaattccgagagtattcaccaaatcaaataccatctaaatattgttgtcggtctcatttttgtttgatccttctgtatatttttagactctaatttcataccctaaaatatatgtattttgttgttttaaaaaaagaaggaaattagggaaaatccttctctaaatatttccaccgttccttggtatgattttcaacgtatttggatttttcacaatagaaaatatcactctatcgttgttttcttctcatgtacgtaaacttcctagaatatcattggccgtcatcgatattttctttgctagtaatcgtattcgatgcattttttccttgtcttcatcgccgcttaagtgggtaaccggtagaatatcttcttctacgtgcgcatcctctcccagccttatcttcttctgcagatttttttcctcagcattatctctcctctccacacggcagcaggcgctcgttctcacatcttcctcctacagccgcgccctggtcctggacatcccagcgccgtcccatctcctccctcccagtcgactctctgctcttccatggctgcttgctccactgcgcagtcgctcagctcatcgacctcccctcgactttctcgatccgccggtgctagccaagtcgatctcccatggcagccggtcagccctgctctccattgcaagccgcgctcctccatcgcgtcgttcctccgctcgcccacctcgtccatggttgtcataccgagttcgccctccgcgcagctggcgtttctccctaacgcgctcgcacagccatctcccatggcgcgcgcttcccctgtgcgtccgtctccctgctccaccttcctgtcgtgcctctctccgtcgaagctacctgctgctcgccatggtgtcttccagtctcaggcttgccctgctccctgttgccgcgagctctagctcagattcaacccagctcggatcttttccatggtcgctgcgcactggccctgctcggattctcgtcgtgcacgcttgggcgctgcccagtggacgcctgctccaatcgccgtgcctagccgagtttacccctacgcgcaactgtgggttttgctgcacagcgttcctgctccccggcctccgtcgtgctcggcagcaagtaattcatgtcgaagcagcagatacgatcccttgtgtcgtgctcgccagatcgagtctcacgtggtcaatctgcgcagttcctgttcggctatcggttctgcctatgtcgatctcctaatttctatggatcgtgtatcgatgtcccattacaacagcccatcgtaaaactctagtgcttgtcgttgatatctggtcgtctccaacctttgtcttgccgtcgtcgttcggtcaccctgtctcgatgtcggtccctacgtgatgcctctgagtatgttggagtcgtgctgacaaaagaagcgccaagagaagatgtccaaaggttggatggtggggtgcgtgaagttcggatagtatctgccaagggctcgacaaattgcctaaatcggagaatcattaccgatctcgcggattcgagtcagctattggaacgatgagccgatttactatttttactattgattttatgatcgtgaaataagacgcttagtttgcgtataaagtttaagttaaagatgccagcgatgcgaggtgtgcttcgaggagtttagttgccgagtatattctaactagttatattttgcagagtgtagtattttggtgacggttaggttaaattcaatattttatacgattgtggataaatttgtcgatggtaattgtgttcaatgcacgtaagatgatgtagatttcctgtgctagtagttagtatcatctatgtttgtgatcgataatgttggagtaggatatgatcgacgattttcttatctagagagtggtgtgatgatgctctacttgataaattaagtatagtgtgatgtttt

SEQ ID NO: 304 - DNA, 2837 bp, Zea mays
  misc_feature (2157)..(2158): n is a, c, g, or t
tcatacttgcaatttaaaataataaatacatacttttcatgctctaattttgcttatcattagtggtccaatgtcacaaatgatgtatatttaattgttcacaacacaactaaactttttatgtatgtacaaacattcccatgaaaaaagtataaggttgtggcatttctgttgttagtctattgggtttactttgtcacttattttcataatatcaaaatcttacaaacatgttttaaatttaagggctactgcaaaatccacatcagatattaaactagataattttgtaatgttggtgagagatatccttgtaccgtcttcaaatgaaactataaatttttattgcttcactaaaatactttctatagatcaatggttgtgatatgccacacaaaggtaattctacactttatttatagagagggatacatgtccaaaaataaccctacagaaaatgaaatagaaagtttattctattctgattacattgcattgtaggctgataaaatataccaagagatcgaatgtcatagggagaaaattgtccgcattgtcgcgttaaagtcatatatgtaaacttgaaatttgaaagtaatacaagggcacaaagcatattaataggactaatttacttatgcttattgataaaaaggttgacacaattgaatattgtagtggttatactaaggaattgttgcccaaattagaggctgaacagtagagtacccttcttgtcttcttcagtagtagatatgatgtatgtcataaatctcaaaatcttcatgctcaagtctgatgaatagacaattatggaagctactaaacgacgtcaaataatatagttcaaccttctaatctaaggaaactatatgagaagcaaatcagacaatctatggtttatgttattatctttttcattgtttctcatttttgtttttatatgatttttcttgctgatatctctgttgttacaactttagaaaatatggagaaggtaccctttctgaaagtagtggtggagcaacgagaaatcaagatggtttagggtcaaacactcaaaccttcccccaaattgcactcattatattactcgcatgcctaactacacttcttatgtttctctcaaaacaatagtggatcccttcgcagagccaagcagttagaaggacataagtgaaatatttctatttcatcatttttaatgttttctattttcgacagttgtaagcacattgtttaaatctttaacagacattctcaatcattatattaagattgtgaatatgattgtcaaatatctgtctggaagtacaaacattcttccccagatttgttgcgttcaagtaattctgttgtctcactttatcgttacctactgtcaaaatattattcttaacatttttgcatttgataacaacttcacaccctaactattaaattgttgtcattgatagattctttgttggctttgagctctcttgattgttttatcccatcattttctatcttaaagaaaagtatttatgcaagacgaaggatgaagtgaaagcaacatggtctctaggggttctacaatataacaccagggctccaatttacatgctcatcgcaacagttgttttgtgctactccgccattgcacctttgattatttcattctatgttgcattgctcttagatgacttatagcgaaaaatcaggtaagccagatgtatttttcttttttgtgtgaaatgactagaagaagaacttccaattatattaaaagaataaaaaatcgaaacagggcaaaaaagtagtgcaacaaatgcatcattttttttgtttgcgcactttgatattcagtttgttaatactataactttttatgttgttttgtgaaattattttttatataaatgatcttgttttattaattggttgtttggtgaagttggtgatcgatctgccaaccttaatccaatgtagattctgatagttatgttccttgcaatgagggctatggacgaatgtgaccacacatgcacacatggatcatcgcgactctgatggtttactagaccaccatggtcggcttcatccccatgaaaaagcttttcttgtgcccctccttccaataagcaaaatctattactactctattaagagtgcaanncgaattaaacttctcatgtcaagttaagtaacttggctagtttggtagggtccatctctagttaaactgatcatctccagttaagggtccatctatagtgcctgtttggtagggtgaaaattatctcaagttccacaacaaaattcaaacaaaattactactgttttatcccctaacaaaccttagttctagaaatctatatgaataattaaaaatataaccagaacaaacgcaaagccactaaccattcataaagcccagctaaacaacaataggcgcaaaatgttgcaagcccaaaaaatctaccaagcaatcagagttaaacatagaccacaatttcaaaacaagcaaacgcaaatctagcatccacaaaaatgttcagctccgatgcaaggaactacagaatctccaacctaataatagccgccatagaaaaaagtgcacattcgaatctaatccttgagtttgtatatgaaacatcacattgaagggccgacaacacgtcaggaagaataatagggctgcaaatcgcaaaaaaaaatagaccaaaccgaaaaataaggtgtggaggatggcctcgtgaatgatcatcgatgcatcaggcgagtcgaacgaaaccctaaccctgtctcttatacacatctccgagcccacgagacaacggctatctcgtatgccg

SEQ ID NO: 305 - DNA, 2837 bp, Zea mays
ttccaaaaccgggtgtgacagtgcggcggaccaacgcacagtggcaccggcaagctctaattcgccgtagaggagaagaaccgggtgggtcgagggtactctacagagcaatcctagccacggagtgggtcgatcgagcgcaccgaggacagcacgggctctccagtgaggagtttgggcatctagggccataacttgggcaaggggtggagctgcatcggccggacaccgtggaggtgcggcagaccgacgcgcagaggcatcagcaagctctaattcgccacagaggagaagaaccgggcgggtcgggggtactctagcgagcaatcccatccacggagtggggcgatcgagcgcagcgaggccagctagggctccggtgacgggtttgggacatctagggcctcaacttgggcaaggggtggagttgcatcggcgggacgccgtggaggtgctacggactgacgcacagcggcaccggcaagctctaattcaccatagaggagaagaaccgggcgggtcgggggttctctagcgagcaaaccgaaccacgaagtggggcgatcaagcacactgaggacagcgcgggctccggtgaggggtttgggacatctagggcctcaccttgggcaaggagtggagctgcataggccggacgccgtggaggtgcggcggaccgatgcgtagtggcaccggcaagatataattcgctgcagaggagaagaaccggcgggttgggggtactctggcgagcaattcctgccacatagtggggcgatcgagcgcaccgaggatagcacgggctccggtgaggggtttgggacatctagggccacaacttgggcaaggggtggagctacatcgggcggacactgtggaggtgcggcggaccgacacgcagcggcaccggtaagctctagttcgtcgcagaggagaagaaccgtgtgggtcgggggtactctagcgagccatcccagccacggagtggggcgattgagcgcaccgaggataacgagggctccggtgaggggtttgggacatctagggccacaacatgggcaaggggtggagctgcatcggcaggacgccatggaggtgcggcggaccgacgcgcagcggcactggtaagctctaattcgccataaaggagaagaaccgggtgggtcgggggtagcgatcaagcgcaccgaggacagtgggagcttcggtgaggggtttgggacatctagggccacaacttgggtaaggggtagagccgcatcggtcggacgccatgtaggtgcggtggaccgacgcgcagcggcaccagcaagctctaattcgccgcagaggagaagaaccgggcgggtcgggggtactctggcgagcaatctagccacggagtggggtgatcaagcgcaccgaggatatcgcgggctccggtgagggatttgggacatctagggccacaactttggcaaggtgtgcagctgcatcggccggatgccgtggaggtgctgcggaccgatgtgcagcggcactggcaagctctaattcaccacagaggagaagaaccgggcgggtcgggtgtacaattgcgagcaatcctagccacagagtggggcgatcgagcacaccgaggaaagcgcgggctccggtgaggggtttgggacatctagggccacaacatgggcaaggggtggagctgccttggccagacgtcatggaggtgcagtggaccgacgcgcagcggcaccgacaagctctaattcatcgtagaggagaagaactgggcgggtcaggggtactctggggagcaatccctaccacggagtggggcaatcgagcgcactgtggatagggcgggttctggtgaggggtttgggacatctagggccacaacttgggcaacggatggagctgcatcgaccggacgccgtggaggtgtggcggaccgacgcgcagcggcaccggcaagctctaattcgccgtagtggacaagaaccgggcgggtcgggggtactctggcgagcaatcccagccacagagttggaagatcgagcgcaccgaggatagcgcgggctccggaggggtttgagatatctagggccacaacttgggcaagtggtggagctgcatcggccacacaccgtggaggtgcggcggaccgacgcgcagcggcaccggcaagctctaattcgccgcagatgagaagaactgggcggctcgggggtactcaggtgagcaatttcagccacagagtgggttgatcgagcgcaccgaggctagcgtgggctccggtgcggggattggaacatctagggctactacttgggcaaggggtggagctgcatcggccgcacaccgtggaggtgcggcggactgacgtgcagtggcaccggcaagctctaatttccgtagaggagaagaaccgggcgggtcgggggtactctggcaagcaaccccagccacggagtggggcgatcgagcgcaccttggacaacgcgggctccggtgaggggtttgggacatctggggccagaacttgggcaaggggtggagctgcatcggtaggatgtcgtggaggtgcggtgaaccgacgcgtagcggcactggtaagctctaattcgtcgtagtggacaagaacctgtcgggtcgggggtactctggtgagcaatccgagccacggagtggggtgatcgagcgcaggctccggtaagggggtttgttacatctagggccacaacttgggcaaggggtggagctgcatcggccgcacgtcatggaggtgcggtggaccgacgcgcagtggcactcggaagctctaattcgccacagatgagaagaacctagcgggg

SEQ ID NO: 306 - DNA, 2836 bp, Zea mays
aaatctataccctcccatggaagggtggttgtaacaccccaggtgtttatcgtcttctcgaccacgagtgcggactttaacacatgatagcggtgaataacagtctctctgtcttaatctgtttttgtctgtcgcgagttcaacattgtttttatttttatctatccgggctcgtcctaaattttcgtgatgttcggaacataattgttccaaaaatcggcgagcctggtgattatttaaaattcatcactcgcgcctaatttagaaacttagtttagtcctccgactttgttagaattatgttccctctagtctttgatgaattatttaaaattcatcactctttgttatatgttccaaaacaagatttattagaagtcgacgactatagttttcagtgccaaataatttagtcccctctcgtcaagcgagacatcgtgtctgaggaattataatcatggtcggtttccaaatattagtcccctctcgtcaagtgagaaataaaacaggttcaaatggcagataaatatttgtccgatttcagttgcatcaaatatcatctgaaatagtgaagccggtattattttggatctggctatttacgtgttgctcgagaaaaacaatacaacagctcattaatcgaatcgttctgtagtcaaatgaccgaaagcacgtgagactcataaaaatttgactggattaaatatagtctaaaatatcgaagccgaaatcagtttggttcagtctgtgtatttcttgtctcgatgtaaatcttcaaatagaaataatgggtacgaattaatctgacttcggagtagtcatcaaatcaaatcgtgtccaaatatttgttctcatacatataacggtgttgaaaaaaagagaaaatatctcttatcctcatctcccaccgttgatatgcattgatagttttttcttcatatgtggataccagatctttgttcctatccagtggttgatatttctgcaacgcacaagtgtaccagtcgtatcttctttgcctctcggttcttcttggacactttctctcacctcgtcattctctctcgcgggacgttgctccctgctagcgcctggacgcttgcctcactcggctctcgttctcctcgcccccatgctccatccatggcgtgtgcttgccagacgccgatgtgagcttcctatgttcttctggccctgctccagttcgccatggtcgcgcgccgttttccccagctcggatttcgccagccgccgttctatggtccgtgtgccgatcgacgtcgtggagttttgtttggtcggctcgtcgttgacctcaccggtgtcgtcgaaccatcgaaccccttcctcaaccacgtcgggtctccatgccagttgtcatcgttcgtcgtcgtgtcgtgtgtgcaacaacgtcactgattcctccatggtgcatgtcgacgaacttcgcttcatcggttcctcgcttttggttcggctcacgtatgcaggccgaacgcattcgccgcttgaccctgtgtcgctagagctcgtggcctcaccaacgatggagtcctcactggattcgtgtccttgccagagctcgcactaacctgctcgaccacacctcaccagctcgctctagactcgatctcgtcgtcattctgtgcgtcatcaagcaatcccaagagttgagtgaagacgaagctagcatcttgtaattcaccaagtactcgacgaaaagcctgaactataaatcatcgtggttcttgcagagttcgcgtcgaatttaatcatgggtgggctgattcgctactactattattttgttttaattaatggattgatagatatgtaggttgcgatgatcctttttatttagcataggtgcgcttagtgattatgttagatccgttgttgtgtcggtgtgccgttccgtggtgatataattatttttagaattataaagtagtcgggtgaggggttaaggtctagaattttgataaaaaaagttatgcgacggatatcttgtctgtagcacaagcacattgtggttttattatatgtttgataaaatgccttgttatatgtattgttgcaactgtgttcgtgattgacaaataattgtgtcacgtagagcttaggtttaaaatgcatattatgctaggagtgtattactgaatgtttaataataggaaaggcaggttaattgttttaaacggccggcaggcaggatttaccagtgtttctaggtttttaagtgttaacgctataatcttatggacttctattaagttgataatgagttgtccgcttgatctaaaactaatatcatattcatgtaattagtttgttatccaaattagtcagaataagtgatttagaaagtcagttaatgtgcttctatccttcctctaaattagatgtctaagactaatgattctaagtttgttagtcctttgttgttctataatattcagactaattttagatgttatgctctaatttgtggcttgtgttcaattattgttgattggatgtttgaattaagtacaattatctcgaagattataattaccatagagtcatagttatctagtgtgcgttcatgggagttgtgatgcatcgtcactaagtgtttagttcattttcgtgaagcattatttaatcctgctattccttcttatgttcatacatgcacattatgcatttcatttaggtacgttaattaatcacgtgatgtgaaggaccaaagcttagtcgaccacaagatgctattaagcatgggtttcttcgcaaggtgatactgatgaatgaacttgaagattgggtgatcagatcaagtgccaggatgaga

SEQ ID NO: 307 - DNA, 2834 bp, Zea mays
catctgatggtgaatctatgtaatagttgaaggggacacgaaatctccataatgtaatgaatacagagagaacctttctaaaggttgacctagtgatatttttacagccattgaattatacaatttctattccttgctgtccaaaattattgtgtcatgttttcagttatgttatcccgaaatgactcatcttcgcttctttcgttgcagggggttacaaatgcaaaggctatgactcattcttccaaatttgtgggagagccacctttttttcctaagttacgttgtcttatctctatctctaccccttaaatacaccagttaaaactatgctaagtacacaacacaaaacatccccacactcataaaaccagctaagtctacccagcttattacctcccaacaaaccccaatctcaaaaaccaacgatcctgatcagcttattgcctactgaaacgcatcttatggccaacattatttggattacttcatctcgcgcacgaaacacgcgtactcacatttccgtggctcgttgctccgcccatgcaaccgccctgctcacatacacgctgaggcacctggtccctagcccaggctccgccccgcgccccttcctccgcccaggctccgccgccggtggtggacgcggacacccactctccacggtgcaagtatatctgggaggcatttgaggttattatagggacagttcatattattactgttgatagtacaaaaacagtacaacaacggtaattatgattcagaatttattactgttgccactggtgtacagttcagtaattataccttatgtaatcacttcaatttctaacgagttacctgttgtaaggttccaaatatttgtgatcgccaaacaaaatgggacggagcgcgcttacaaatataactaatgagaataacaaaggttcatactgatatgtttccatgtcttcgttttatactgatgataatattgagctatttaaatatcttaataaatctgcccccacaaccagtgcgatctgatgatcaagaacgtaagagggaggagaggaacagaaaacaaagagaatactatgcacaaagaaaggctgatgaaacccaagaagaaagggaggcaagaaataaaaggatgcgtgattaccacgccaggaagaaggctgagacgggtatcccctatgatcttatactacattctattgtttttttaacaataattcatctgtctattgtagtgctatgctcgcctggacagtcccaacgttatggttttggatcttcgatcgtaatgcaagctcctggtggggacaacacacatgtggcacgggctgagacgtcgtatggtatgagatgcttgttgcagacaccatgttcaacactttctcaggtatcaggattgcaatacatggactcaattggtcgaagtgatcccatggagtggctacataccaatgattacacatacagtgaatacggtgacgaaatatgtagtacgccaaacacaatgggaacaagacgacatactgcgcttactgatatatctaaccaaattatcacaggttcatgcataatcaaaccaagtagcacaatcttttcattttattatttattactgatgtcaaacctttttgaaaatacagatatggccccacaatcaggtccgtccgatgaacatgagtgtcatcgggaggagaggaatagaaaacaacgagaataccgtgcaagaagaaaggctgaagaaaccaacgaagaaagggaggcgagaaataaaagaatgtgtgattactgagcgaggaagaaggctgccacaggtacttcctgccgataattaacatcgtcctattttttagttaataatactcattcttcctgttgcagagccagtaacgcctaatgttacgaggggctctttgcaccaactgccaacatcaggggaaccatgttcaaccatttctcaaccttcaacctataatcaatacggtaggtattcattgttataattactacttacataatttattatttgatttccttttgtcttcagcagctactgcatctaccatgggcaactgcataatgaaccgagcgaggtacatcaatatggatgatgcagctagagaaattctactgcataagcgacgtgaatacaaaaagttgagacaatgtggacaagatgacacgataactggtgagcacaagtgaatcattcaaaaaaaatcaatgtgtctcctcttaaggcttaccatggctttctacgctgccagacactctcaggtgctccattatcaattcagacacaacaacatattgtccatgacacacctaccaatgagcctgaattgacatagtatgatactgtattaattgatcctacacaaccaagcgtggaaggacatggtacctaactgtctaatacttctttcctactaaatatggttattctgcgtatgatggttgcattgcatgtgtgagtagaaaattaattagagatccttgacaaatggttgtttgggtcattttctttatgacggttacatatgggtatatacttttatgttataatatactggtatataatttcgttatttacctttacatcattaacacatttctaatgtctggtttacacatcagagcatcccaatattgctcaacataatgaatatactagaagtcaggaatttcatggagaaggtaaccataaattatgatttatattattttatccagaaatggttcatttctgtttttaataactgcaaatagtgcatttgttttttaacacagacgatgcattcgaatcatatcgtctgcttgggtactccagtctt

SEQ ID NO: 308 - DNA, 2831 bp, Zea mays
ggtgccgtttggttcacatatttgtaacgtaatgggtaacggataacgttaaatcatgtttgttttagtccaaccgtaatcagataccacactaaaatttgataccagcctattcaaatttgttaccgccagtaatcgagtcgaaaccattaccattaccgtttgcgttacattttttgaaccaaacagcaccaagtctttcttcttttgcagtctgcactgtcttctcgtcgtttgtgcttgttgaataccaaaacaggagcatcaaagagagacctgaactttaagacttcaatttggtctgttcgatcgttaagtaggaaagtttctgtggcttccaactaactaaacccaaacaaacacagtaattagaagtggaaatcgttaacaaattaaggtaatcatgcaaaaacctgttattcgatgagctgtaaccggtagcagcacttttttgtttctatttaccttaacggttcctgaaacgaaccaaacaacacctttatttgactccctttcatgcttattgttgtggtatgcaaaacttgcaatacacatttccacacctttcaaaactcgtactgagatacgacgtgtgacaccaattagagaaaaaatgaaacacaatactaatcccacctggaagcgttggcatgttttggcagcaaccagcaagagagatgatgaagacgtcggagtgacgtgcttcgcggcgtcggagtggcccgccgcttgaagagagcgtgcaaccgtgaatgtcgcctttggtaccagatgtgccagcagtgtggaagacacagacattgaagaagaggaggaagtaccttcgctggagcagcacaatggtgggcgcggcgtggcgatgagcaagtaggaagagatatccgatccgtcgtcgccactgcgcgtggaggaaaccttcgtaaactctgtgctgccgtctgctcagtcccctacgagagcgtgaagcttccagagctaggccgtccaagactccaagtgactgggcggtcagccatggagtgggatgcgcagaggcggaggtgagataaccagagcagaagatgttgaacggcttcttctctccatcccatttcccttcgtttgtctattcccttccaccgcatacggataggccctcaaggtgattttcttcttctcccaatctccccataccaaatcctaggtcctaaagcatctacagcgacggattagacgaggaagccgcagcagaccttggcctcaacatgatgtctgatccgaaactcgcgcttaggaacgaaaaactaaaacaagctgccagttgaatgtatatgtaacccgcagaaccacaaaatacggcaacatttgtggatagacttcagatcgagacttcaaaggttttttgttatttcacatagagctggcctgggacaaacatcatataatatctgattggctactcagttactaaaaaatatgcatgctaacttgaaacttctgtttttgttaatgaacgcattcatcgcgtcgttcttaatttgtgcacaatttaatcttcaccattcgtatgggctgtaggacactaggtctgtagcaaaaatatgtatgaaattagatactatatatgccataatctttcaccgattgtaggaccatgaagaaattctaggtacatcaaccttttgattagtatgggtccttgcacggtaatgtggcgatggttgtggtggctctgactgcaagctgaaggactccatgtcgcacatacacattgcggtgcacaggacttcgctaggagctagtgggagtgatttcatggccagcgacagtcaacagaggtaatgtttctgtaacaatttttatagcattataaatcagcgttagcgttgcagtgacattatgtgcttataacttgtcattagccataaagcttacgtttttgctgtttagtctatgctagccttctggaagggcaacaagtttaatggttgcatttcattcattctttatcaaataggtaatgcatggtgtggatcgtgacataatgtggctccaacgggatttgtacatctacacatgcaatcttttttgatacatgacatatatatttaaattagggccaataataccattcttcaaggttcttatggatggagagaagataccaaaatataaattggaggttgaagccactatctgatgaaatgatcaagtgttgcgtatataaatcatgttttgattttttttccattgtgtttggttttggatattttttttgtttgctattattctttattgtcacactacaggtcaaggctacttcctgattaaatgatcaagtgtttcacatataaaccctattctaaaattcttcactattgtgtttgttgttggatatagttttttcgtttgctccttttttatttctaacttgccatcaactatatgtaagtgattttacttctgcccatgtacgctagagaacatacacactgtctgttgtacatatatgacttaatgagacagggagtcaacatttgaaaatgatcttctagaggtacaaaaattattgtttttgttttggtttccatcttatgtactgaggtcataagagaatatatagcttgatattgtcacctctttgaatgaaaccttaaatctagcaccgtgtattttaaataataaaatttttcctaaacgttgaggtttttagtgcatgaaagtgtaaatgttggtcttatgttactctattcaagaagtgtattatctttttgttgcttgtggttcctgaattaaatcagttgttatttggacagttctatgtatcaaattgaatgccctggtatatgtat

SEQ ID NO: 309 - DNA, 2828 bp, Zea mays
ctgaaaacaacaattaataaatttcagctcctatataattcaagaattgccgcgttctagagacttgaactattctaacattttaccttctgttagagttaaaacaatcaaattaggaccaacaagtagacttactaattttatacaagttattttgtgtgctagaattaacatacacaatcaacaacgtattcaccacaataatcaaacccggtacatatatgtttatcgttgcgcccttcatacactaatttgcattttaacttagacatcacatgagcactaatacttttcatccgcgaccataaccatacacatttagactacaataagcaaatcatcgtgactacgagcttaatcaaagccatctaacaagttggttaactacagtaatgacatagcccgctatacaacatacacgtcagcttgtctattattatcgcaaactgagacacaacatacactacaacatttacaaacatacatattcacaaatactttcgcacaccgaccaatttatacgaatcgtaaaccaccaatctacaattcgcaaacaccatgcatttacttccccaatcatgaacgcatacatgtttatcacacgagccgagtatttcaataattatcctaaaacaaataactccattacacacttgtatcacaaacctacttgacttacttgaagtgtctactcgaattcgtgagcataattatacgctatatgcgaagcataatttaacgaacgcataatacgcatcgttacgactcaacttataaatatagagaaaacaatgactactttggcatgtcaccacctctctatataagccaaaacaatttctactatcgactaagagttctaggtattaaacatattattactttccatgcacaaataaacttcaacttagcaccagtgacactgatggattttcactaaacccatcatgcgcataatcccgtctcgcatacaaccatattgtggcgtgcactcgagacactaccgattaacttaacgcaatcactactacaatgcacttcgatatacacgttcgacattatagtgctccgacaaacccacacttccaatctacttgtcacataatttatttttttgacccactctaacctacaccacgatgaatacataaaatatatttaacatagactaactcattagccgctgcggaaattaccaagcatgctttacgctttattaaatttaccacaactaacacactactttacgacgaagtgttttaacaaacaattaatacttccgcgaaccaccctcgcaacacgtaaatgaaccatcgcagtcacacatattcaatgccaatatacaccatatctatatgcatgccatcaaccgaatcacattaatagtaaattataaatccatcaacctgtccactcggatttgagtttcgcatgcgtccacggtttaggtgcttcaccgaatcatgcatcgcgcgaggcatgacatcgacaagggctgcgagcaatgtcatagtttattacacgctttattggtgcgatcatttaatccaacacgaaaagcgcaggacagcggggtctcaccacgggtttcgatgacggcacgcagagactgtgcagatcaggtcgatgcaagcgacatggaggggatccggggctgctgcaggcttgccggtgcaacagtggaggagctcgcgcggccctggcgtggctgagcgcgcgtgaggtggggaggcggtgccccagcctgactcgtgaggaatggagctcggcgccgcggctatgcagaccaagccgacgcagggcgcgagggagctgcgacggccatggagacggagttgcggccctgggctccgtcgtgagctgggcatctccagcgcccacgggagtttctggaggacaaaacaaggaaacaccaggagagcttggatttgaggggaacaaggggaggggttggattccaaccattggggtgtcgagcgcccaggcaaggccaccaaacaccatggcttcaaggaaggagaggagatcggacgctggacgagcagggcgcgccatggagaagaggaaggcttgctggcgagctggagaatcgcaggggcgtctaggcttgtgcttgtgcggtcctggcgttggagacgggaaagctcatcggtgtcctgcagaagacgtcggccggcatggaggaagggagcttggtgaccggcctgaatctgagggagcttgcaggggaagccgatgagttcgaagcaccaggcgtcgagcacaccaggggaaaggagcaggacgattggcggccatgggaggagcttggttggggaggggtgtcggacctggggcagaggaggctggcgttgagggagttgagggaagcggctgccagggggcttctgtgcgctgggggagaatggcagcgctccacgactggttttgtggaaggagaggagcatgtgctggttgatttaacagggcactgttggcaccccattggccaccgtgggcggcagccatctgttggccggctgcagccattggcgtagaatgtggtggccagccactggccaggggctggcagtggcagactggccgcgccacgcggtggcgctgtcggctgtggtgtgcggtcccgcgaaagaaaacagatgttgataacattgttaaggagctaaataaactttattttatttctttgaaacaagagctcgcgtatgagttgtttattaggatggtgacgattattggttggagaggagtggtcatcagtcggtcgatttatacagcgctcactcgttggctgagactgacgctgggaacggagcgaacgaacgtac

SEQ ID NO: 310 - DNA, 2825 bp, Zea mays
atcaccagctgatgctattcttgacttctgctatttcataattggtaaactaccttcataattggcaaaataccttcgaacgtgggtactgatttggtggagctaaagtgttctggtatcctcaggtggcacacatcttcctcaggtggcaaaataccttcataattcagcatcagctatctcatcttcctttttgagataattgttggagctaaagtgttctggtatcctcaggtggcacacatccccggtgcgctattcttcgacttagatggcatagttgatcagacaactgatgtgagaattgtttctatatatactttgcactctcattttttctttattttagctaaagtatagatacagcgacgattttcctaggattgcggtgattcatacatctttctacaaatctcatgtacttagatttcgccgccaactggagacttattctttcaattagtttgcgcaagacagtagcgatatatggcttgtcatttttcccaatgcatactaagtttattgtttcagttaccacacatgctgccatcagaagaggcattcacaacagcaatttctgagctagatataaaaaaccaggataaagttattgtttatgatggaaagggatttttcagtgcgcctcatgtttggtggtaagcgctgaaatctgtatccagtatccacttcataaaaaatgatgaaatcaatactccattagacacttgctattcagttgtgctgtcgatataagaagcgataaacacacgatcaggaaactggttatagccgacagttattcgtcatgtttatcacattgatattcggtgtaggtaactgcagccctgtttagtcagtttagggttctttaggtgcatgttattcggtgtaggtaacatacagttttctgtgtttccatatgatccaggagccaacgatgatgaaactatttaggctttcctccactgtccttccagcagctcatcgttgcatgccttgtctgcccaagttgaacattgattaatctgaaaaataggagacgatgtgggtccttggtattgtgcatgtttctactgaatccatgcttcctttgtgtacttttactggtaatctgttttcattatggaaaaaatgaccactagtcttcttgatatatcattcttccacatgttgttgttatacttggaggaatggtacctctagagaactttgcactttttctccgcaaagttcttttaaaaatcctattgcaatgccttttgatgctggctgcacacaacctttttttacttattttcttaaacaatggatgtggtgatgtgatattagttttatattttctctgattcgtgaacttgtaggtttaattcttgatggtccatcttctgttgatgacttatggattcttttttcttgtggtcagtcctgcatcaattttaaaacagaattaatacatttttttcattttcaaggttctgatctcccatgccacaattttataacgttgaaggattcaaaaatctacagaactagatgatacttgcataatgcagccctcagatatttggaaggcgcatgttggttcatcacagtcagagggttcgggtctggatatggagaggaacggatgcaatcatatttattgtccatctcctttccaaccaattgcctcagctggtcagcactctgaaagcagcgctgcatacttttcttggcctacatctactctaatgcacgggtcagctgaaggccgtgctaattactttgggaacctacagaagggtgtactaccaggacatcttggtcgcttgccaaagggccaacaagctaccaccttacttgatttaatgattataagagcattccacagcaagatcctccgccggtttagtcttcgtacaacaataggctttagaattaggaaaggaacattgactgacacacctgccatccttgtgtttgttgctcgaaaggttcacaggaagttgctcagcgctactcaatgtcttccaactgcccttgaggtaggcatgatgtttgtttcatgtagtttacaatgttatttaagccatctgaaaccacatattcagtttcattgcgttccataaacagggacctgggggtgtgtggtgtgatgttgatgttgttgaattttcttattatggtgcaccagccccaacaccaaaggaacaactttatgatgagcttgttgatggattgcgtggtagcgaccctattgtaggcttaggttcacaggtaacattcttttgttttcaaacaactagatgctgacaaaagagtatttccatcacttgccattcctcaaatataaatatattgcatctattatatggctcttctgacaaaagaagtttgaaaacagagaggaaggataaggacgcaaagaaaagaagtaaaaagaggagaaaggtatactctagcttatgacctgctgcctatttgtgaaattgttgcgatttacctaatggaaatatatttagttatgataactatgttctaggtactttgcttacttaaaatttgtttgacgccctcacctttaaatctttaacaacacaaaagttcatcagagtcaagttccagctcatcttcagaatcttcaagcagcgacgatgagagttcaaggaagtccagatcacggtcgagatcaaagagaacaaggaaggaaaagaagagccggtcaaagtccaagcgcagaggcagtgaaagcgaggaggaaggcccggtacgcctctctaaattcttcgggaagtaaggagtagacgctactgtagttggaaatcgcttgattagcagcctcatta

SEQ ID NO: 311 - DNA, 2823 bp, Zea mays
tataaaatgaaaatggtagaggtgtttccctcaccgctttattcactaatcagccattgaaggtacattaccatgagaaatcataataccctaaacatgtgcaggggtgtaataaacatcaataataatatgaatactaaaagctcatgcttgaccggatcaagcgtgcgatacacctatattgaaacaccaaaatcagtaagcaagcaacataacaagtctccttagccatcacaagagccatagcacacaaatctacctctacacatgaatgagaaaccgcttcttagtcttccaagcaagcaataatagtatcaccaaaaacacaataggtagaaagagtgacaattagaggaaccactaccccaagtagcatgacaatatatctaaatccttaagtgctaggtgggggaaaatcaagcaacaaacaacatgacacagtctcacaaagataatgtaagaaatattacaccaacacacgaaaatattgcataaagtataaatagatatttgtctatgcaagaatatattttatttgagaccaaaataattttatttgagttaaaattgttttgttattgattttatttcatttcgaacatccaagtttaaatttcaaataactatatattggagtggattacatgtttatttcaataaaatagaggggctttcatgcaaaactagaactattagcgttggatgacttaggctctaaccaatatcggcttgttttagccatcagatcacatgtgtgcgtctatgattaaaagagtaattgtgagggtggtgcttagagagcgacgtccttccccatgatagacatcagatctctctcttttaatttattatcaagtgttttctaccttgactaattcatccaccatgcttcttcattgacttctgggtagtgtacaatataaaaaagtgcatgttttgatggcacaaagaaggcatataaaaagttcaaacatttcatagctgaaatcagcagtcagagatgtaggacgacaaccaccaacaactgttgtttcacgggaccactccctccaaattcttctaagttcaactttgaatgcgagtagaacaaggggaacactgacaataaggaatccaccgtgaacttagatcatgaggttaaaaagcttgcatgcatgcatttgttaattgctgaatttagcagtaataatatggattaaattagtaatttctatgtggaattatatgcaacaggaatgcacaattgcttttgtatttttcaaaactcgctatgacgcagttactacatcaaatatggtgcaggcatctaacccaatgaaatgggttactagtctggctccagaaccagaagacttgtatttgtccaatctttggcaatccaacaagtggcgtaaagcaacactaattccaggcaatattatttttgcattcttacttttgctgctgatggtgtgtatacaagcattatttgacccagagcagctgcaacagttgattcctgcttcgttaaaagaaaggttggagaattaagtactaaaacttcagttgggctatctcgatagatgtgtgttcttatgtcactacaaatatatatactatccatttgacctgtctgcatgttgcacctattaaatatatattacccgtcctatttgcaggaaaaactacatgactaacctagtaacgggataccttcctaatgtgatccaacaaattattctatatattgttgggacattgatgatgaaagtttctaaattggaaggtgccacatctcacagtgcaaggaagatgagtgcttgctttaaactgttgtgcttcatagtttggaacatattctttattaatgtactatttagtacattcatgagtcaattgaatttgttattaagcccaaaggacattcctgtcaagcttgctagagctttaactagacagctttagcacaccttcccttttctttatggaatgataatatattggttttgtttatttaattttcatctaacatttctgtttcttttctgtgattttatcttttattgcaggctactttcttcatcacctatgttatgacctcgggatgggctagtttataatccaaacttttgttgttttttaatctgataatagctttataaatatattttgagaaagggataatatagagaagatacagaatttgttcccacattcgcctatcagcatgaggtgccaaaagttctattgtttggactattgggcttcacatgctctatggtggctcctatgattttaccgttcctgctggtatacttttaccttggccgtgttgtataccgcaatcaagtgagaacctagatactatattttattttcttacttaccatgaaatttgtccattcatgctaatgtaccatgtgttctttttcagtttctcaatgtttatcgaacaaggtttgacataggaggattgtattggccaattgcacacaacacaactatattctctctcatgctcacccatatcctctgtgctagtgtatttgacactagagagtcgtgggtagctctatgcttgaccatacctcttatcagctctactcttccatttcacttttactatagaaagagtcttctgttattcaagactattccaacaaaggtaatattagttcgttaatataatgtgaaatgttcctttccaaaacgataatgtggagatgtgactaggtttactagagcataaaataataattgatggctagagtttattgttgccttgtgattttgcaagatctcttctcttatggcatttattgttgccttgtgattttgcaagat

SEQ ID NO: 312 - DNA, 2822 bp, Zea mays
caatctgatttcaaaaatcaacatcggtgatgaattttagatgtcgcgatttatctctttcaatcgtaaatccgaaagccagtcatatctcaagacgatttattttcgaatcatgcgtagggaattattgccgagcgaagtcagatcagactctcgaccaagttaatcgctcaatcgtctattcgtcggaactctaattcgttatgttctccatagagacaaattccacgggagcatttttattctgggaaatatttagcgcagcccgattacgtgtattgggccagcccaacccagtccatttggaaccctaaccctaggactcctctataaatacaagtgcctccccttgcaaattagaaaatttgcatatacccccctagccgccacaaccttcttcctcctctcccacacgcacgcagctctcttcttctctgttcatggcgcaggaaatttcctcctcgcccatggtgtccttccctcctcccccttcttcttcctcaagcaagcaggccgacctctcctcctctgccatttcctagcgccaccttatttttttcccctgtctctttcttcctcacggctgcaacagggagctcatctccttctcccatggcgctcggcgcccctgcagcacggcgcccttcttccccagtgacgcctctgctccaaccggccttcttcctttcccccatctgagcgcccaagcctacgcccttccctgctccatgggcgcgagctccacctcctgcaatggatgctgcgtgagctcaacccaagggcgcgttccctgctccacggccagcaggaagccagcgcccctctcctactcggccacatctgcgcacagagagttcttccccacgccaccctctttctttcccacgaagcaagcagggaacacggccaacattatcttcctcccatggcttcctccctgccgcgtctcacctctggtcgacgccttgcacagcgccctctctcccatggcgagcagctttcctccctatggtcatggtctgcgacaggaagtcgcgcgctacatgttcgatgttttgcgcagcagccccgacatctcctcgtggacagcacgccgtcgacgctcaccggttgtttgttgtttttacgtagccccaacatcgacttcgttcacccccggtgagtcacccctctgcccttgctgcaatcatatttttgtgctcagtaaaatgttgaaatgttgtgtgtgtctaatcgcagctatccatcaatgccatccgttgcgcacgcgtgttcgatacaaggccggtcgggtgaaccacatgcatgcacaactcgattccgatctagtccaggttgattgatttatagtttaccatacgtatgatttggttgatgtcatgcagtgcatgtatatgtgtggatgtgtgtaaaatgtttcagttatacacattagtagggtcgcatttgcggttggagaacaagaggttgtttgatgtgtgcgatttgtagtttgtctaattatgttttggtcgatgtggtgtatattggtgtttgaatatatgtggttgcgatggttcatttatgtgtcacaaggatggtttgtggaggtattaattgtttgttaaaatacttcgtcataaagcattgtgttaattgtggtaaatctaaaaaagcgtaaagcaggcttggtggtttccgcagtcggctaatgagtaagtctatgttaaatatattttatgtattcatcgtggtgtgggttagagtgggttgaaaatataaattatgtgacatgtgattagtgttttaaagatgagatgtgtgaataatcagttggtgtttcactcgtctagtcgataagtgttgtcataaataattgtgctaaaatttggtcataagaatgcagtgggcacgtggtgttggttggatgtgataagtagattggaagtgtgggtttgtctaagcactgtgttgtcgaacgtctatgtcgaagtgcattgtagtaatgattgcgttaagtaaaaagtaatgtctcgagtgcacgccacaatatggttgtatgcgagacggggttacgcgcatggtgagttcagttaaattccatcggtgtcacatgtgttaagttgaggtttatttttatgtggaaagtagtaatgtatttaatacttagaactcttagtcgatggtagaaattgtcttggcttaaatagagaggtggtgacatgtcaaggtagtcatcatttcctctatattaataagtcgagtcaatacgcattatgcgttgattaaatttcacatcgcccatagtgtatggttgtgttcatgacctcgaatagatgtttcgagtggacaagtaggtttgtaatgcaagatgtgtgatgaagttagtttgttgtagaatatttgttgaaatgctccattcatgtgatagacatgtatgtttaattcaaatcaagtcgatgtgtgtgatgatgatattcatgaattaagtagatgtcctgtaattgtgtagtgaaggttaggttaagttgcaagcgatgtggggatgtttggtaatgatatatgtgaaatgtgaacgagacatccaatgtattcggtatgtcgcgtagtggtggtattaaaaatggttagaaatcgatcggctaaatgccaagttcggttagagttttttggttaaatgggattgtgtggtgaagggatggcatgactacatagccatcacgtcatctattgggtgactatgcttaagtgtgtcttgatataagttagaataattccagtctctagaacatggcaattcttgaattatacaggagctgaaaattattaattgctcttttggg

SEQ ID NO: 313 - DNA, 2821 bp, Zea mays
gaactagggtcgggacctagagagatgtgattagtctgacccatagagatgcgatttctttcaatggcatcatccggtttttcctcaatatatcatgaatttgttgggggacttgcgagacagagtggatgaactgacgaaggagattgatgcattacaaaataaggaacaagaacttaaggactctttggaaggtatgatgcagctattgaatttggagtgaaggtgtagtcgtgttcatgcagccttagcagtaagcccttattttgttttctgcctatttctcttttgtagccatgtcagttatttatactttgttctttttatgctgagaagggcttggggtgctagtgaccaatatgctgatggttacttcctccgtgctactacgttctaatggacgcactcagttagtctggtgtcagaactcagttattccattctaatacctcagttattcttgtgggccgactcatttattttcttctcgtgactcagttattctactccaatccctcaattattccgttataataactcagttattgtaacgtacccactcggttattctctgttcacaagtcaattattctgttccagtaactcagttattctagtgtggcgactcagttattcttgtgtcagtactcagttattctggtgacagaactcagttattacgttctactacctcagttattctaatgtgcacactcagttattctctactcattactcagttattccattctaataactcagttattctggtgtcagtactaagttattctggtgacagaactcagttattacgttctactacctcagttattctaatgtgcacactcagttattctgttctaataactcagttattctactaattactcagttattccgttctaatacctcagttattctactgttccgactcagttattctggagtcagcactcatttattctagtgggcgcacttagttattccatgttcatttctcagttattctcggttcagtactcggttattctgtgttcatcactcagttattctagtgacggaactcagttattctctgctcatgcctcaattcttgtgggccaactcagttctactccaatccctcagttattccgttataatacctcagtattccatgttcctaactcagttattctaaacccttagttattatgttataataccgcagttattccatgttcctaactcagttattctaatgcgcgccctcagttattccatgttcaacactcagttattctctgtacgttactcaggtattgtgcgttcattactcagttattctagacgacgcactcagttattcgagtgacagaactcagttattctactccaatccctcagttatcctgtgtcatacctcagttattgtaatgtgcctactcagttattatatgttcatgactcagttattccgttccaacaactcagttcttctaatggacgcactcagttattctggtgccagaactcagtaattccgttccaatacctcagttattcttgtgggctaactcagtgattatggtgtgcagactcagttattctggtgtcggcactcagttgttcggttctgatccctcagttattctactccaatccctcagttatcctgtatcatacctcagttattgtaatgtgcccactcagttatgcggtgtttattactcagttattctctattcacagtcagttattgcgttcaagtaactcagttatgctattgttcattactcagttattctgttgtgcacactcagttattccatgttcactactcagttattatctgttcattactcagttattccgttccaacaactcagttcttctaatggacgcactcagttattatggtgacagaactcagttattccgttccaataccttagttattcttgtgggctaactcagttattctcctccgatccctcagttatcatcatacctcagttattggaatgtgcccactcagttattattgtgtgcagactcagttattctggtgtcggcactcagttgttcggttctgatccctcagttattatgttataatacctcagttattgagatgtgccgactcagttattccatgttcgtcactcagttattcttttgtcggaactcaattattctaatgggcgcacatagttattctggtgtgataactcagttattctcgtgtgcctactcacttattctctgctcattactcagttattctctttgtaatcactcggtagtggggactccgtattctctattcacagtcagttattgcgttctattaactcagttattccatgttcgccactcagttatttactcagttattgtgttttcattactcagttatttcattccaacaactcagttattctaatggacgtactcagttattctggactaatacctcagttattcttatgggccaactcagtcattctactacgatctcttagttattccgttataatacctcagttattgtaatgtgcgcactcagttattacatgttcagtactcagttatttctttcagtagctcagttattctattgtgcggactcggttattctggtgtcagcactccgtcctaatacctcagttattctctgctcatgactcagttattctagtgggcgcactcagttattccatgttcatgtctcagttattctggagtcagcacgcagttattctagtgggtgcacttagttattccatgttcatttctcagttattctcggttcagtactcggttattctgtgttcatcac

SEQ ID NO: 314 - DNA, 2820 bp, Zea mays
tttcgactgagcctttcgttttatttgaccatgttggtatgatttaaattaatacgactcactatagggtcagtgcggccgcgacttcaagtcaccaatgaggttgccggcgttggagagcgagtttcccaagctgaagaggccccgtgtatgacttcttgctcctagccacgtcacaggtggccggccgcgccaccacatgcaatgggatagtggcggcggcagagacatggggactggggagagaagtctagaagtcttgcgatgcaagaagatgctggaagctcgattcgagtgtgtccgttggataacgatcttacgctgttaataatagagacgacgtggatggtctggaatgcaagattccctccccgctctattgtatagaattgccgacgtggagtgtgccagcgtcgccgattcctaatcaagcggggaatgaatttctaatgacgtggatagcgtcgtcgttgccggtttgaaccggctttaataataaggaaaggaaaggaaatgtcgttgaggagccgaagacgacgtggaggggccagtcacaaatttcatatgggtctttatctagctgccgcgtatgcagagcatgagattgaggcacacaataaggctctggatgccatggccctgttcgacggcaatgtagatatggttaccaacgtcgatgttgtgccgccgagtaggaccatgacgacgagggaaatttgctattttgtcactcccagttgtgaacttctctattttagacccagacctacaaatcataaacacagatggtcccacgagtcatagacagagggtcacataatagcatttagcccacgttaaaaaagctaaaatagcaaatttttcgacgacgatgggctcctcgagcccatggccacgactagcattgctactcgtgacagtcgcatatatgaggaagagactaccaaaatctagactctaggctaactttaacaaggtgacgacgttcgacggtaaatgtaaaaaggtaaggatctttgatatcagcaaaccatgcaagagtactgtcggagagaaaaaaatattaaattctctgagaaataagtgaaaagtaaatttgttgcagggaaagatacaatgtttgatgggctacagtaaaaatatgttgaacaatagaaaatacagtggcagtatgtctaaactacggaaaaagagtacatagttataaatgtttttttcatgaaactaaatactactttgtagtatagttataaatgtttttttcatgaaactaaatactactttgtagttgaagtacagaagagagaaaccatacctctataagttggtagccaaataattgtagccccgcagaaattgttgctattaaaacaatttttagaaatgtataagtgactttatgtagcagcacccatatcgagtagtagcaacagctcgaatgaaaataaactatatgtcagatgtatagaggacccatggtggactgccatctcgaaaccatacaaaaaattcttatgatgccaacagagaacaaatattgatagcaagagaaacgatggaagtcaatttaagataactataaacctttctccatgatcataaattgaatgttgtttaaaaatgatatttgagatctttgggaactcatctccatgttcctgtttatgctatctctgaatgaaatgttcttactcctaatgaaaataacattatagaactaaaatggccaaaagagcgatggaagtcatctttaagataattataaacctatctccatgatcataaattgaaagttgttataaaatgatacttgagatctttgggaactcatctccatgttcatgtttgtgctatctctgaatgaaatgttcttactcctaatgaaacaacgttctagaactaaaatggccaaaagaggtgtcgaagatcataagtgtataattatcagtataaacctatctccatgatcataaattgaatgttgtaaaaaaatgatacttaagatatttgggaactgatctccatggtcatgtttatgctatctctaaatgaattgttattactcctaacgaaaacaacattctagaattggaacggccaaaagagttgtcgaataccataagcctataattatcatgaacatttatataccaaattgtcactttcaggaagacatttacaatgaaaataatctggtttctgatttggatataacttttttgtattcaagcgtaagagaagaaggcagtacatatgtaagtcatcaactgaaagtgctgttctttacggagaatcattgttataatgaggaaatcagggaaactacatgagtgccaaaaaaacatgacaatactcatattgtttaccaaataaatgagtagactatccatatgatgtaatcatatatggggtccaaaccaaaaggaaatatagaatcatacgcggtttacaacattacaattgtaaaccgaataagtgttgttatttacgaagaatcgttgttgtaaacagaatttaggaaaactacatgtgtgccaaaaagaaagataacagtactcatatcgtttaccaaataagatgactatccataaaataagtagactatccatatgatgtaattatttatgggttgcaaaccaaaagctaatatggaatcatatgcagtttacaacattatgagaacagtgcttcaaaaattaaacaaagactatcggaacccaaaaaaacaaaagaatggtcacctaattcagtaacggaggctgggttgcactaattggattgattgattgtccctacctatgcaaaatggggacatatcca

SEQ ID NO: 315 - DNA, 2814 bp, Zea mays
gggagaacggaggtcggttcagtaaaacgatgaagatcagtggcttaggaaatatctgaagaaaagatcagtggtactgtggatttggatgtgatcagatgaattggagataggaacaaccgcttgataactttgagccaattcactgcttcgcggattaggccgaggtctggccggagatatttcactggcgatcaccgtggctcggtcctttcgttgccgtgtcactcgcacctcaattctacctctctgtgttcctttgttatgtggtcgtcaagcgttagcgacgtgcttcgtgaccgtggatagttagccaagttgtcgtgcctttaaatagcgctgggaatcgcggcgaggtactcagagttcttcagtgagctcggttaaagccaaaatttgcattgcctcctcctctccctaaattggttgtgcatggtgaattggtagtccttcgcggccatatagccctgacgtgaccccctgtttccactcacgtgaatacgaattggaatctcgacccactcagatgattttatcttgaacaaattaatttgaactcgaagactaaaatgttcagggcaaaataatctgaatcgcgtattgtatgagaaaaatcatgcgcgagattgctaaccaaggaattataattgagatttgattctccaataaatcatcaatggcagagtgattaggtgttcgagtggcagacgaagttatatggtttcaagtcgtatcaaatatagtttaaaatatcagtctcaatctcgtttgggttcattctatgtgcatcctacccgaacccgatattatccgagacaaagagattaccgtttgattttatagcagataatattgggtccgaaagaatactcctgatcgcttgcgttaccaagaaaccgtgcacaagattaacaattgggattattcattagtgtgctattctaggtagagaaatcaaatcgattaggaaaacagataaatttttatctgagttcaactaaattaatagagtctcaagtaccgtatccggatagtgttttggtccttgtgtttcccggctagatccaaaacttcggatataaataacgggtgaaaattcatctaattccgagagtattcaccaaatcaaatcctatctaaatattgttgtcagtctcatttttgtttgatccttttgtatattttttagactctaatttcataccctaaaatatgtgtattttgttgtttttaaaaaaagaaggaaaaacagggaaaatccttctctaaatatttccaccgttccttggtatgattttcaacgtaattggatttttcactatagaaaatatctctctatcgttgttttcttctcaagtacgtaaacttcctagaatatcattggtcgtcatcgatattttctttgctagcaatcgtattcgatgcattttttccttgtctctgtcgccgcttaagtgggtaaccggtagaatatcttcttctacatgtgcatactctcccagccttatcttcttctacagatttttttccttagcattatctctcctctccacacggcaacaggcgcttgttctcacatcttcctcctgcagctgcgccctggtcccggacatcccagcgtcgtcccatctcctccctcccagtcgactttctgctcttccatggctgcttgctccactgtgcagccgctcagctccttgacctcccctcaactttctccagccgccagtgctcgccaagtcgatctcccatggcagctagtcagccctgctctccagtgcaagccgcgctcctccatcgcttcattcctccgctcgcctaactcgtccatggctgtcgtgccgagttcgccctgcgcgcagccaacgtttctccctaacgcgctcgcacagccatctcccatggcacgcgtctcccctgcgcgtacgtctccctgtccaccttcctgttgcgcctctctccgtcgaagctccctgctgctcgccatggcgtcttccagtctctagctcgccctactccttgttgctgcgagctccagctcggattcagcccagctcggatcttttccatggtcgttgcgcactggccctgctcggattctcgtcgtgcgtacttgggcactgccccagtggccacctgctccaatcgccgcgcccaatcgagtacacccctgcgcgcaaccgtgggtttcgctgcgcagcgttcctgctccctggcctccgtcgtgctcggtagcaagtaattcatgtcgaagcagcagctgcgatcccttgcgtcatgctcgccagatcgagtctcgcatcgtcgatctgcacagttcctgttcggctatcggttccgcctacgtcgatctcctaattgccatggatcgtgtatcgacgtcccattacaacagcccgtcgtaaaactctagtgcttgtctttgatatccggtcgtctccaacctttgtcttgtcgtcgtcgtttggtcacccgtctcgatgtcggtccctacgtgatgccgctgagttggagtcgtgctgacaaatgaagccccaagagaagactaagaagcagtttctcattcatgtgtataggtagatttgcatgctatggctcttgtgatggctaaggagacttgttatgttgcttgcttgatgattttggtgtttcactacaggtgtatcgcacgcatgatccattcaatcatgagcttatagtattcattagtgttgatgtttattacacttccacacatgtttagggtattaagatttctcttggtaatgtaccttcaatggctgattactgattaatggggtcgggaaaacacct

SEQ ID NO: 316 - DNA, 2811 bp, Zea mays
taaaaagaaaagaacacatcaatttcatcttgactacatttgaattagatattccaaagtccacaaacataagtagaataagttgggaaatactgatcaccgaagccaaataaaaaacagatgttggtgtcgggcaggaacaactactggggtgcagtacccaggaagttgacggacgtggcggtcgttggagcagcgggcggtgggcttgcagaagaatgtcactccgtagggcgggcgcgcaccgcgcagtggtgactggtgagcgtcttgggcataatgccgttgacgatgaggttgctgacattagagatcgagtttcccaagctggagatggcccgtgtacgacttcttgctcctaaccgtgtcacaggtggccggccacgccaccacgcgcaatgggatagtggcggcggcggagtcgtggggactgggagagaggagtctggaagtcttgcgatgctaggagacgctggaagctcgattcgagtgtgtccgttggataacgatcttacgctgttaataatagagacgacgtggatggtctggaatgcaagattccctccccgctctattgtatagaattgccgacgtggagtgtgccagcgtcgccgattcctaatcaagcggggaatgaatttctaatgacgtggatagcgtcgtcgttgccggtttgaaccggctttaataataaggaaaggaaaggaaatgtcgttgaggagccgaagacgacgtggaggggccagtcacaaatttcatatgggtctttatctagctgccgcgtatgcagagcatgagattgaggcacacaataaggctctggatgccatggccctgttcgacggcaatgtagatatggttaccaacgtcgatgttgtgccgccgagtaggaccatgacgacgagggaaatttgctattttgtcactcccagttgtgaacttctctattttagacccagacctacaaatcataaacacagatggtcccacgagtcatagacagagggtcacataatagcatttagcccacgttaaaaaagctaaaatagcaaatttttcgacgacgatgggctcctcgagcccatggccacgactagcattgctactcgtgacagtcgcatatatgaggaagagactaccaaaatctagactctaggctaactttaacaaggtgacgacgttcgacggtaaatgtaaaaaggtaaggatctttgatatcagcaaaccatgcaagagtactgtcggagagaaaaaaatattaaattctctgagaaataagtgaaaagtaaatttgttgcagggaaagatacaatgtttgatgggctacagtaaaaatatgttgaacaatagaaaatacagtggcagtatgtctaaactacggaaaaagagtacatagttataaatgtttttttcatgaaactaaatactactttgtagtatagttataaatgtttttttcatgaaactaaatactactttgtagttgaagtacagaagagagaaaccatacctctataagttggtagccaaataattgtagccccgcagaaattgttgctattaaaacaatttttagaaatgtataagtgactttatgtagcagcacccatatcgagtagtagcaacagctcgaatgaaaataaactatatgtcagatgtatagaggacccatggtggactgccatctcgaaaccatacaaaaaattcttatgatgccaacagagaacaaatattgatagcaagagaaacgatggaagtcaatttaagataactataaacctttctccatgatcataaattgaatgttgtttaaaaatgatatttgagatctttgggaactcatctccatgttcctgtttatgctatctctgaatgaaatgttcttactcctaatgaaacaacgttctagaactaaaatggccaaaagaggtgtcgaagatcataagtgtataattatcagtataaacctatctccatgatcataaattgaatgttgtaaaaaaatgatacttaagatatttgggaactgatctccatggtcatgtttatgctatctctaaatgaattgttattactcctaacgaaaacaacattctagaattggaacggccaaaagagttgtcgaataccataagcctataattatcatgaacatttatataccaaattgtcactttcaggaagacatttacaatgaaaataatctggtttctgatttggatataacttttttgtattcaagcgtaagagaagaaggcagtacatatgtaagtcatcaactgaaagtgctgttctttacggagaatcattgttataatgaggaaatcagggaaactacatgagtgccaaaaaaacatgacaatactcatattgtttaccaaataaatgagtagactatccatatgatgtaatcatatatggggtccaaaccaaaaggaaatatagaatcatacgcggtttacaacattacaattgtaaaccgaataagtgttgttatttacgaagaatcgttgttgtaaacagaatttaggaaaactacatgtgtgccaaaaagaaagataacagtactcatatcgtttaccaaataagatgactatccataaaataagtagactatccatatgatgtaattatttatgggttgcaaaccaaaagctaatatggaatcatatgcagtttacaacattatgagaacagtgcttcaaaaattaaacaaagactatcggaacccaaaaaaacaaaagaatggtcacctaattcagtaacggaggctgggttgcactaattggattgattgattgtccctaccta

SEQ ID NO: 317 - DNA, 2808 bp, Zea mays
catagtgactagatggaaattataagttgtagttagttttgtaaaaaaaatagtttgcataatttatcctgtcttatacgtccaaatgtcataacattaaaataactgcttacaggctgataattgtcaaaatgcacgaatctactaattaaaagtttttttattttcggtggtagtttcatttctaacatgtcagcaatttggatggtgtggcaatcaatcagtgaagaaagagatgaaaccatgtgtacactattacctgggcatattatgtcttgcatgttacctaaaataatgcaccaaatgaaaatctccgctatgagagaatgtttcaaccaagatttcatttcttttaatttgtttggactttgtaacttttgaacattagttttagttttttttttaaaaaaaactcctcgattacgttaaaaaaaatcctcgaagccaaaaggtcacttcggagcattagtttttagtttttttagacttagtgtgcttttagaattttgtcttataatagctctttagcttttaaaagatcaaacaaacggcgatagaataggagatcacacaacagcgcatatttagatttttataggataggatacaagaacacaagttacttacataaacaaattggaaaaggaatcttcgacccggttgcattgaacggtaatgcaggtcgtaccatgtgcgcgaagcctgaattattggcttaattttagtccacaacgactcaaagcatcacgccagccgcacctgcggaccgcggcgctgtcctgtgtcttctcctcccagtagcgtcgccatgatttacgcaagcttgcagaacgggaggccatggcagcgcgcacgggtatgatggcccgacgtcccggttcctcacgtgctcattttccacctccatggtctccaggtcgacggagaagagccaggttttctcccccggcgtcagcaccacggaggtattgtctgcagcgacaatactcgccggcagcctaaagaaccagtattcccaaccgggcagattcgcggtcgcgtccctcagactgatgctcctctctatcacccactcgccggaatccggtagctgacagaacacctcgaggtcatcgccgtccaagcgcacgacgcgcaccgtgtctccaccgtccacgccaccaatgacacggaagctgatcctccgattcggcagctgcataggcgccgggaaggcgaggagcgagaacttgagcgtgctctcgtcgagcacgagcaggctactggtctccatcccccagtagaccttcctggcggctcgtccagcaaaatggctcctctctatatctgggacttcaacgtcgtcgtcgttcatggcgtgccaacatatgcgccacccgccgtcgctacctggagtaaacacgcacgcccgtggcgtgcagaactggtagcgccacctgctgcgctcgtagagcacggatagcaccctgaagtttgacatggcgtcgccggcgcaggttccgacaccatctagcaggaaggcgccaagtaacgggagatggctgaggtcggccgggcgcgcgatcccctgatatcgccgtgacacgggctcgcacacgatgaagtcaggtgaccagcgccttgggtctatggactcccaccacggcgtgctggtcaggaggaggaggctgccgcggctgtcgacgatctccctgctctggctacgccgtatacggctggaacggttgtcgtacatgtacatgcggcgtgggcggtcgccttccaccggcggagcgtataggaagtcgagggagaagtggcccgcgtcgacgacggccggcgacgagggcacgaaggctgccggccgtttccttgccggccggccccaccgccccgtcgcgtttggaggcagcatgtccgtgacgtagtagcggccggccacgggcggcgcgccgtggagggcgcgacagcaagccaggaagcctgcgccggcaacggcccggcgccagcgcctgcacgtggccgcagcgcggatgaggtggagcggcgagccgaggttgaggagcaccgcttcgaggagctcgtcggggaggtcgtttacgctcgtcggccccgcgggcagcttgctcctctgtttggccttgaccttgttacgcttacgccgctggcccttccccattgacacaggaacgtgcgcactctggttggcactcgagaagatatgctaaactagctagatcggtcctgttccattgagaacgaacagtgtacctctatttatatatacttgctcggttgatccactcttctattgtggatcatttttgtatccaagctatttttttaactctctaggtcacaaatttgtcactctcttgactaaaatctcgtgtcaagctttccaaactttaacaagtttagagattcaaaaatgacatcgctagacttgtcttgaaaagaacttctatatttacatatatttattagacaatgtagctataacttaatggcaaaattatggccaagttgcatctcaaagacaaaacaaagccaaaaaaatgttataagtttttcatcgagattgagtacacatggtatggtacctaactaattgagaatcaaagttgctatttgaactaactatgaaagaaataacatttttgtgatcgaattagattagcattatgatgtatttggcacgaactaactatgaaagtcattcaagttttctatatttggctagcgaggaacccgaaatagaagatgtctatatttgaatagtcattttcataagcagttagagggtacgtacttttgtataaaaatctc

SEQ ID NO: 318 - DNA, 2807 bp, Zea mays
gagttaggtgcagtttagtttaactgatccaaatgatgcccaactatatgaactttgtgacatatggttagcaggttactggggtcttattgggtgagaaacatcttaggctggttaattttttacgtgtgtaaaacctcaatcatgtcacatccactcgtaagaagactcagttgtattcctgttaatagaaatggttgtttcctctttaaaaatatgttgactaacttggtctctatagacaagtttagtgacctcgtgggcaatttactctagcaggccccaaaagtcaaacaacaagttacgtacttctccataagaatgtagcaatcaataacatgcatgtttgtcaaactgacaactaagacccaattgcagcaagagcgtgtgacagttcctaacccacgagacccaatttgcagtagaaaagcatgcataagattttgttgacacctagaggagacggttcctacattgttcgactccagtgcacctaattgggcctataaataaaccaacaatacaccttaaggcagaaaattaaattgggtatatgatcgcatgcaaatgcaacattaatttttaggcctgctccgacggtgtaaacaagcgaaactatatttttcagacctgctaaccgcctgacacaaagttgatatagttaggcctcatttggattagctaaactcgactacagctaactcttgcgttttagtcttttgttgatcttcatttttattagtttcaagatcttcatgcttaacaaaagagaacaaatttcccagcgcatcctcaagaaatagcatactatctttggcatttatcgccactacatgtcatctaagaatttcaacacctttatttgtgctcccacttgcagctcctcaacattatacaaaagcttttgagctgcttcagtagcccgctttacctgtaagttcttcctcttaatggtcccaccgtaacattcttccattttcttaagctgtttccacacataattctttttcgtttgttatgctgaaatttcattgtgcttctctcatcttaggatctagtaagctttctttagtttttaatctcttccctaatctcttctccaatcttttgggatccgaattgtcaatactaatatatgaagtaaagtttagtcccaataattcggatcaccaaaaaagtgagaaagatattaggtaagagataagaaaactaaagtaagcttccaagatcatgagattagaggacagtgaaaattcagcacaacaggcaaaaaagaattttgtgtggaaccagcttaagacaatggaagaagattacactgggaccattaagaggaagaaaatagaggtaaagcaggctactgaagccgctaaaaagtttttgcataatgttgatgagttgcaattgggtgcccaaaagaaggatgatgaaattgttagaatacaaatagtggcgacaaattccaaaaagagaatgttgtttgttgaggatgagctgcaaaaattgttgtctttggtcaaggataaagatcttgaaactttataaaagtaaaatcaactagagactaaaatgcaagatttagttgctgtccagattaactaatccaaacgaggcctaactatatgaataggtggttagcaggttactaggttcttattgggtgagaaacttttgatgccggtggattttgctatgtgggtaaaccctgaatcatgtcacatccactcttctcaagactaaacacaagagttaggtgcagattagtataactgtggcctatataaaataatgtggactaacttgttctctatagacaattttttagtgatctcgtgggccaaaagttagacgaaaagttaccttgttctccacgagaaagttgcaattaataacatgcatgttggtcaaactgaccaatcagactcaattgcagcaagatttggcacacggatgtactgcaaacataaatcaacagtcaggactcacaaaatcaatagctaggcttgtgctattgctctctctctcactcaccgagaagacatgtacacaactctctatcttgtgagtatcaggagcatcgtcttgctagctttctcctaccagagcaccacactttctcatagcactagatagcacatcattgatggatccctacatacagcgctagcacccattaaataaatagaagtagacgacgacatgcctagaaactacacctctcgtctcgtctgggccacatgatgcacgcgtcttaccatgagaagcgatcactactacaggccaaccgtacgtgtctctccaaacataggttgcactagagcgtgttcttcaactagtggatgcaagactcgcattaaatgcaggcatggtctgcatgcacaaggcgccagcccgcacgcctcctccgttgctccatgcatatggggcgcatcctttggctctgcgatccaccggaaccgctccactttttcatgtactcaacgttaaactccagcaggtttcatataaactcatgcatagtactagtatatggcatggcactccggtcgaaatccaggactgatggtctgatgtgctgcacgcatgttaggtaggcttcacacatcagtcgtgcttgcttgttcgtggagctagcttgctagcctttccctttctagtgttcttgcacctagctacagcagatcatgagagctttcaagcccgttgtacgtgctagaggccagaggctttccctagctccatctgaaaaaggctgctgcaggaaatgacttttgatcgagccgctactgctagtgcttcatctctta

SEQ ID NO: 319 - DNA, 2870 bp, Zea mays
tattatcatggccgattgtaaaaagatgcaagctagacacataaaggaatcaaaagaaacaacactaaaaaagttccttgaaccaatatatcatggtgatcgatgacaaaatttattaatggataatctgaacacacaaaagtgaataattattgattccactactcggctgcaaatagcctaacatatcaaaaactcatctgtcacgacattgagaagattttgacttggtaacgccatccatttggtctttcagggcatccatccttgtgcccaaagcatttagttgtttgtggatgacataaacgtctaccttggagggagacatgtcatgccacggcgacactggaggggacggcgatggtgtccttgatggcgcacgtgttcggggcgtcggcggtggctggaatggcgcatgtcatggcggtgtcgcttcatcttgttcgtgaaacaatctctcaagtagatccaaattcttaggtggttcatttatcatatgcttgaaatcattgccacatttctaaaaatgaaacaaacgtataattagaatatatataatctggattcaatcaaagagagacagagaatacccttgtttttttaatatgcatcttgcggcttttcgtctcccccatgtttgaagagtggatacgatgcagaacatggtcatcatacaactgtttcattcggttccatctgtttatgagtgttttatttgaaattgttattgttgtcaccttataaagttttccgacaaatattccagagctgtatcatccaaggtggattgcctctgctttatgatgtcgctgtcaagcaagtcgacgcagcccctgcagaacacagtgtctatatccggataccagcagaacctaccctcatcttgggtcatattttacatctacaagaaaaaaatgaaagaaatcacaaaaaaaacatatacatataagctatcacatttactagtaagagaggggtacgtacgtgagaaaactcacataaaactacgggtcacgactgaggtgtgactgtctggaagcaaacttaagcgcaatgataataagctataacagcagggattctttttagatctatcgcactgaaggccttgagaagtatattaatagaagcccccggtggcaatatgcatggcacaagtacgccacaccacttcctctacttaatttgttccgttcttatccaaacgaacaacaacgatcgatcgagtcttgagatcgctcgcgcgggggaagcgtgcgtcgctggcgacgggcgagtgcatcgactgcatgcatgctccatctgtgtgcatgcaagggaagtatattaatagaagctcccggtggcaatatgcatggcacacgtatgccactttgctttctgtccctaatttgtttggttcttatccaagtgaacaacaacgatccatcgagtcttgagatcgctcgtgggggaagtgcgcgtcggtggcgactgtcgactgcgtcgacttcatgcattctccatctgtgtgcatgcagctgctggttgtttttatttacgtgagtttgtttagcgctgatgctgcaaggaggccgcctagctagtgcgtgtgtgcacgtcgtgtgcgtggccaggtcgtaagccggcacgccaagtctcctgcatgcatgagcgctgcagcacaatgccggcggctctgttggtcacgtcgctcgtaccgccatgatgatgggtccggcgcatctgctgcgcgccgctcgggcaccgcacctagggtcttgtcattgcgaccgatggatttcgggctggcggacggggctggcccctcctctctctctctcgatgccattgtgcgctgcacatatgccgacctgggcctgacgcggtgagaatacacatgctgcatttccctaattcaaaatttggatactaacagcgtgaatagtccaagatgtagcaacataaacattctgctaattcaaaaacagacagagttgtgtattctttcttctttgtaaactgtagcaaggataattagacagagttcgtggaattgtggatcttgtatattaagttagaatctctatttgtatggagtttgtggagtatgtagtgtattttttttgttgatgcttctgtaagagatgaagcaccagcagtagcggctagatcaaaagtcatttcctgctgcagcctttttcagatggagctagggaaagcctctagcctctagcacgtacaacgggcttgaaagctctcgtgatctgctgtagctaggtgcaagaacactagaaagggaaaggctagcaagctagctccacgaacaagcaagcacgactgatgtgtgaagcctacctaacatgcgtgcagcacatcagaccatcagtcctggatttcgaccggagtgccatgccatatactagtactatgcatgagtttatatgaaacctgctggagtttaacgatgagtacatgaaaaagtggagcggttccggtggatcgcaaagccaaaggacgcgccccatatgcatggagcaacgaaggaggtgtgcgggctggcgccttgtgcatgcagacaattcctgcatttagtgcgagtcttgcgtccactagttgaagaatgcgctctagtgcagcctatgtttggagagacacgtacgattggcctgcagtagtgactgcttctcatggtaagacatgtgcatcatgtggcccagacgagacgagaggtgtagtttctaggcgtgtcgtcgtctacttctatttatttaatgggtgctagcgctgtatgtagggatccatcaatgatgtgccatctagtgctatgagaaagtgtggtgctctggtaggagaaagctagcaagacgatgctcctaatactcacaaga

SEQ ID NO: 320 - DNA, 2800 bp, Zea mays
gttaggtgcagtttagtttaactgatccaaatgaggcccaactatatgaactttgtgacatatggttagcaggttattggggtcttattgggtgagaaacatcttaggctggtaaattttttacgtgtgtaaaacctcaatcatgtcacatccactcgtaagaagactcggttgtattcctgttaatagaaatggttgtttcctctctaaaaatatgttgactaacttggtctctatagacaagtttagtgacctcgtgggcaatttactctagcaggccccaaaagtcaaacaacaagttacctacttctccataagaatgtagcaatcaataacatgcatgtttgtcaaactgacaactaagacccaattgcagcaagagcgtgtgacagttcctaacccacgagacccaatttgcagtagaaaagcatgcataagattttgttgacacctagaggagacggttcctacattgttcgactccagtgcacctaattgggcctataaataaaccaacaatacaccttaagggagaaaattaagttgggtatatgaacacatgtaaatgcgacattaatttccaggcctgctccgacggtgtaaacaagcgaaactatatttttcagacctgctaaccacctgacacaaagttgatatagttagtcctcatttggatcagctaaactcgactacagctaactcttgcgttttagtcttttgttgatcttcatttttattagtttcaagatcttcatgcttaacaaaagagaacaaatttcccagcgcatcctcaagaaatagcatactatctttggcatttatcgccactacatgtcatctaacaatttcaacacctttatttgtgctcccacttgcagctcctcaacattatgcaaaagcttttgagctgcttcagtagcccgctttacctgtaagttcttcctcttaatggtcccaccgtaacattcttccattgtcttaagttgtttccacacataattctttttcgtttgttatgctgaaatttcattgtgcttctctcatcttaggatctagtaagctttctttagtttttaatctcttccctaatctcttctccaattttttgggatccgaattgtcaatactaatatatgaaataaagtttagtcccaacaatttggatcaccaaaaaagtgaggaagatattaggtaagagataagaaaactaaagtaagcttccaagatcatgagattagaggacagtgaaaattcagcacaacaggcaaaaagaattttgtgtggaaccagcttaagaaaatggaagaagattacactgggaccattaagaggaagaaaatagaggtagagcaggctactgaagccgctaaaaagtttttgcataatgttgatgagttgcaattgggtgcccaaaagaaggatgatgaaattgttagactacaaatagtgatgacaagtgacaaaaagaggatgttgtttcttgaggatgagttgcaaaaattgttgtctttggtcaaggataaagatcttgaaactttataaaaataaaatcaaccagagactaaaatgcaagatttagttgctgtccagattaactaatccaaacgaggcctaactatatgaataggtcgttagcaggttactaggttcttattgggtgagaaacttttgatgctggtggattttgctatgtgggtaaaccctgaatcatgtcacatccactcttctcaagactaaacacaagagttaggtgcaaattagtttaactatggcctatataaaataatgtggactaacttgttctctatagacaattttttagtgatctcatgggccaaaagttagacgaaaagttacctacttctccacgagaaagttgcaattaataacatgcatgttggtcaaactgaccactcagacccaattgcagcaagatttggcacacggacaaactgcaaacataaatgaacagtcaggattcacaaaatcaataggcttgtgctattgctctctctctcactcaccgagaagacatgtacacaactctctatcttgtgagtatcaggagcatcgtcttgctagctttctcctaccagagcaccacactttctcatagcactagatggcacatcattgatggatccctacatacagcgctagcacccattaaataaatagaagtagacgacgacacgcctagaaactacacctctcgtctcgtctgggccacatgatgcacatgtcttaccatgagaagcagtcactactgcaggccaatcgtacgtgtctctccaaacataggctgcactagagcgcattcttcaactagtggacgcaagactcgcactaaatgcaggaattgtctgcatgcacaaggcgccagcccgcacacctccttcgttgctccatgcatatggggcgcgtcctttggctttgcgatccaccggaaccgctccactttttcatgtactcatcgttaaactccagcaggtttcatataaactcatgcatagtactagtatatggcatggcactccggtcgaaatccaggactgatggtctgatgtgctgcacgcatgttaggtaggcttcacacatcagtcgtgcttgcttgttcgtggagctagcttgctagcctttccctttctagtgttcttgcacctagctacagcagatcacgagagctttcaagcccgttgtacgtgctagaggctagaggctttccctagctccatctgaaaaaggctgcagcaggaaatgacttttgatctagccgctactgctggtgcttcatctctta

SEQ ID NO: 321 - DNA, 2791 bp, Zea mays
ggggaaactaccattagcagtataacacccataaaaatgcatgttcttcgtttcacttacaatgtatatgaatcaccttaggaactctattagggtcatgagcgagtgcagcatgatcccattagctgaggttcttcctgtcgccctgctcagggttgacgacaacgatggcgtcggcgaccacgagcccctcgacgcggagtggggcggcgatctcgagcatggaggacccactggtgacgaggtcctcgatgatgaggaaggagaagctgaagtcaatggcccacgcgacgacgcgtgcagcgagagcgcactggtatggcgcctcggcctggtggaaccttcccctggtcctgtgctcgaggaacctgaggagtgcagatggtcgagatggggttggaggaagcggtctctggtgggtaagccgatgccatgccgcggtggtgaaggggggaaggacgcggtctccggtgggtggggaaggggagccgctgtggggaagaggccgacggacgcgacctctgcggggctggggcgggcgtcgatgcgagattgccggggggagggcgagggcggaggtgtgttgatgccggtggggctgggcggaggcgggcatgcgcgagatctgggggcgagggcatccatgcgcgggcatgggagggagcggagcggagccgtggatgtcgcgggtgcgagtggaggcagaaccgtgtgtgcacgcctacactacattcttaattagttgtaaagataaagataagctacctaccctctgctactgcctacttttctgtagccagattcacaatccatccaaagactcctaatcattctgatctaggtttctaaaatatttggtgaatatttggtgtctgatctaagtgacgagaaatacctcctactcattttgaatgttgtagcctcctctttgaccttttttgtggtttgtcataatctggtatttttttgggatgtagtacttgtgatcatttagagatgaagaggtgcgattgatgcttcattatgattagatccatgaaactctacaataacagtttgtgtcgctatttgtttttcttttttcccttttgccttgtcttcattttgatccagttcaaaataaaggcttcattttgatgaaactctaccatctggtattcttgtttgtctggtatgcagtggaagaggcggcttaagtggaagtgccggcagaggtccaagtatgcagggagcctttgcgttcggttgcagtttattgaataattttagttttatatactaacatagtctgtaatggatatgaaattctttctatcggtggtcaaaatattgcatcaagtgttttgtctgtcgttgcttaccataaataaaatgtcgtcatacctctttaggtgactttgactcaacattgttatatttaacatctcattatcaaagtcgtttgaaaaccaatcattgctaccaaatcgtcaccaaacaatgataagctaacctgcatatatactcgtttaaaaaatagatatcaagaattgtcctttgtcgctttgtgatacctataggccatctgatattgcgagttctggcgtgatgaataagacgtttgctcaattccaagtatattttatttataaactcgtcacttagaaaattgatttgcaatttgtagccatgtatatctaaattagagctctgtgatagaatctggttttatatgccattgcaactcacgagcacttggctagttattaataatgatgcagatggatagcaggaccaccattctaggctactgcaaaacatgttccttaaatcatctccaagagctccctagaaaatgactcctgaaaatcagttttaaggacatctaaaaaattagtggggtagattttaatcctttctccaacacatctcttaaagcgatagattgtttttggggagcccaaaaaaaccccatttgtagctacaaatgagggagttttaagggctatgaaaaagatgggagcactttagaggaaccgttggtgacacgtttttgtgtttttcccaaaaaacatgatttaggggagacttctagggagctcttggagatgctcttagacccctcttgccttcaaggccacccaagcactaaactcagtatgtcatcatagatatggcatgacaacacacaaaacaattcaaagcctctttcgttttagcacaccaatcaaatttggatgctgcactttcccttctatcactggattgaaaaaagataacattgagttaattttgtagttattctttctggagatgattggtctttctaatggaatttgttagttctgacttcggttgtgattaatcacaactaagattattgctttgtggagttaagaatactagagtactgctttgcaactgtcttttttcgtagttggaattcttaatttactatcttttgtcatggattgttttgcttttaaacataaagattgttttaaccatattttatatcttatcatctttatgaggacacaattgtttcatcaactaaagaaaggatattagtatagagctttcttttccaaaaggtaccacttagtctacattatcatgatctactcttttataattccatgtaaacctgcactctaaaaaaacatgacctaaaagaatactgcaatctttagtgtttctcatattttggagatagtatgcagattccagtgactccgagatggtgctgaacatggtgtgggagatggtgaggaactgcaagttggacagcgcggtaaggcaggtcaggatg

SEQ ID NO: 322 - DNA, 2788 bp, Zea mays
ttatccataaccaagaatcatttaaaatagcactacatatattttaacataacatgcctaaactagtattgtttatagtctggcataaagcaaaatgtacttacaattggaatgaaaatttttctatatttaattcttctgttaaaaatataattggtataactgtaatagaataataacaaagtatcttaaaacatggatcgaaataaaaccagaattgcataaatatagctctcaactctggaaaattacagatctaaaaaatatacatgttgaactttaaacatttctaaagttacctcattcttcatatctacaaactctagtgcctgcattcgaacatccaatatcttaggccccaaacacatggtataggttgtcttgcacttgggttgatgatgaagcatgtgaaacaacatgttgggtaactcacgcctatagtaaattgatgatccgaaaaaatctacatgttatgcttcaagcgcttctagagtcccctcgtcctttatatgaccaaatctagtactagcattcgacaatctagggtcgcatactcatgttatggttgtcttgaacaagggttaatgatggtgcatgcgaaacaataagttgggtccatccgtaaaaactgtctgtctaaacaatacaatatttcgggcttcaaaatgcatcgaagttgacgcacatcagaaatcgatatatcatgcagcaaacttgtacgaatataatacccattagtcccatacatatattttgatcggtcttaaacttggattgctatgttcacaactgtggaacattgcaaatagcactatatatgtgtttatggtaacatgccgaaacaagtatgtcttagagtaccacatttagaaaagagtaatgaaagtggaaatataaattttcttccattaactatttttccattaatagaggttgtatctgtgcaaaatagattatcttgaaaaatctgcatattgcaattcaaatacttttaaatttacctcattctttaaaatactgaactttaatcggcatgcgaccatctaattaggtgggtcccatactaaagttttgattgtgttgaattttagttgctggtggagcgtgtgaaacaataagttgaatcattctataaatctaccacataatttagggcttcgaaaagcttcaaagttttcgcatggttcatgccacaatcttttcaagaaaacatacacgaaatcatgaccctttactcccaaatcagtgtattgcgaaaactttgatgacaaaccttgttgggtcgttttataaaaactaccattctaaacattacattatttagggccttgaaccgcttcaaacttacattaatgtccataaccatgaatcatttaaaatctttccacatatcttatgtgataacatggccaaacaagtgatgtttacagtttggcaaagagctaattgtaatgtaattttccttggttaaattattttgtaataaatatcatgagtcccatacttgttttttgagtggcctcaaaacatgcactgttgtccataaccgagaaatatataaaatagcactacatatggtttaagatagcatgcctaaactagtattgtttatagtctcgcatagagcaaattgtaattagaattggaatgaatttttttctatatttagttgttttgttataaattgatataaatgtaatagaataatcaaaattaccgatcaaaatatagctctcaattcctgaaaattaccgatctaaaaaatatacatgttgcactttaaacatttctaaagttacctcatccttcatacctacaactctagcgccatgattcgaacatccaatatcttgggcccctaactcatgctataggttgtcttgcacttgggttgatgatgaagcatgtgaaacaacatgttggatagcaaacgcctcatccttcatatgaccaaatcttaaaaaatacatggtgtgcttcaagtgcttctagagtcacctcatccttcatatgaccaaatcttgtgctagcatgcgacaatctaggttcacatactcatgttatggttgtcttgaacatgggttaatgtgggtcccatactcaagttattgattgtgttgaattttagttgatggtggagcatatgaaacaacatgttggatcattctctaaatctaccacataatttagggcttcgaaaagcttcaaagttttcgcatggttcatgccacaatctttttgagaaaacatgcacgaaatcatgaccttttgctcccaaatcagtgcattgcggaaaatttgatgacaaatcttgttgggacatttttgtaaaaactaccgttctaaacattacatcatttagggctttgaaccgcttcaaacttacattaatgtccagaaccatgaaacaattgaaatctttccacatagtttatgagataacatgcccaaacaagtgatatgtattatttggcaaagaaaaattgtaatgtaattttccttgcttaaattgttttgtgataaatatcatgagtcccatacttgttttttgagtggtctcaaaacttgcattgttgtccataaccaagaatcatttaaaatagcactacatctggtttaatatagcatgcctaaactagtattgtttatagtctggcacaaagcaaactgtaattaaaattggatgaaaaattttctatatttaattcttttgttataaatatcattgatataacagtaatagaataataacaaagtatcttaaaacatggatcgaaataaaagcaga

SEQ ID NO: 323 - DNA, 2787 bp, Zea mays
cggggcttgcctggaataaacaataggttagtgtttgttagatggcgatctcttgatgaccatccttttgtcttggcatttgttcaggcaggttcgtccatcagcatcaccatgcggagtagctcgcgcttgaggtcgacttggctcacgttctccgcatcacgcgattaattaacatacctgagtagaatgcattatgcacatgattgcatatcgacaagaatattacacacctaaatagtgctacgcgatagcgaattaaacacctagtgacgaggcgttgtacaagttcatacggacacactagttatcgacgtacgactaagcgcaataattacgcttctcgaaattaaacggacctaacgcaaacatcacgagcaacaaattatacacatgaaacacaattagcctaaacacaacttatcagataattaattaaattctaaacttatccctcgttttatcaattatactacatcgctcacaaagaactattttaattttattttactcctcacatattttacatatcaacaattaatcaaacatttcttatcgtaaatatatacacatctttataagtgatttaaatatttcatcatcgcacaggcctactaatattctactcggtacactaattaagctaattgaccgaaatagcgaaataactcgctataactgaacctggctcgataatcgcaagaactgcgaagtcgacgagagtttcatgacttacgcaatttatcgagcaccttaatgagcatcgcactagcacattaatttattcattgatcgaactattctgaataatttatcagcttaccgttttcacagctgacacgaatccgcgagatcggtagcgattttccgatccaggcaatttgtcgagcgcttggggaatatcgtgctgctagcttcgtcttcatgcgatccttgcgattccttgatgacgcacagaatgacgacgatcttcgattgaagtcttcgaccgagtacttgataagcgatgcacagggacctcgcttatttttgtctaaagtccgggattcgtggttcgatgagatcgagcagagaagaacgaggttcgccgggctcgacgacgatatgggagagtgacatatatgtgacgcaagtgacggagacagccgcgtatggcagcaacgcgtcgacagtctatagatttgggtgttttattgaataggcgggatgagaggagccgaacaatcacttgaacatggtcgacggcgaggcctgccgtgagaatatcggcacacgatgcggcatgacgaactagcaagctgagctatggcgagcgatgtcgacaacaaggccggggcgacatagactcggggctgctgcacgcacagcgcgacgacgaacgacgatacttggcaagatcgacgacgcaatgggaattcgggccaagcgagccgagatgacacgctagtgagcagaaaataggacacgagctgcattgaatccaaacactgcgagataggcaggaccgagcccgcagactccacggcgcggccaacagaagagcatcgagcgccatgggaagacgtcgagcatagcacgcgcgcagacagagtgcagaggagcacggcgcgagcagggggaggagcaagaaggagcttgagctgggagcttcgtcgggcgcagacaccagggcgcggtagagactcgagagaaaggggcgcgacatggaggagcttgggcgcagtccaagcgccggtcagcaggacgccgcgagggagcagggagaccgcggagctcgcgcgcaggggcgagcgccatggctgagagatgagctcggctgggagccgctgcagaggaggatggagaggagatggagacgtcgtggaagatgagtgccggccaccaggaaggagctcagcgcggctggatttttatgcttgagttgagcgtcggctgagcggcaaggtggcggtaaggatagggatcctgcggatttttttgttttgtttattttttctctctttttttaatagagaatcacagatattttgagtcaagatatttagattggagcgagacgtaattggaacaaatcagaacagtatttcggactgtgttccatttgatttgaagtcaataatttcatccgcgactaaacaagtggctccatagccacggataatttaccggtgaattggagcgcaattaaaatttctcggatgagctgtctcagttgacgagtggaaaccgaattatttaataattgtttatatccgatgatttggatccggcgagaaacagcagaccgaaataacagatttcggtactaacactttgttctgcgtaatttgaatgaagttagccgaaaccatatccgctaaagtacacatgatttcgtcgccaaaatagtgtatggaagaatgaacggaattataacctcgcgcaagatttctctcaagtagcatgtgatccaatttatcttgcaccgagtattttagtcgtcgagtttaaactaatttgcccgggataaaatcgtccgagtgggtcgagcttccgaatttcatatttgcacgagcgatgaattttaaataatcaccggacgcaccaattttcggacaactatgttccgaacatcacgaaaattttggaagagcccagatagatcaaaataaaaacgatgtcgcacttgcgacaaatgaaatagatgcgatattaaaccgcgatagatgaaaataattagaccttagtgtccgtcttatttaatgatatcacgtgcttaaatatgtactcattgtcgagcggaatata

SEQ ID NO: 324 - DNA, 2786 bp, Zea mays
ggatctttgaggattgcagccagtgccaagagattacatttgtttgtgacggtagttggatggattgtagcacagttgtcatggaagctgtaagtaagcaaactggagtcactttaaactagtacacgaaacacgacacggctgaatttaactagcgcattaatctcatcagagcacgacacagctgcagcgtaaggggctcagggccatgcttggttcagagttgcaacatacaaggtaatagtttccaagtacatgcaccaggttaactgcacttccagtaactcaaaaacagataaactacgtactactctagctaggatcttcattcattaagcatggaacaatggcgttgaagtcagcggcttcgcttgcccttcgtcttgcttgctttccaaagcgccaaagcatgccgaactgcttccaccgtctttgctttccgatccaagtggtagttccacagctcagggaaaggatccctcctgccgccattgccgtccttcagctccgtcagcgcctttgttactgcagcatagggttcctcaccgagctcctttacttcttggagcttcttgtcaccctcattgagtgcttcctacacaggcacgtgcagcacaatgctccattataaacaattcgtaccaatagatacctgttcaacaaaaggcaaagattccatcttaccgacacttttccatcaacaataataaccttgaaaggatgccattcaggattttcaatgtcattctgccactttgaacaaagtctagcactttcaacttctgcatccactgctggaaacttccgcttgcacaggtttagaaacacactgaggtcaagttcaccaactttcttgacgcctatctgtgtagggcagtctgaggatccagacaaactctgcagagcctgcacattgatgaccaaacatcagttctcataaacaaaaaacgctaactgaaactgagtggtacactggcatggcataaaaaatttatcatacatttatcatcaattctcgagcttctcgcagctcatcactgatcttgctttccctactgattatatcttggttgtagttttccgcatcgttcagttcttcgatcttctctttgagctcctcctttagtttagccattttctctctcgatatcgggtcttcatcacctggcttgagctccatcaggtgcagtttcccgctcaagtgctttatttccagttcaagtttctgcctcatctccaactgagtgttcaacctcaaaaaatcgtctagaatagtttttgtttctctctacagtttccacagtaaaaccaaacaagacaaatgtcattcaaaagaaaaccgcatgcaagcacatcaagggaacagggctaaccgtttgtttatccacaagcttttgaacattttcaccagctttctcttgctccaatgcagccaacctaagatgactggtcctcattgcattctgtacagcagaagtcaaaagtatgttatacaagctgtacaatctctgcatatgagtggcataatttccattcagctttcttctgctattattttgactgacaagaacaataaaatgattgtttaatccattctatataataacacaaacaatagggggttatttcgataaggatacaaagtcttgaaatttaaaagaggtttgaacaaaaaaaagttttagacggatagacctcttgcaaaatcaccctaataaaattgttcaaccatctgacacgtgacaactaattgtagaatggcctatgtttccataccataaaatcaaaagtaacaaaaagattttgatttcaaagaaaataacaataaaaaatattttatcattctcaacatctgtaaaagacatacatgacgagaagattctaattcatgtaaggagcagaaaactacagtatatatactaatccccaagctattacgtaattcttgttgataaaacattttgcctcagatgaaagaagttgcccacctttagcttctcctgctcaagattccgtttgtcatgttctgactcctcgatttgtttgtttcttgcatcaagctcatccaccatgtcctggatattggactgtagcttccagttctcctcaacaactctttgtgtgttttgttgaccaagctttctcatcttcaggatttctagtaaaagtggggaaaaaactgttaggatagtcatgaaaaccacaacatgaataaaaatggatagtaaccactgcatgtatttagtcactcctaaatgtatcatgaataaataaccagagtattgctatgtaccttgattgtatgactggagtcgttgctccctcttctgcatcattatgttaagtgaagcagaacgcttgttgtactcagactcaagtttctctaaataaatttccttttctttaactttgcaggccaaattggacagaagtctttcggttttatttgccccttcactcccaatatcttttaatgttttcaggtcaccattttttctcagtagttcacctattgcccctagagaattgtagtcatcagcccttgccatccacccaacagtctctgtacctccacacttcatctccttccagcaatttttactgtaccctttcatcgcaaagtgaccatcaaaggcccgtgcgttcctaaaacctctccagtcattcccgaactcaatgacagcatcacgcgtgggacgacctttgctatatacaggatgcactttcactggacgaaaagatgagtaatgctccttcagtcggttcgcacttttaccgaagaattc

SEQ ID NO: 325 - DNA, 2781 bp, Zea mays
gtctcttgcttgattacaagttgcttgagaatctctaccctttaaatccaccagttacaactaagctaagtccaccctacaaaacatcccacccactcatctctaagctaactccacccagcctattacctccggacaaatcccaatatcaaaaaccaacatcccagatctactctctctctctcgtactgaaacacatctaatggtcaaacttatttggattcttcatctcacgcacgaacacacgcatccgccgcctcgctgctttctttctctgcccatggaaccgccccacacacatagacgctgagcccgccgcctcactcacgtccgctggcctccgccgccgtggacgccgacaccaccatccacttctgggcacacccctccctcctccagcgccacttgaacctgctgcgcgacgtcctcggttgctggaagtggtgctgctgagccgacgtggcagtgggctgtgcaggcggacctgctgtagcgccacttcaacctcctccgcgacgtcctaggttcgtcgccgccgacgccatcagagaggaggccaacgagctggtgcgcatcggcagcgtaaagcgcgcgctgcgctccaagtccggccgcgcgcccgcacagttctcgcgctcgcacttgacgggccactcgctcgcagcgtccgccaccaccggtaccggcggcggcgccagcacggagaggttcacgctgcgtctgcccgaacacatgcaccttcagtcttggcttagatttggtacctccatgatttcaaatttggatagtgcaattttgttctcagcatagtgcaatctactgggaatttgcaacaccagttaataatggcatgattattacttatggcaacactgcccttagcttttcaggttagtaaaatttcttgattcagtagcacatgttgatagtacaacaacatgattcagaatttattactgttgccactggccaccggtgattttctgttttacagttcagtagttatatgtattcaggttagtaaaattatatgtattcagacagttcaatttctaacgagttacctgttgtaaggtttcaaatatttgtgatcgccaaacataatgggacggagtgcgcttacaaatatatctaatgagaataacaaaggttcatactgatatgtttccatgtcttcgtttaatactgataatatcgagctatttaaatatcttaatatatctgcccccacaaacagtgcgatccgatgacgaagaacgtaagagggaggagaggaacagaaaacaaagagaatactatgcacggagaaaggctgatgtaaccacagaagaaagagaggcaagaaataaaaggatgcgtgattaccgcgaggaagaaggctgagacgggtatcccctatgatcttatactacattctattgttttttaaaaaataattcatctgtctattgtagtgctatgctcgcccggacagtcccaacgttatggttttggatctttgatcctaatgcaagctcccggaggggacaacacacatgtggcacaggctgagacgccatgttcaacaatttctcaggcatccggattgcaatatatggactcaattggtccaagtgatcccatggagcggctacataccaatgattattacgtccgacagactgcgcttactaatatatctaaccaaattatcacaggttcatgcataatcaaaccaagcaacacagtcttttcattttattatttattactgatgtcgaacatttttgaaatacatatatggccccataactaggtccgtccaatgaacatgagcgtcatcgggaggagaggaatagaaaacaacgagaatactgtgcaagaagaaaggctgaagaaaccaacgaacaaagggaggcaagaaataaaagaatgcgtgattaccgagcgaggaaaaaggctgacacaggtactaaaaataggtcgatttttagttactaatactcattcttcctgttgtagtactatactcactcagacagacataggcttatgctactgaatcttcgatcgtaatagaaaccacaaccactagagacgataacacacagatggcagagccggtaatgcctgatggtgcgaggggctctttgcaccaactgccaacatcagtggaaccatgttcaaccatttctcaaccttcaacctataatcaatacgataggaattcgttgttataattactacttacataatttactatttgatttccgtttgtcttcagcaactactgcatctaccatgggcaacctcataatgaaccgagcgaggtacatcaatatggatgatgtggatagagaaattctactacataagcgacgtgaatacaaaaagttgagacaatgtggacaagatgacacgataactggtgagcacaagtgaatcattaaaaaaaaatcaatgtgtcttctcttaaggcttaccatggctttctacgctgccagacactctatcaggtgctccattatcaattcagacacaacatattgtccatgacacacctacccatgagcctgaattgacagagtttgatactgtattaattgagcctacacaaccaagcctggaaggacatagtacctaactgtctaatacttcttttcctactaaatatgtgtgagtagaaaataattatagatccttgagaaatggttgtttgggtcattttctttatgggggtttgcatcattcaaactggacggttacatatgggtatatacttttatgctatatactggtata

SEQ ID NO: 326 - DNA, 2778 bp, Zea mays
ggtcttgtcacgcagtacagacccaattgcttttgctgccaatggagaccccacacatctctcaacgattcgatcaaccaactcaactaaatcatctggcttgctcctctgcaatccgaatgctcttgtttctataatttcttgtatgtattccttgcccaagattgccacttcatggtaatgatttgtccatgagctgtcaactacagcacccataaactcggctacttgtttttcacgtgttgtcactaatacggcgccatagacatcttgtgtaagaaacgccttgatctttctccacttgtcaaagttaatatccttttcccagacgtcatccaatacaagaaggtacctgataatgttttttcattagtacatttctatctggatggccctaaagcaagcatatagcctatacattacaaattgctccctccaatccaatttaagtcacactagctttgtattaagtcgatcatatttctctagcttcaatgacttttatgaaaatatatattaacatatacaaaatacctaacagatttactcaactgacatattgcaaggtgtgtggcactcaactcaaagagagctagtggtcatttgcatatataatagtgtttgttgcctggttaccagaaatgtttgactgcatcagcttttgtgtttatgctatatatgtagtctatagcagaatataatacgatctttttctgtgggcagatcatggcatggtctgagaggagatgaaagtagttatgcagactacagaccacttcagcagaattaagttagagctaatgttatgtttggaagggagttgacctgtatacttctctgtcaacataattcaagcttccattttggaaccatgttgtacttttacgtgattccgtacttgtagaacacagtaggaaatatatcttacatgtgaatgccaaaagcatgagtgcggtaattaaagccacatttagttatgttctaatttaattttagagctcgcacataaacttgtagtaaatatcagcaaagaagtccattaggtacacacaatatgacacgatgtaatgagtgtttagtaaataatgaaataaaaacatcatacaaggcaaagaaagtaaagttactaataactaataagctccagccaatacctctttccgttaagatgttcttgaagcttcttcactgcttcctcgaggtctctctctgaggcattacatatcttgttggcaagattaaggacactaaaatcatctgacacacatacccattttcgtagatggaagtactccttgacctgagggtcgttgtggatgagctgagcgagggtggtcttgcctagtcctcccattccaacaatgggaacgaccataagatcaccaccgacaacacgaccattggcattgaccaatatgttaaccattttgttcctctcatcatgtctagacctggcaacaatatcttcatgatcatcaatgaggaaatccatctcacgcaactccaacgatgccgcagtcgccttgggctcaagcttgttgaattcaaaggttttcatttcttccataaggtccttgaaggtgtcaacaatcctgcgaagcctatagcccatcctactacggaatgcaacacgattgtgcgtaagagttttaccctgtccataacgccaagctcggtgatgtgcccattctccttggcccggcggcggagcacctcgtactcgaagtcatcaaagacctcgtgtgccttgtacgctgccgtcttgacctgctcgagccattcctgcacaccgcggcgaggcccctgcttctcagcatcaacgatgaccgcttcgatggcttccaacctgagcttgagggtgtcatagttcttctccatgccctccatcaccttgtactggtcggtgagaaggctgacaaccttcttcttcaacagggaaaccactggggcgaccaccaggctggtcgctagttcagccattggagcaaggactcagcagagctttggagcgttgggtggagtggggctggagtggagaagatagaagagaatgtaaatcgctttggaggaaagcacagcagggcatctttggtttgctttactcaaagaaaagaaaaggcagtgcatctgtttcttaatatcttatcgctggtggaataaatgtactctctgctatagtggcaaaagaataaactgcagttgcagcacaacgaaggcatctaaaagattgaagtatctatatattctttccttcatgaacagaactgtatatgtatagtgctacacagcacagtgaacatgctgcaagtactgtgtgcacactgtgtcaaccacacaagagagagagaaacaaaaacctgactaagcaactaatgcgacgcagtccatgtcaagcaaagtcatacatccaaagttaacgtacttatctgtcttcatttattctctgtcggccattgtgaaggtggttgacaggttgtgtggtcttatatctgtctccacttattatgtctccgtcaggacagcccacctcttcacctgccagccagatgataaactcgatgatgaggaaatgagttgggattgtagaaaaagtaggacctaggtagcacatgaacacaaatttaaggatgtatttgtcattttaaatcttaatactttctttgtttcagaaagaatataattctgggttttacacgggctggactttttaagttatagttaaacttatacaaaatggtatcaatatttatatctctaaataaatgtatgcatatatat

SEQ ID NO: 327 - DNA, 2770 bp, Zea mays
cattgatataactgtaatagaataataacaagggatcttaaaatatggattgaaataaaagcagaattgcataaatatagctctcaactccgaaaatttaccgatctaaaaattatatatgttgcactttaaacatttctaaagttacctcattcttcatatctacaaactatagtgccagcattccatcatccaatatcttgggccccaaactcatgctataggttgtgttgcagttgggttgatgatgaagcatgtgaaacaacatgttgcatagctcacgcctatagtaaattgatgatctgaaaaaatctacatgttgtgcttcaagcgcttttagagtcacctcatccttcatatgaccaaatctagtgctagcatgtgacaatctagggtcgcatactcatgatatggttttcttgaacatgggtcaatgatggtgcatgcgaaacaacacattgggtccatccataaaaaatgtctgtctaaacaatacaacatttagggcttcaaaaagcattgaagttggcgcacattagaaatcgatatatcatgcagtaaacttgtacgaatataatatccattagtcccgtactcatgttttgatcggccttaaacatgggttgatgtgttcacaactaagaaacattgcaaatagcacaatatatgttttaaggtaacatgcctaaacaagtatgtcttttagaaaagacaaatgaaagtggaaatataaattttcttctattaactaattttccattaatagaggtcgtaactctgcaaaatagtttatcttgaaaaatatgcatattgaaattcaaatacttctaaagttacctcattctttaaaacactgaactttaatcagcatgcgaccatctaatttgtgggtcccatactcaagttattgattgtgttgaattttagttgatggtggagtgtgtgaaacatgttggatcattttgtaaatcgaccccataatttagggctttgaaaagcttcaaagttttcgcatggttcatgccacaatcttttcttgaaaacatgcaaaaaatcacgacgctttactcacaaatcagtgtattgcgaaaacattcataacaaaccatgttgggtccttttgtaaaaacaacagttctaaacattacatcatttagggctttgaaccgcttcaaacttacattaatgtccataaccatgaaacatttaaaagttttccacataccttatgagataacatgcccaaacaagtgatgtttacattttggcaataagcaaattgtaatgtaattttccttggttaaattgttttgtgaaaaatatcatgagtcacataattttttttagtggcctcaacacatgcattgttgtccataaccaagaatcatctaaaatagcagtacatatagtttaagatagcatgcctaaaatattattgtttatagtctagcatagagcaaattgtaattaaaattggaatgagaatttttctatatttaattcttttgttatagatatcattgatataactttaatagaataatatcaaagaatcttaaaacatggatcgaaataaaagcataattgcataaatatagctctcaactccggaaaattaccgatctaaaaaatatacatgttgcactttaaacatttctaaagttacctcattcttcatatctacaaactatagtggcagcattcaaacatacaatatcatgggccccaaactcaagctataggttgtcttgcacttaggttgatgatgaagcaagtgaaacaacatgttgcatagctcacgcctatagtaaattgatgatctgaaaaaaatctacatgttgttcttcaagcgctcttagagtcacctcatcctttatatgaccaaatctactgctagaatgcgacaatctagggtcgcatgctcatgttatggttgtctcgaacatgagttaacgatggtccatgcgaaacaacatgttgggccatctataaaaactgtctgtctaaacaatacaacatttagggcttcaaaatgctttgaagttgacgcacatcaaaaatcgatatatcatgtagcaaacttgtgctaatataatacccattagtccattactcatgttttgatctgccttaaacttgggttgatgtgttcacaactgaggaacattgcaaatagcactatatatgtttttaaggtaacatgcctaaacatgtatgtcttacaagacgacatttaggaaagtgtaatgaaagtggaaatataaattttctttcattaactatttttccattaatagaggttgtaactctgcaaaatagtttatcttgaaaaatttgcatattgcaattcaaatacttttaattctttaaaacactgaactttaatcggtatgcgacccgctaattatgtgggtcctatactcaagttattgattgtgttgaattttagttgttggtggagcatgtcaaacaacatgttggatcattctgtaaatctaccaaataatttagggcttcgaaaagcttcagagttttcaaatggttcatgccacaatcttttcgaaaaaacatgcacgaaatcatgacactttactcccaaatcagtgtattgcgaaaacatggatgacaaatcttgttgggtcatttttgtaaaaactaccgttctaaacattacgtcatttagggctttgaaccgcttcaaacttacattaatgttcataaccatgaaacatttgatatctttccacatgttgggggccttcgtcctccg

SEQ ID NO: 328 - DNA, 2665 bp, Zea mays
attagtttcaaggtttttatgcttaataaatgagaacaatttttgcagtgcatccacaacaatggcatactatctttgacatttgtcgccactacttgtagtctaacaatttcatcatccttcatttgggcgtccacttgcagctcatcaacattatgcaaaaggttttgagctacttcagtagcccgctttacctgtaagttcttcctcttaattgtcccaccgtaacattctatcattgtcttaagttgtttccacacaaaattctttttcgtttgttatgctgaaatttcattgtgcttatgtaatcttaggatcttgtaagctttatttagtttcttaatctcttctataatatcttctccatttttttggggatccaaattgtcaattctaatctatgaaataaagtttagtcccgacaattcggatcgccaaaaaagtgaggaagatattaggtaacagataaggaaactaaagaacgcttccaagatcatgagatcatataaggacaatgaaaatttagcataactagcggaaaagaattttgtgtggaaccagcttaagacagtggaagaagattacattgggaccattaagaggaagaacatataggtaaagcaggctattaaagctgctaaaaagcttttgcataatgtttatgagctgccattgggtgcccaaaagaaggatgatcaaatttttagactacaaatagtggcgacaaattccaatgagaggatgtcatttcttgaagatgagctgcaaaaattgtcgtctttggtcaaggataaagatcttgaaacttataaaaataaaatcaactagagactaaaatgcaagatatagttgtagtccagattaacaatccaaatgaggcctaactatatgaacaggtggttagcaggttactgggttctttttgggtgagaaacttctgatgttggtggatttttctatgtgggtaaacgtaaatcatgtcacatctactcttctagagactaaacacaagagttaggtgcagtttagtttaactaatccaattgaggttagcaggttactggggtgttattggttgagaaacttctgaggctggtcgattttttatgtgtgtaaaacctcaatcatagcacatccactcgtaagaagactcggttgtattcctattaatagaaatgggtgtttcctctcaaaaaatgtggactaacttgatatttatagacaagtttagtggtcttgtgggcaatttactctagcaggccccaaaagtcaaacaacaagttacttctccacaagaaagtggcaatcaataacatgcatgtttatcaaactgaccactgagacccgtttgcagcaagagcgcacgacagttcttgacccacgagacccaatttgcacgatacaccataagggtgaaaattaagtcagatgtatgatcgcatgtaaatgcgagattaatttccaggcctgctcggacggtgtaaacaagcgacactatattttttacacctgctaaccacatgtcataaagttgatatagttagacctcatttggataagctaaactcgactacagctaactcttgtgttttagtgtcttgttgatcttcatttttattagtttcaagatctttatgcttaacaaaagagaacaatttttgcagcgtatccacaacaaatggcatactatctttggcatttctcgccactacttgtagtctaacaatttcatcatcctttatttgggctcccacttgcagctcatcagcattatgcaaaagcttttgagctgcttcagtaccccgttttacctgtaagttcttcctcttaatggtcccaccgtaacattcttccattgtcttaagttgtttccacacataatttttttcatttgttatgctgaaatttcattatgcttctctaatcttaggatctagtaagctttctttagtttcttaatctcttccctaatatcttttctaattttctagggatccaaattgtcaaaactaatatatgaaataaagtttagtcccaacaattcggatcaccaaaaaagtgaggaagatattaggtcagagataagaaaactaaagaaagcttccaagatcatgagatcagaggacagtgaaaattcagcataacatgcaaaaaagaattttgtgtggaaccagcttaagacaatggaagaagattacactgggaccattaagaggaagaaaatagaggtaaagcatgctactgaagccgctaaattttttttgcataatgttgatgagttgcaattgggtgcccaaaagaaggatgatgaaattgttagactacaaatagtggcggcaaatgccaaagagaggatgtcgtttcttgaggatgagctgccaaaattgtcatctttggttaaggataaagatcatgaaactttataaaaattaaatcaaccagagactaaaatgcaagatttaattgcagtacagattaactaatccaaatgagtcctaactatatgaataggtggttagcaggttactaggttcttattgggtgagaaacttcttatgccggtggattttgctatgcgggtaaaacctgaatcatgtcacatccactcttctagagactaaatacttgagttaggtgcagtttagtttaactacggcctatatat

SEQ ID NO: 329 - DNA, 2767 bp, Zea mays
agcatcatcacaccactctctataagaaaatcgtcgatcatatcctactccaacattatcgatcacaaacatacatgatactaactactagcgcaagacatcgacttcatcttacgcgcactgaacacaattaccatcgacagatttatcgtcaatcgtataaaatactaaatttaacctacgcgtcaccgaaatactacactctgcaaaatagaactagttcgaatatactcggcaactaaactcctcgaagcacacctcgcatcgctggcatctttaacttaaactttatacgcaaactaagcgtcttatttcacgatcataaaatcaatagtaaaaatagtaaatcggctcaccgttccaatagctgactcgaatccgcaagatcggtaatgattctttgatttagccaatttgtcgagcgcttggcagatactatccgaacttcacgcactgcacatccaacctttggacatcttctcttggggcttcttttgtcagcacaactccaactcggaggcatcacgtagggaccgacatcgagatgggtgactgaacgacgacggcaagacaaaggttggagacgaccggatatcaacgacaagcactagagttttatgatgggctgttgtaatgggacgtcgatacacgatccatggcaattaggagatcgacgtaggcggaaccgatagccaaacaggaacagcgcagatcgatgacgcgagactcgatatagcgagcacgacacaagggatcgcagcagctgcttcgacatgaattacttgctggcgagcacgacggaggccggggagcaggaacgctgtgtagcaaaacccacgattgcgcgcagggtgaactcggctgggcgcggcgattggagcaggcagccactggggcagcgcccaggtacgcacgacgacaatccgagcagggccagtgcgcagcgaccatggaaaagatccgagctggagctcacggcaacacggagcagggcgagccagagtctagaagacgccatggcgagcagcagggagcatcgacggagagaggcgcgacaggaaggtggagcagggagacggacgcgcaggggaggcgcgcgccatgggagatggctgtgcgagcgcgtcagggagaaacaccggatgcgcgcagggcgaactcggcacgacagccatggacgagatgggcgagcggaggaacgacgcgatggaggagcgaggcttgcgatgcagagtagggctgaccggctgacatgggagatcgacttggcaagcaccagcggctggagaaagtcgaggggaggtcgaggagctgagcggctgtgcagtggagcaagcagccatggaagagcagagagtcgattgggagggaggagatgggacggcgctgggatgttcgggaccagggcgcggttgcaggaggaagatgtgagaacgagcgcccgctaccgtgtggagaggagagataatgctgaggaaaaaaatctgcagaagaagataaggctgggagagaatgcgcacgtagatgaagatattctaccggttacccacttaagcggcgacacaaggaaaaaaatgcatcgaatacgattgctggcaaagaaaatatcgatgacggccaatgatattctaggaagtttacgtacatgagaagaaaacaacgatagagagatattttctatagtgaaaaatccaaatacgttgaaaatcgtaccaaggaatggtggaaatatttagagaaggtatttccctatttttccttctttttttaaaacaacaaaaatacgcatattttagggtatgaaattagagtctaaaaatatacaaaagattcaaacaataatgagacctacaacaatatttagataggatttgatttggtgaatactctcggagttagatgaattttcacccgttatttatatccgaagttttggatctcgctgagaaacacaaggaccaaaacactatccggatacggtacttgagactctattaatttagttgaactcagataaaaatttatctgttttccgaatggatttgatttctctacctagaatagcacactaatgaataatcctaattgttaatcttatgcacggtttcttggtaacgcaagcgatttggagtattctttcagacccagtattatctgctataaaatcaaacgttaatctctttgtctcagataatatcgggttcggataggatgcaaatataatgaacccaaacgagattgagactcatattttaaacgatatttgatacgacttgaaattagataacttcgtctgccactcgaacacctgatcactctgccatagatgatttattggagaatcaaatctcaattataattccttggttagcaatttcgcgcatgatttttctcatacaatgcgcgattcagattattttgccccaaacattttagtcgtcgagttcgaattaatttgttcgggataaaatcatcctagtgggtcgagattccaattcgtattcacatgagcgatgagttttaaatgatcaccggacgcaccgattttcggaacaactatgttccgaacatcacgaaaatttaggaagagcccggatagataaaaacgatgtcaaactcgcgacagacaaaaaagatgcgatattaaaattgcgataggcgaagatgattaaaatttagcatccgttttatccactgatattacgtgcttaattccatactcgttgtcgagcggaatataaacaccaggggtgttacagccctcccc

SEQ ID NO: 330 - DNA, 2747 bp, Zea mays
gatgcgtgggactcgactcgcggacgccacgactccagcgcgccgacgcgagttaccgcagcagcctccacggcgtcgatctggaggcttcgatctcggctcgtaaggacggaatcgacacaaccaccactgatgtctccaaggcctgggtcggcgctgcgtggcgagcaacatcaaactcgagcgaagcccagcgcgcatcctgtgccgagagtcggtcacagatctcgcgcaggagctgtgaagcaaatgaccgcctaggcccaactaattgacccagttactacccattacacgggagtttgatttgcgcacacgtcggcccatctcctcctgtgctcactgtgtactgttggtgaagccggcacatgcctggggctgacacatattgtccttatacttcattaaggatgtgtttggtttaagatcaaagtaggataaggcggggacaacaccgtcccctcgattttttgggaccacaccgccaccaaaaattgctccggtgttcactttcccccgcgtgactctcatccaaacaatatagaaaatatggctatctcctttcatccctccttgtacatctaactaaacacaccacaagttgatctttccaccgccaccctaacataaatgttttgtgtagtgtatgttacaattatcttgatttccttgttttgtcgactccttggtgatcgatgtgcctaactggctaaagaatgatatagtttgtaaagatttacaagagcaacacgttaggttgtttccagaaagaatatcatttactatatacactatgcataggctatcaacctcgaagggacgcgcagctcgcatgtaattccggcgattgcacgtctttacaaaataagataattatatcatggtctcaaatttgtcgagcttcttcactctttgcatagatctgaccagcaatgccaaaaatattcctgcacattttcagtttggatcagaccaatcaggaatatatgtacatatagcttgaatatatagattgattctactacatggtatatatgtacatatcaacaagtttcgccagcctttgtgatactcctatatggttaaaagaaataagaggaccaacaagatgcaagaaacactgaaaagatgtgaggtgataatgttgttgagtacaaaattttaaaattcattttatgaaattatgcaagaaaggaaatcctacctgcaccaatgaaagagccgtttgcaattatctggttcccttgactattcagtgtgaccccaacattcaagagagtaccacccaaggctgtatacatggtggccatctgaagaacagtagctttacgtgcagcacgttctgactgcaaatgccattcagttcagattcaggccaaagaaaaaaaatagcgtagtagtttttaggcagaccagatgaggccaaacaaagattactagtttttagtagatttgagggcgatgaaaaaaaatcttgcaatgtatctcccgcagtcttgagaagatgcaagtcaatggcctacctccagtactctgaccctaagtttcagatctcctgtctcaagttgtcctacaaaatcttcaattctctgtattctgtacggcattgatattgtagaatcacgagcctgttgtatgttggacataacagtggtaatgttttagtgctgagcaatataccatacacatgacgaaatgtaaaaaaaaaacaaatgtgaaccagcagatttatatgcttacatcatttgcttgcttccttatttcctggaccaattgaggtccagtttgtcgtctctgtttcaagtctaacagttcctgaagttcaaacgaaattaggctcgcaaacacagacaaacatccaaatgggcttctgtttctaggaagcaaaacggagtaagaactaaattataatgagataataaaagaagcccaggaacatcaaggaatataaaacagatggtttagcatgtgaatcattttttagctgtactgacccttcttagaagatataagataacaagactaaatagaacacatgaatggaaaaggtactgtaagaaaacttgattattatccggaggcttacttgagcatatggtgctgcaactttgacaaacgaaaattctggatctaatatgtatccaattcctgccaaataaaatagtcattaatatacaagtggttaccttattatttcggttgcagttgataatagtagagaataaataaataattggaatataaaattgtgaagaattgggctacagcagactaacaagatgcatgacttatttagatatgcatctgatttcctggaacttagattaacaatagatagtatggtatattcagatacaggcagtaaaacaataaagcgtaaagacaaataaaaaattatcttgaagaagtggtagagcattccacgttattaataagagagcgtcaactacaaaaccagcccagaagtaccgaacaaagacagaagcacatatgccccaaaaaaagcaaaaatagaaaataaaggaaacatggaaagaacatgttactgtttcctcagctattacatgagatttagtagaaagactaatatttgtgttcacatgttgctcagaagattctatgtcataattgttagagtatatttggaagtttacatattgtgtttcgtagactgtcatgtgttagaatatatttggtagttcacatattgtcaggaacatagcctaggcgtctaataccatgagaga

SEQ ID NO: 331 - DNA, 2641 bp, Zea mays
tagtgaggggtttggtacatctagggccacaacttgggcaagggtggagctacattggtcggacgccgtggaggtgcgacggaccgacggcagcggcattggcaacctctattttgccgcagaggagaagaatcggtaaggtcgagggtactctggcgagcaatcccagccacgaagtggggcgatcgagtgcactgagggcagtgcaggctccggtgaggggtttgggacatctagggccacaacttgggcaaggtgtggagatgcatcggccggatgttgtggaggtgcgacggaccgatacgcagtggcaccggcaagctctaattcgccatagaggagaagaaccgagcggctcgggggtactctagcgagcaatcccagccacgaagtggggcgatcgtgcgcaccgaggacagtgcgggctccagtgtggggtttcagaaatctagggccacaacttgggaaaggggtggagctgcatcggccagacgccgtggaggtgcggcggaccgacacgcagtggcaccggcaagctctaattttccacagaggagaagaaccaggcgggtcaggggtactctagcgagcaatcccagccatggagtggggcgatcaagtgcactgaggacaacacgggctccagtgatgggattgggacatctagggccacaacttgagcaaggggtggagctgcatcggctggacgccgtggaggtgcggcggacctacatgcagcggcactggcaagctctaattcgccgcagaggagaagaaccaggtgggttgggggtactctggagagcaatcccagccacggagtagggcgatcgagcgcaccgaggatagcgcgagctccgttgagtggtttgggacatttagggccacaacttgtgcaaggggtggagctgcattggccgaacgccgtggaggtgcggcggaccgacgcgcagcggcaccagcaagctctaattcgccgcagaggagaagaatcgagcgggtcaggggtactctagagagcaatgccagccatggagtggggcgatcgagcgcaccgaggatagcgcaggctctggtgaggggttcgggacatctagggccacaacttgggcaaggggttgagctgcatcggccggacgacattgatatgcggcaaacctaagcgtagcgacaccggcatgctctaattcgccgcagaggagaagaactggcgggtcgggggtactctggcgtgcaatcccatacatggagtggggcgatcgagcgcaccgaggatagcacgggctccgatgaggggtttgggacatctagggccacaacttgggcaaggggtggagctgcatcgtctggacgccgtggaggtgcggtggaccaacgcgcagcggcaccggcaagccctaattcgccacagaggagaagaaccgggcgggtcggggtattctagcgagcaatcccagccacggagtggggcgattgagcgcaccgaggacaacatgggctccggtgatgggtttgggacatctagggccacaacttgggcaaggggtggagctacatcggcgggacgccgtggaggtgcggcaaaccgatgcgcagcggcaccggtaagctctaattcaccgtagaggagaagaaccgggcgggctggcgagcaatcctagccacgaagtggggcgatcgagcgcatcaaggacaacacgggctccggtgaggggtttgggacatctagggccacaacttggataacgggtggagctgcatcggcctcacgccgtggaggtacggcggaccgacgtgcagcggcaccggcaagctctaattcatcgtagaggagaagaaccgggcgggttgagggtactctaccgagcaatcctatccgcggagtggggtgatcgagcgcaccgaggacagtgcgggctccggtgaggggtttgggacatctagggccaccacttgggcaagggttggagctgcatcggccaaacatcatggaggtgcggcagatcgacgcacagcggcactagcaagctctaattcaccgaagaggagaagaaccgagcgggttggtggtactctgttgagcaatcgcagccacggagtggggcgatcgagcgcaccgaggacaacatgggctccggtgaggggtttgagacatctaggcccacaacttgggcaagttgtggagctgcatcggccggacgccgtggaggtgcggtggaccgacgcgcagtggcaccggcaagctctaattcgtcgtagaggataagaaccgcgtgggtcgggagtaatctagcgagcaaacccatccacgaagtggggtggtggagcgcactgaggacagcacgggctcctgtgaggggtttgggacatctagggccacaacttgggcaaggggtggagctgcatcggccacacgctgtggaggtgtggcagaccgacgcgcagcgacaccggcaagctagaattcgccacagaggagaagaactgggcgggtcaggggtactctagtcagcaatcacagccacggagtggggcgatcgagcgcaccgaggacagcgcgagctctggtgaggagtttgggacatctaggtccacaacttgaacaaggggtggagctgcatcggccgtacgccatggaggt

SEQ ID NO: 332 - DNA, 2741 bp, Zea mays
  misc_feature (546)..(548): n is a, c, g, or t
  misc_feature (2269)..(2272): n is a, c, g, or t
ccccgacccgctaggttcgtttccactgcggcgaattagagcttgccagtgccgctgcgcgtcagtctgccgcacctccacgacgtgcggctgatacagctccactccttgcccaagttgtggccctagatgtaacaaacccctcaccggagcccgcgctttcttcggtgcgctcgatcgccccactttaattgtggctcggattgctcaccagagtacccccgacccacaaggttcttgtccactatggcgaattagagcttgtcggtgccactgcgcgtcggttcgccgcacctccatggcgtccaaccgatgcaactccaccccttgcccaagttgtggccctagatatcccaaacccctcaccggagcccacgttgtccacggtgcgctcgatcgccccactccgtggctggggttgctcgccagagtaccccctacccgcctggttcttctcctctacggtaaattagagcttgccggtgccgctgcgcgtcggtccaccgcacctccacggtgtgcggccgatgcagctccaccccttgnnnaagttgtggccctagatgtcccaaacccctcaccggagcccgcgctatcctcggtgcgctcgatcaccccactccgtggctgggattgctcgccagagtagccctgaccctcccggttcttctcctctgcgtcgaattagagcttgccggtgccactgcgcgtcggtctgccgcaccaccacgacgtgcggccgatgcagctccatcccttgcccatgtagtggccctagatatcccagagccctcacctgatcccgcgctatcctcggtgcgctcgatcttcccactcagtggctgggattgctggctagagtacccccgacccgcccggttcttgtccactgcggcgaattagagcttgccggtgccgctgcgcgtcggtccgccacacctccatggtgtccggccgatgcagctccaccccttgcccaagttgtggccctagatgtcccaaacccctcatcggaacccgccctgtccatagtgcgctcgatctccccattccgtggctgggattgctcgtcagagtacccccgatccacccggttcttctctacggtgaattagagcttgccggtgcctctacgcattggtccgccgcaccttcacgacgaatggccgatgcagcttcaccccttgcccaagttgtggccctagatgtcccaaaccccgcactggagcccacgctttccttggtgtgctcgatcgccccactccgtggctaggattgctcgcaattgtacacccaacccgcctggttcttctcctctttggtgaattagagcttgccagtgccgctgcacatcggtccgcagcacctccacgacctccggtcgatgcagctccaccccttgcccaagttgtggccctagatgtcccaaacccgtcacgggagcccgcgatatcctcgatgcgctcgatcaccccactccgtggctagattgctcgccagagtaccctcgacccgcccggttcttctcctctgcggcgaattagagcttgttggtgccgctgcgcatcggtctgccgcacctacacggtgtccgactgatgtagctccaccccttgcccaagttgtggccctagatgtcccaaacccctcaccgaagctcccactgtcctcggtgcgcttgatcgccccactccatggcttggatttatcgccagagcacccccgatccaccccgttcttctcctctgcggcgaatgagagcttaccagtgccgctgcgcatcggtcggacgcacctccacatcgtccggcccatgtagctccaccccttgcccaagttgtggccctagttgtcccaaccccctcaccggagcctgcgttgtcctcggtgcgctccatcgccccactcagtgactgggattgctcgccagagtacccccgacccacatggttcttctcctctgtgacaaattagagcttgctggtgccgctgcgcgtcggtccgccgcacctccacagcgtcggactgatgcagctccaccccttgcccaagttgtggccctagatgtcccaaatccctcaccagagcccgcgctatcctcggtgcgctcgatcgtgccactatgtggatgggattgctcgccagagtacccccgacccgcccggttcttctcctcttaggcgaattatatcttgccggtgccactacgcatcggtccgccgcacctccacggcgtgcggctgatgcagctccaccccttgcccaagtnnnngccctagatgtcccaaacccctcatcggagcccgtgccttcctcggtgcactcgatcgcccactccgtggctgggattgctcgccagagtaccccgacccgccaggttcttctcttctgcggcgaattagagattgccagtgccgctgcacgtcggtgcgccgcacctccacggcgttcggccgatgcagctccaccccttgcccaagttgtggccctagatgtccaaaacccctaaccggagcccgtgctttcctcggcgcactcgatcgcccccactccgtggctaggattgctcgccagagtaccctcgtgtaataccctaattgtaaaacttaagaatggagagttgtctccttaattgttttgcattcaattcatcacaacatgaaaacaccttatgtaggtcaacaaataactaaaaaatatataaaatgtacatcatgttggagtttatgtgatgttgcatg

SEQ ID NO: 333 - DNA, 2738 bp, Zea mays
tgtaacacccctagtgtttatattccactcgacaacgagtatggaattaagcacgtaatatcagtggataaaacagatgctaaattttaatcatctttgcctatcgcgattttaatatcgcatctatttcgtctatcacgagttcgacatcatttttatctatccgggctcttcctaaatttcgtgatgttcggaacatagttattctgaaaatcggtgcgtccggtgattatttaaaacacatcgctcgcgtgaatacgaattgaaaactcgacccactcggatgattttatcccgaacatattaatttgaactcgacgactaaaatgttcggggcaaaataatctgaatcgcgcattgtctgagaaaaatcatgcgcgagattactaactaaggaattataattgagatttgattctccaataaatcatctatggcaaagtgatcaagtgtttgagtggcagatgaagttatctgatttcaagtcgtatcaaatatagtttaaaatatcattctcaatctcgtttgggttcattctatttgcatcctatccgaacccgatattatccgagataaagagattaatgtttgattttacagcagataatactgggtccgaaagaatactccggatagcttgcgttaccaagaaaccgtgcacaagattaacaattgggattattcattagtgtgttgtaggtagagaaatcaaatcgattcggaaaacagataaatttttatctgagttcaactaaattaatagtgtctcaagtaccgtatccggatagtgttttggtccttgtgtttcttggccagatccaaaacttcggatataaataacgggtgaaaattcatctaattccgagagtattcaccaaatcaaatcctatctaaatattgttgttgatatcatttttgtttgatccttttgtatattttttatactctaattttataccctaaaatatgagtattttgttgttttaaaaaaagaaggaaaatagggaaaatccttctctaaatatttccaccgttccttggtatgattttcaacgtatttggatttttcactatagaaaatatctctctatcattgttttcttctcatgtacgtaaacttcctagaatatcattggccgtcatcgatattttctttgccagcaattgtattcgatgcatttttttccttgtctccgtcgccgcttaagtgggtaaccggtaatatatcttttctacgtgcgcatcctctcccagccttatcttcttctgcagatttttttcctcagcattatctctcctctcgacacggcagcaggcgctcgttctcacatcttcctcctaaagccgcgccctggtcccggacatcccagagccgtcccatctcctccctcccagtcgactctctgctcttccacggctgcttgctccactgcgcagccgcttagctcctcgacctcccctcaactttctccagccgtcggtgctcgccaagtcgatctcccatggcagtcagtcaaccctgctctccatcgcaagtcgcactcctccatcgcgtcgttcctccgctcgcccacctcgtccatggctgtcgggccgagtttgccctgcgcgcagccaatgtttctccctgatgcgctcgcacagccatctcccatggcgcgcgcctccactgcgcgtccgtctccctgctccaacttgctgtcgtgcctctctccgtcgaagctccctgctgctcgccctggcgtcttccagtctctggctcgccctgctccctgttgccgcgagctccagcttggatttagcctagctcggatcttttccaaggccgctacgcactggccctgcttggattctcgtcgtgcgcacctgggcgctgccccagtggccgcctgctccaatcgccgcacccagccgagttttcccctacgcgcaaccgtgggtttcgctgcgcagcgttcctgctccccggcctccgtcgtgctcggttgcaagtaattcatgtcaaagcagcagctgcgatcgcttgcgtcgtgctcgcaagatcgagtctcgcgtcgtcgatctgcgcagttcctgttcggctatcggttccacctacgtcgatctcctaattgccatggatcgtgtatcgacgtcccattacaacagcccgtcgtaaaactctagtgcttgacgttgatatcctgtcgtctccaacctttgtcttgccgtcgtcgttcggtcaccccgtctcaatgtcggtccctacgtgatgcctccgagtatgttggaatcatgttgacaaaagaagccccaaaagaagatgtccaaaggttggatggtggggtgcatgaagttcggatagtatctgtcaagcgctcgacaaattgccttaatcggagaatcattaccgatctcgcggatgcgagtcagctattggaacggtgagccgatttactatttttactattgattttatgatcgtgaaataagacgcttagtttgcgtataaagtttaagttaaagatgccaacgatgtgaggtgtgcttcgaggagtttagttgtcgagtatatttgaactagttatattttgcagagtgtagtatttcggtgacgcgtaggttaaattcagtatttatacgattgtcgataaatctgtcgatggtaattgtgttcagtgcgcgtaagatgaagtcgatgtcctgcgctagtagttagtatcatctatgtttgtgatcgataatgttggagtaggata

SEQ ID NO: 334 - DNA, 2736 bp, Zea mays
cggtggtcaagacactcctgagcttcagcttcgggttcaccgtcttccctgagaattcctggtagctcctcgacaatctccgctagtacttcctcctgcgatcctgtatgatgtatggatgcagtatgaggatacatgatgcttcatgcgagagatgtatgatgcatatggatgcatgtgatgtatacttatgtcaaaatcgggttattagatgcgagcttctacaagatagtctatatcgtccaagaacatgtagtctgtcttttcttggtcggtcccgactagtgtttaaggattctacacaactttatgttggttacgttataaagcgtctcgaattaccttacacctataggttaagacaaactaagttatattcttcattgagcctcctttatttttttgaggttagttatttcctagtaaaagggatttgttcaactctaatcatcttcctagaagtaaccccgtaatttattttgaagtaacttattcttgaactagaatctctcctaattacatagacttttggtataccacttagttggacttatattgagactaccatttgattactttgaaatttactacaaaaactctatcagataatagttcactagtgttctttgccatagaaatttcaaaggttttggaggcatatttttgattgcataaaaataacaagaaatggtgtagaaaacaaattaatctacttttaaacactaaaccagtcaaataataaaaatcatatttttcctatactctacttggcctaacaacatgccataaaaatttacacatacaattcctatataaatctttttctatagttttctaaagaaatcagccttttctgtttttaatttattatccaaaattccgctacatgactgctggttcaaattaattccagaggtgattattaacacatgatttagccacaaaaattttcacaaccaaatttgcagttttactatttatttttatttttctaaagaatcaaccatttaatcttttaatccataaacacaaattaatccacagaaaataaccctaaaataaatatcacggttaatcaatacccataggaacctaacaaaaatttgaatcatatttttctagcctcgaatttacttatttagctacttataaggaaactcggttttcatatttaaattcaaaccgtgaacaaaatcatttaaatcttgacatgcaacattttaaaccgtagatctgactcagaggagtcctacaaattttatttcaccatttttcgagttcaaaaactcgagttaccattttccaagcctctctgtgttttaaatcgaaaaaggaaaagaaaacggaaaaaccactttgcatgtcagcccctcgggtttcagctaactgcaaatggtcaccacaaggtcctcagccactaatctctaagtctatgccatcttgactttggcttaatcacgcgcgagattcgtcttctacctcgaaacagagagagggagagacgagtgcgcggctcggtgacggcttactggcagtgaagatggctaggcgaggtggcagacaggtgcagtcgatgaaggcgaactcgacgttggtcttggctcggcgggtggcggatggagatgtccggtccacgcacgctagcggggaccgaggaacggtggcgtcgacggaggtgcttgataccttctccaagctcaagcaagggctcggggttctcggctggacagtgaagcgagggacgacgcttggtttggacggtaggagaaaggagcgatagcgcaggcacgagctcagctcgcggtagccatggcgggcggcgtcaggtgagagcgagagagtgagggcgagtgagagtggaggaaatgagcactggcgaggtgaggcgcgctccacttcggcctagcagccagacgcggcaaggaccatgtgtgcatgcaaggagaaggcaacgcgtgcgctcgggcgcgagctcgacgcgtccccgcggctgccacatggcgggcgcgatctgcaacgcttgcagacgcgaaaagacaaaatggagagctcaaagcgttgcatgtttcagccgttttgctcccctctctaccgactacaactttgctatagggattagggtgattcagcggctagattttgaattatatgcctccaaactttggtttgtcagcactgcacaaaacggtggaaactggccgtctaaccgtgtcaaaacatgtcaaacgaattcaaaagtgtaccaactttttacagggcatgccctatgtaattatctacaacttttgtaattgggacaatgtgatttgaagattatttatatttgaacgcactgaagtttgaaaaggaggcaccagatcagacttagaaaaatgaggttgtccccattttttttctgaaaaacttcattcatcaagcacaacagtcactaaatcacaatatcctcgcatatagtttaagaaactaccatcacatgaactcaatagtgagaagaccaaccataaacaatccaaattaattaagcaagattactcacactctagcactctatgacaatctatgtctaaaagaactaggttttctactggtgcaagcaagcgttcatttcatagctattagtggcaatttaatattttcaatggaagtgataatatgattgatgatgctcatgataatgcctttatgatgcacatgccatgaatgaatatggtagtttcttcttgatcttcattaatc

SEQ ID NO: 335 - DNA, 2800 bp, Zea mays
tatctcccagccatcttctactctatcttctccaccgctcacgttctcagattttctttcactgtgttggccgtcggcctcatccctggccattcttatctgctggctggcactgccttctttgatattccccaccgtgtacagctaatgaccttatccggttatcccaacgtgagctcgtcttctctccatcccctgcctttatcttctccagccgtcctctgtttggttattttccagcgcgtgcagctccggctcgttccccatggtggccgcgtttgcctctccctggcgcgctctgcccccatccccgtgcaccccttgctcctccagctcggcgcccatctccatggctcgcgctgcgcccagccgccgcccctgtgtacttctctgctcgccggaatccctttgccgttgccatggcagctgtccggccgagctcaacccctgcccatctccctggtcgcgacccccctcagcttcttctccgtggaactcgcctctgcgcctggctcctgctcgtcgaatctccagcgatgtcgtcgccttgatgctcgccagcgtcttctctacccctacgcatccatggtgatttcccctgctgcagcttcctcggcgcgcagcctccctcccagcttggcctcttccctgtgctggcttggagcttccacggccgcaccaaattccccatgcgcgctgccgtccgctgcacgaagcttccatgtcgcgcgtcgtgcttctctgctcgccatggtggcgtgctctgctcgcccatggagttgcccaacccctctgctctccattttctttgtttgccgtgcgcacgaattttatctgctcgccacagcgtgtcgagctcccgcaccatcatcgcttctgtcgcaagctcgttagccacagttatcttgaccgcatcagcacgtgactgtggtcgtgttcgccaggttcgccaacacgctgttgccaattcgactgtcgtcgcggttgtgtgcctcgctgcgtgctcgtcgagtgttgttggttgtacctcaacactcgtgcttgccgctggctcgcgttaacgctcgcacgtctgctcgttgtcactgcgggcactcactctcctctatcgggtttcgcgcgtgctcgcgtttgccatcaagtcatcgaacccgtcatcccctgcttgaccccaccccaccagctcgctccaaacacgatctcgtcgtcgttcgtgcatctccaagaaatcccaagcgtcgggtgaagacgaagaccagcagcgtggtgttcaccaagtgcgcgacaaaaagctcagacatcctgcgcgactcaagttcggttcgtcaaaattattcagtcgaggaaaagatcttcagcaattgattaccgaagaaaagaaggcctctggataacgtcaaccggaacccgtagtcgtgtttgcgactatcgcgtcgaattatttagggtaagtaaatttgttactcgtgttagtggattggtggatggtttgactaggtttaatatttattgttttcctgagtcgttttagtaatttggtcgatgtcgtaagatgaaaaagatctcaataggtctcagtggttgcgggactataggtgttaaaaatgaaaagttttattaatatataaggtacacagtttaaagagtcaataaaaagctaggaataaaaatagatgttctagtgttattatgttaatttggttaatagatgtaattgatgccctactataatatccatggtgcttaatgcttgattttaagagtttcatcctttttagtatagagtatctatgttatactcgttatactcgtgctcatacatgtgcatcgtgcatctcatgaggtacgataattaatcgcgtgatgcggaagataagccaagtcgaccccaagcgcgggctaattcgcaggatgatgctgatggattaacctgaagatggataatcagaacaatgcgaagacaaaggatggtcgtcaagtggacgccacctaacaacactaacctagtgttattcgcttgatttcttagtgtaacaccgcaggtgtttatattccgctcgacaacgagtatggatttaatcacgtaatatcagtggataaaatggatgctaaattttaaacatcttctcctatcgcgattttaatatcgcatctgttccatttgtcgctagtgcgacatcgtttttatttatttatccggcctctcctaaattttcgtgatgtttggaacatcgtcgttccgaaaatcggtgcgtccggtgattatttaaattcatcgctcgcgcgaatacgaattggcaagcccgcccactttcatgattttatccctaacaaattcatttcaactcgacgactaaaatattcggggcggaataattgggatcgcgcgtcgtctgagtgaaatcgtgcgccaggatatgattcaatttacccttctgcaggctgttttgacgtgcatcagcagatatgatttcggctaatattagtggaatcacgcagattaaaataccgaagccgaactcgtgtcaatctggtccgtttacatcgtggccgaaatagtcacaaaaattatctaatcgaaatttagtcagaatcgtaaacctcagatgttccgtttcgtgatccgagaaaataatgtgcatacgactatttgtttgtcgctaaaaatcccgattcaaaaatatctatgaatttctgaaaatctgaaaaaaaaaggaaaatatttttctaaccgcctcctgctgatttttctcgcgtgaagcttatcttcaccaaatttttacctgcgcgcattcatctg

SEQ ID NO: 336 - DNA, 2734 bp, Zea mays
cttaaaatatgaggccttaatctcaaaatttgtactttctgtctgagggtcgttaacaaaattttcagggcaatcaataaaatatgtgtcattgaacgggtcaccgccaacgcctacacaagttgaccgccccaaatgtacagttgccgtctgaaacacctatcaacaaaagtcagacatgcattaaccaaacaattacccgattaggttcgcacatacacaaaaggtcatgtcaggcataccgcttcatatgtcaaggtaccagaacgagatatgatcccaatatgcccatgcttgtggacgtaacctggaacgattccaattttacactcaccaggcttaatgataacatgacaatttggcccaatcaattgagttttagactgactgtttactgcagctttcactttcacctaaatttgcagacgaaacattatgttgtcacctcatggagttccatcaacacagcaaaatataactaactgatctatgacatgagtcaatagcaatatacagaaaaaggaatgtccacaagcaagccgctcaatgaaccatggtagtaaaattgtgtctaattggatcacctacatctaattttcaaaatttgagccccatcctgcacaagagactaatagccgactgcatgcctatatgtgcaagataaactacgatgagcagtaaccatatgggcaacgcacggtatggacctagtgtgtgtatatatatccattgtggctttgagggtacggtacgatatttttatacttgggagaaaaatctatcgggttgagaatcaaacttgcacccatacccgcggatacaaactcacacccaaacgcgcattctatagagttttatccgtgggaacatggttaaaatgtgcatgttaccatccctcacagcttcgctcgattgaatgaaaaagtcgggtccgagctcggacgctcacgcggacacgtgtcagcatgtgtcgtggccgtcaaactcatgaaacccagagatagcttgaaagcctctccggttttattaataaaaagagtatatattcttagatctgtaaatacttggactgctataacccttctttatagttctctagagaagaatagattgcgaataaaagaggaattaagcccccgttcagcatggctgtcttttgctgctttgtgtaatactgcacgtacgaaatacagacaacgatacatttacggtcttgttcggtaggctagtattcaatacacactaggaataaccgaacaaggactcaagtggataggtctagagcatgtccaacatgaatatgttgcacatatatattgagctaacatagttgtgcggaaataatgagaaaacaacacttatagccgagcgaagatccacgtaccttttcctggtccgtaagcaggatcggtttctcagtttgttgaccctccgtgtcgccgactagtttcaagacatgaaagagtttgaagaaatcgatcaaagtccgatttgaaatatgttatgatagcctaccattgacaagacgaagaaactacggaaaaatagttttaactgccagataaggggactacgagccatatagatatctcagaaaatcgattgattttgttgcatcgaagtaaaatgttatttttgccataaaatttattaggagaaaataaaatttattagcagcgtctgtatcgtaggcgtagccagatcggatccatatcacgttcaagctgatccgtctagaaaggtaggcagtaatatggagtctgttgctgcgtgcgtctattgaaagaagtaaccagatattatctcgcctggtagtccagcgaacggactcgagtctgttgctgccgctgcggggatcggagtccagttcccgcgtaatttcgcgcacgcaacaactctcatccctcacctatttaaacctacgcccacaaccgcaagccccagcagagcacaccgcctcgacgttctgcgagcgaggcgcagggggcgagtacgcacatccgcagcacgttcaccggcaggaagatggtattggtcgccatgggccaggtcggcgcgccgcttccgtcgcccacgccttcgtccgagtctgacgacacgatcagcgaccaccgcggcgcctcgtctggggcggtcgtcgtcgtcgactcgccggcacccgcgcgggagtacatctgcaaactatgcggcatgacctactcgacgcaacaggcgctaggtggccatgtagccgggcacaggaacaagcagagagctgcggcggcgtccacagggatgatgcaaaacggcggcggcgactccctcgctgcgctccgccgcggcagcaacgcacaggcgacgtacgtgtgccaggagtgccgcatggagttcaccaccgggactgcgcttggtggccacaagaggaagcactacgatggcccgccgatcatgcgcaagaacaacaagaggccgtgtcagccgctgcctataacacttgcgctcttccctactaaaactgaagagccgtcgccacctgcacctcccgtggctaacaacttcagcgacgtcgatggtgccagcaagctcgaccttagacttacgcttgccatgcctctcggacaagcgtcatcagaagaacaagaagaacaagggtcttcgtccaccggcgagcagcagcacaagtagccggccacaatggagacggataaagcgcgccaccccaccacttcgtccaccggcgaccagctgcaggggg

SEQ ID NO: 337 - DNA, 2734 bp, Zea mays
caaattatgcatccaaaacttacaatttcgaatggaaggagtagcagttaagcaattctacgtagtaatagtagttagtttaagcaacagcagcgctttaaatacagatactaattgctaacctgaagacgtgaatttgtaacatcaacatgatcttcaaggtcatcctgcaaccaaagataaagaagttatcatcgagtgcagaagacacaaatactactggttttgttaggtggcactaactatcaatcttgtgtgcagggtaagttcttcattgactgctaatgcaatatgcttcgtgctcagcactgtctcttccagcttctcgagaccctcatcttgctctgtaacatgttgatacacgactcaaataaataaagcactatgaaatggtccttgctcccacaactgtcatttccaaggaactagatatgtaccaaccaaatatatgaaatgcaaatggtgtgaaaaaacagtgctacatgacctcatgcaaacagttgaatgcacccttttagtaaggtccatggagcaaacactactgaacaaaccacaataacccaatacctttcataatttgcctctgaaggccaacaattccttggttatctaacccagcaactctgctcatgtcatctggcattttactttgaccaagcagatcctccctaaattggaaaaacaagggtaaatattcacacattagttctaacaaaaaaacataataatacttacctaaaaacttgaatacagtaaattaatgtgtttaaaaaatatattaagatttaggaaggatgagttcctatagagatcattgctgacacgacagacctgttagcgaagtttgacatgttgaaacttgtcgccatctgcttggctttagacttcaaactggaaagcatgtcttggcgtttatgcatctccttgtcagtgctgcacaagtcaaaagaagtcaatttcaagcaaaaatgtttgatggtacgcaaaaaaaaaacagagtaaatgtctggacatcaaagtatgaaattctttgtcaaggaataatatctttcattgctacacaaatccttctcataatgaattttctctcaacttaaacgtacaaaacatgtatctagtgaaatgatgtccacaccgtcctagtaatctgcagaacaaagggaaccaatgaaccatattttcgtttgtaagcaggaaaccatttactagtacaaccagcaaattactcttttcaagtaatatattatgggctgttaggatcagtgccccagcaggaagccaggaacacaagttttggccctgcccatgcaatttggctgggctgcaatgctgatgcatcagctggagagtggcccaagaagtgccacacattttgtaacaatctttggaattgtattttctaaactatgtgcccaatatgtgatccatttacaccaattacgtacttgtgatttaatgtaaacaaagacacatgatggataattcgatttatgtcgaaattctaaaaatcactgacatgtgggccccacatgagaatcactgttttagaataatttgctgtggttgcaaccaagtccaatcttggctttgttacaaaccgaacgctgtatttataactcaaatttggtattatcctaactttggccatggccaatatttgggttaggcctcctaggatttagggtctacaagaaaacaaaccactggacgatctattctggaacaacgtaaaattgtgcacaacacataaaccagataactcaatttttagtacagtgcctgtcatagccagatccataacatttcatcacctaaggtacggagtttatctttattgattcacttattcatggcatagttcagtgctcactcattcgaataccacttttcatccctagatctagtatcagccattgttaagaccataaccattcatttacagccgcatgcagctcaattttgagtgcaagaacacgtcaaatatagtattgacaaaacagatcattggtttaaataagttcttcagattcaatagctatatgtttcattgctaagtatcagacttgagaaaaacaaataaggcatcattgcaagcactccacccatcattagtatcaaagttgtgaaagtagttgcaacacgacatacattgactttggaggaattctgccaaacaatgactccaagctatccagtctagtaccaagaatagttatttttctccgaatggctgaagtatgccgcataatttctgggcctgattgtggaagagaccctctgtcggcaatcatggaactgatgtcatcagcaagtctggatgcttcattgtattccttcatccatgggtccgaagatgatgccattgctggttaattcaaaatgacagaacacgtcatgtgagcagaatttggataagcataatagcataaacaacaatattgtaacccattatcaaacaatttcattgtaataaactagtatcatgcagagcccttcatgtctatgtaaagcaccaccagaactgtggttgaaaaggcaggaagctcttacaggcaagttatcaacagacagtttctaggcattgctgtctatcaatgccattattgagtacaacaagcttcatagaaaaggatttgcatgtgtagaactttgtttgactagagcaaatgatacatcatgaatctgcgagtagtatttttcccagcacacctacctttggtattaagcacaatta

SEQ ID NO: 338 - DNA, 2734 bp, Zea mays
agctcttctcagtccacagcttcccgctgagtcaatatcacgcagaattttaacactgcttgtcacagtggaaccgagtgacaggacgtccagggggagtgtgtctcatcacaattcgacgggttttttttgcataggttccttctcaggattctgcaataaaccgaatgaacagaacaaagtgaattcaaaaaaagtgcatgagcaactaaatgaataggttccttctcaggattctgatcatcattgtcattgaactagtgaaaacagaatgaaaggtatctctagtgaggtgggggcacagacaagaattgcttacagtatcagcaactgtatctccagtgataccggcatcatgctgaacattttgatcaccttgcatctgaaaaatataaaacagaaggcagaagaataaagactagcataaaaatgacagagacatagtaaagcagaatgactgacaggttgttctgatgaatcgcccctgccacgagcggcgttagcatcacgatccggcgactgtgctggaggagatgaatcttgcctctgaaaaattatatatcaaaaggcagaacaacaataactgacagcacaccagagtattaagtggctgtgacataacaaagtagattgaatggctgacagtttctatatcacgcacaacatgagctgtgtcagaatcacagcccggtgaccgagcaggagaaggtgaaggtgtatggcgggtatcctccacttgagcagtatctcgcccttcagcaataatcacctttttgcgctttctgttgttttcatgcagcctagaggcagttatctggtgcaacaatgacaaaggcattaataaataaataaatgacaacaaaattaagggaatgaatgaggccagcaaactcacagaagaacaccgttttgcatgttcttcgcatggagaggatgcaggaggttgtgtctcatcattaaatttcataattgcattcacctcatccaacattttcttctgcgccttttgcaaatccagctgccctctctggatttgtctctttgcattctcaatagcgcgctcagcatcagcaaacctacgctgaccctctgaaatctcgcaagacgctctttccacgctgcaatcatattctctcagtgcatccttcacagcatccttctgggtactatcaacaacataagaagcaatagactgcgccaacaacggctccaactgaacgaggccaaattgaatactttcagatccagcactttttgacctggcccgtacaacatcagaaggagcgggctgctgcacattttgtcctctagtctgtggctcgtcgtcagcccgtatgttggaataaacagtacgatccctgctcaacaactaaaacatggaaacaatttagtgaccaagataaaaaaaaaccaaaaaatcgatctcatcatgccaaaagagacacaatgactgaatggacactgcactacatttaaccacttgcatatagctcgtgttaacgcggggagaagagggggagggatcggtggcggctgcgcgagcaagggggagggatgatccaaataagggaatgacagtgggcatggtatataataactgagtgaacaaacatactaagggacagaataaccgagtgaacaaacgtaataacttagcaacaaaacagactataaaaacagaataaccacagaagaaagaaatttattacttacattcaactttccataggacacactgccatctctcgacgtcaatcggtcagcatccattatttttccaatacgatcattagagtactgtgaccatcgaggtgtaacagtataatgttcaacgcctgggcaatccaagttgtcaagatagtagagctgaaaacagcataataatatatgtgaaaatcaaaatatatattgacaaaacaattaagaaaatataaaaaagaagtgaacagtaaataaaattcatttcttaccatcaagagagcagtgcagccttggatgactggggtcttgttctttctatgattcttcctccatatggcagacttgtcctttatgtcattaaccacagcttgacaccaatcaaattcacttaaagcgttcaagtccttgcaaatgaggtaatctgaaccaagaggatagtagctgctggttggaaaaagaaagctgctacaaacgatgatgaagaaacactggacagcccaatcatcaaattcttcagcactagtggaagcaaaattctcaagaatccacctaggaacaacgtatgtctgtaaacggtcgtaattatccatcctagccatctcatacatacgtcgcattcccttgtcgtcgcatttgtttttaaggtcgcttcttgcttttatcttttcgtcctcaccaaactttgggattggctttccaccaatcggaaggccaaagatcaggtgcactacttgtggagtgacaggtaaaacctttccagaaaattcgatccggagtgggtcacccttaacattcttcatcaaaaacatccctaaagatctgtctaacagcctgctaataccaaaccgcaaaaaatcaccaaatcccaaccttctcaacctctgcttgtaatgctcagacatagggttgattaaatcatacacaaccttgggagagcacctcatgattgagaagtgtcctttgttcttctacaaaaaaaataaaaagatattgatagacgaataacaactgaaccaaaattggacaacataac

SEQ ID NO: 339 - DNA, 2732 bp, Zea mays
gaataacggagtccccactatcgagtgattacaaagagaataactgaataattcagttatgactgcgaaataactgagtaatgagcagagaataactgagtcatcacaccagaataactatatgcgcccattagaataactgagttccgacaaaagaataattgagtgacgaacatggaataactgagtcgcacatcgcaataactgaggtattataacataataactgagggatcagaaccgaacaactgagtgccgacaccagaataactgagtctgcacacaataataactgagtgggcacattccaataactgaggtatgatgataactgaggcatcggaggagaataactgagttagcccacaagaataactaaggtattggaacggaataactgagttctgtcaccataataactgagtgcgtccattagaagaactgagttgttggaacggaataactgagtaatgaagagataataactgagtagtgaacatggaataactgagtgtgcacaacagaataactgagtaatgaacaatagcataactgagttacttgaacgcaataactgactgtgaatagagaataactgagtaataaacaccgcataactgagtgggcacattacaataactgaggtatgatacaggataactgagggattcgagtagaataactgagtaatgtcacacgaataactgagtgcgtcgattagaataactgagtaatgaacgcacaataactgagtaacgaactgagaataactgagggatcagaaccgaacaattgagtgccaacaccagaataactgagtctgcacaccataatcactgagttagcccacaagaataactgaggtattggaacagaattactgagttctggcaccagaataactgagtgcgtccattagaagaactgagttgttggaacggaataactgagtcatgaacatataataactgagtaggcacattacaataactgaggtatgacacgggataactgagggattggagtagaataactgagttctgtcacttgaataactgagtggtgaacatggaataactcaaggcgcgcattagaataactgagtaccgacattagaataactgagttaggaacatggaataactgcggtattataacataataactgagggtttagaataactgaggtattataacggaataactgagggattggagtagaataactgagttggcccacaagaactgaggcacgagcagagaatagctgagtttcgtcaccagaataactgagtgatgaacacagaataaccgagtactgaaccgagaataactgagaaatgaacatggaataactaagtgcgcccactagaataactgagtgctgactccagaataactgagtcggaacagtagaataactgaggtattagaacggaataactaagtaattagtagaataactgagttattagaacagaataactgagtgtgcacattagaataactgaggtagtagaacgtaataaccgagttccgtcaccagaataacttagtactgacaccagaataactgagttattagaatggaataactgagtaatgagtagagaataactgagtgtgcacattagaataactgaggtagtagaacgtaataactgagttccgtcaccagaataactgagtactgacacaagaataactgagtcgccacactagaataactgagttactggaacggaataattgacttgtgaacagagaataaccgagtgggtacgttacaataactgagttattataacggaataattgagggattggagtagaataactgagtcacgagaagaaaataaatgagtcggcccacaagaataactgaggtattagaatggaataactgagttctgacaccagactaactgagtgcgtccattagaataactgagtggcacataaataacttgcacatattacaataactgagttgcacatattagaataactattcagaataaaataactgagtggcacataaaacaactgagcgttcatcatagaataactgaatttggaacataaataagtgagcatccagtacaatataatcgagtggtggatctcgtcgaggtccaaatgacatcaccctacaaactctaagtagcctgacttggtagcagctgaggcagcctgtcatctgagccgactagtcctccttgcagcaatgaccaaccttttggccaggagagcgtcacggcggatggtggaggtgtgcccaatatgctgatggttacttcctccgtgctactacttgtgcgtagttgccacaatggaggtaaccaccagcacattggtcactagcaccccaagcccttctcagcataaaaagaacaaagtataaataactgacatggctacaaaagagaaataggcagaaaacaaaataagggcttactgctaaggctgcatgaacacgactacaccttcactccaaattcaatagctgcatcataccttccaaagagtccttaagttcttgttccttattttgtaatgcatcaatctccttcgtcagttcatccactatgtctcgcaagtcccccaacaaattcgtgatatattgaggaaaaaccggatgatgccattgaaagaaatcgcatctctctaggtcagactaatcacatctctctaggtcccgaccctaggttcccatctgcattcgacacggg

SEQ ID NO: 340 - DNA, 2731 bp, Zea mays
ccgaaagtctggctgtctcgtccagtatctcgactcctagtctgccatcctttatggactactagtccacaatcctctatgggcattgtaacagagtgaggttggtgaatgacaaatgtttgccttgtggagaaatcatacttaagaatttcgactctacgacatcacagatatagttaatgagtgggacatgttaagagaaaagaatttgatgtaatcgatattacgacatcacagatatagttaacgggcgagacatgtccttttgaggattttcaaaggtttctttactagtggacgtactcaagctagaacattgctcctcggcaccaccaacaatcttaatttcctctaagggtacttcttcaatattagggaactgggaataataagaatggagcatgtggtgaatttcctcccttcttcctaatcgttcatcttccatatccatgtcaactaaatcctgcaaaatcacaaggcaacaataaatgccatacgagaagagagatactcactctcatgacaaactctagccatcaattattattctatgctctagtaaacctagtcacatctccacattatcgttttggaaaggaacatttcacattatattaaggaactaatattacctgtgttggaatagtcttgaataacagaagactccttttatagtaaaggtgaaatgaaagagtacagatgataagaggtatggtcaagcatacagccactcgcgattctttaatttcaaatacaccagcacagatgatctgggtgagcacgagagagaatatgattgtgttgtgtgcaattggccaatacaatcctcctgtatcagaccttgttcgataaacattgagaaactgaaaaagaacacatggtacattagcatgaatggacaaatttcagggtaagtaagaaaataaaatatagtatctaggttctcacttgattgcggtatacaacacgaccaaggtaaaagtatactagcaggaaaggtaaaatcataggagccaccacagagcatgtgaagcccaatagtccaaacaatagaacttttggcacttcctgctgataggggaatgtgggaacagattctgtatcttctctatattctccctttctcaaaatatatttccttataaagctcattatcagattatagaactgcaaaagttcggatgataaactagcccatcccgaggtcataacataggtgatgaagaaggtagcctgcaataaaaaataaaatcacagaaaagaaacagaaatggtagatgaaaattaaatacacaaaaccaatatattatctttccataaagaaaagggaaggtgtgttaaacctgtctagttaaagctctagcaagcttgacaggaatgtcctttgggcttaataacaaattcaattgactcatgaatgtaccggatagtacattaacaaagaatatgttccaaactatgaagcacaacagtttaaagcaagcactcctcttccttgcactgtgagatgtggcaccttccaatttagaaactttcatcatcaatgtcccaacaatatatagaataatttgttggatcacactaggaaggtatcccgttattaggttagtcatgtagtttttcctgcaaataggccgagtaatatatattcaataggtgcaatatggagacaggtcaaatggatagtatatatatttgtagcgatataagatcacacatctatcgagatagcccaactgaagtttcagtacttacttctccaacctttcttttaaggaagcaggcatcaactgttgcagctgctctgggtcagatagtgattgtatacacaccatcggcatcaaaagtaagaatgcaaaaataatacagcctggaactagtgttgatttacgacacctgttggattgccaaagattggaccaatacacgtcttctggttctggagccagactagtaacccatttcagtgggttagatgtctgcaccatatttgaggcagtaactgcatcatagcgagttttgaaaaatacaaaagcagttgcgcattcctgctgcatgtaattccacatagaaattactatccatattattactgctaaattaagcaattaacaaatgcatgcatgcaagaattttaacctcgtgatctaagtttatggtggattcttcattgtcagggttccccttgttttgctcgccttcagagttaaacttggaagaatttggagagggtggtcccatgaaacaactgttggtggttgtcgtcctaaatccctgactgccgatttcagctatgaaatgtttgaacttcttatgtgccgtcttagtgccagtctgtcagataaattaaagacaccaaaaccaagaggttaaatacaaacacgcataaggaaagaaaaaccattcaacactggaggaactagacatttgttcacttgttcatgtcaaaaagacaaaaacaattatgagaaaacctagctaatcatgagatgaagtattaattatacttcacttagaatatataatagtaaatgttcttcactagtaaaagagaaatgcatgcattgagtacaagctagataccattatcttatggacatgcccaactttgtagacaatttgatggaagagataactagacgagtgatactttgtgaagaaatttccaacagcatcactgtatgattctttagctgtctttggtatttcacgaacaaggagtgcaaattga

SEQ ID NO: 341 - DNA, 2727 bp, Zea mays
gaataacggagtccccactaccgagtgattacaaagagaataactgaataattcagttatgactgtggaataactgagtaatgagcagagaataactgagtcatcacaccagaataactatgtgcacccattagaataactgagttccgacaaaagaataactgagtgacgaacatggaataactgagtcggcacatctcaataactgaggtattataacataataactgagggatcagaaccgaacaactgagtgccgacaccagaataactgagtctgcacacaataataactgagtgggcacattccaataactgaggtatgatgataactgagggatcggaggagaataattgagttagcccacaagaataactaaggtattggaacagaataactgagttctgtcgccataataactgagtgcatccattagaagaactgagttgttggaacggaacaactgagtaatgaacagataataactgagtagtgaacatggaatacctgagtgtgcacaacagaataactgagtaatgaacaatagcataactgagttacttgaacgcaataactgactgtgaatagagaataactgagtaataaacaccgcataactgagtagtgaacatggaataactgagtgtgcacaacagaataactgagtaatgaacaatagcataactgagttacttgaacgcaataactgactgtgaatagagaataattgagtaataaacaccgcataattgagtgggcacattacaataactgaggtatgatataggataactgagggattcgagtagaataactgagtaatgtcacccgaataactgagtgcatcgattagaataactgagtaatgaacgcacaataactgagtaacgaacggagaataactgagggatcagaaccgaacaactgagtggcaacaccagaataactgagtctgcacaccataatcactgagttagcccacaagaataactgaggtattggaacggaattactgagttctggcaccagaataactgagtgcgtccattagaagaactgagttgttggaacggaataactgagtcatgaacatataataactgagtaggcacattacaataactgaggtatgacacgggataactgagtgatgaacatggaataactcaaggcgcgcattagaataactgagtaccgacattagaataactgagttaggaacatggaataactgtggtattataacataataactgagggtctagaataactgaggtattataacggaataactgagggattggagtagaataactgagttggcccacaagaactgaggcacgagcagagaatagctgagtttcgtcaccagaataactgagtgatgaacacagaataaccgagtactgaaccgagaataactgagaaatgaacatggaataactaagtgcgcccactagaataactgaggtattagaacggaataactgagtaattagtagaataactgagttatttgaacagaataactgagtgtgcacattagaataactgaggtagtagaacgtaataactgagttccgtcaccagaataactgagttattagaatggaataaccgagtaatgagtagagaataactgagtgtgcacattagaataactgaggtcgtagaacgtaataattgagttccgtcaccagaataactgagtactgacacaagaataactgagtcgccacactagaataactgagttactggaacggaataactgacttgtgaacagagaataaccgagtgggtacgttacaataactgagttattataacggaataactgagggattggagtagaataactgagtcacgagaagaaaataaatgagtcggcccacaagaataactgaggtattagaatggaataactgagttccgacaccagactaactgagtgcgtccattagaataactgagtggcacataaataacttgcgcatattacaataactgagttgcacatattagaataactattcagaataaaataactgagtggcacataaaacaactgagcgttcatcatagaataactgagtttggaacataaataagtgagcatccagtacaatataatcgagtggtggatctcgtcgaggtccaaatgacatcaccctacaaactctaagtagcctgacttggtagcagctgaggcagcctgtcatctgagccgactagtcctccttgcagcaatgaccaaccttttggccaggagagcgtcacggcggatggtggaggtgtgcccaatatgctgatggttacttcctccgtgctactacttgtgcgtagttgccacaatggaggtaaccaccagcacattggtcactagcaccccaagcccttctcaacataaaaagaacaaagtataaataactgacatggctacaaaagagaaataggcagaaaacggcttaccgctaaggctgcatgaacacgactacacctttactccaaattcaatagctgcatcataccttccaaagagtccttaagttcttgttccttattttgtaatgcatcaatctccttcgtcagttcatccactatgtctcgcaagtcccccaacaaattcgtgatatattgaggaaaaaccggatgatgccattgaaagaaatcgcatctctctgggtcagactaattgcatctctctaggtcccgaccctgggttc

SEQ ID NO: 342 - DNA, 2726 bp, Zea mays
caatccgatttcaaaaatcaacatcggcgatgatttttaggtgtcgcaaattgtttctttcgatcataaatccgaaagtcggtcatatctcaagacgatttattttcgaatcacgcgtaggaaattatttccgagcgaattcaaatcagactctcggccgaattaatcgctcaatcgtccgttcgtcggaactctaattcactctgttctccgcaaaaatgaattccacaggagcatttttattccggaaaataatttagcgcaacccgatttagaattttgggccaagcccattccagcccaataggctcactaaggaaccctaaccctagcacatgcctataaataggagccctctccccttgcacttggcaattttgcactcccacccctccatttctttcagccaccacaaccttgcttccctgtctcttcttcctcacgacagcagcacgcactccttctcccacacggcaacacgcagggagcttcctccctgtccatggcgtctcctccccttcctcgagcaagctccagcgcgcgcacagggtagcaaccccttcatttcccccgtggatccatggcgctcggcagcagggtacctccccacgagctccctccttcctggtttttcttgggcgctccatgcctctaccctggcttgagcaggccggtgttttcccccagcgacgcctctgctccatggccagcgcgccccttcttcctccctggtttccacggcggccagcagggagcccagtttctccctcccatggcgcctccacctccctgcgcctagcacatatcctctgcccagtgccctccctcctctctgtttcccttgagctcaagtgcagggagctgcgcccttcttctccacagcgctcaacgcccctccccctgttgttccctgcgccccattttcttccatggaaaaccagcaggaggcccccctcccctcagctccaatggtgagcctctccatggccggtgccccgcgcagcgcctctgctcgactccctctccgcagcagcatgctccggatttctgtacgccgacacagagctgcgcagtcctgacccaaagcgttgcgtgggtgtttggacagtcccatgctacgtcgttgatctgcgtggttcgaacgtctcctcgtctcgcttcgccgggtctgcgcagcgccggcgagccgtcattgaaacccatggtgagaccccgctgtcctgcgcttttcatgttcgattgaatggccgcaccaacaaatcgtgtaataaactgtgccgtgctcgcagcccgtgtcgtcgtcatgcctcgtgcgtcgctcgtcggcaaagaggccaatctgatggcatgcatgtgcaactccgatcggattttggcctggttgttcgccttgaatgattcgcgatttgttttatttacgtatttggtcgatgatgtgcatgtgtgaatatgtgtgtgaaattataattgtatgaatgcacgcgtatatagaagaaaatgaagtagaacaagaacttggatgtttttatatcttggtaggaaaaatatgcgatgcgttgtttgatgcgaaaaactaagttacaaaatgcggattatgttttgggagatgcatcgataggtgtttatgtgaaaagtgtaattgttttatgagagtgatcggtgattgggatagtcgaggcgaatgaggagtatgagtaatcctgttggagtcacttgtgcggttgatgccttgtgcgtattatggggacacataggtgcgtgggtgagccgaggtgttattttgttgttggattggatagatatgtggctgctatagttccttggtgcgtcgtagggattggtcgcgaatgtgttaatggtttgctaacatgcttcatcgtacattaatgtgttagtgtggcaaaaatttggtaaatcttaaagcatgcttggtgacttccgcactcggctagtgagtcagtctaggataattatatttatgtgttcatcgttggtgtaggttaaattaggtgaaaaatgtaaatttcgtgacataaaattggtgtttggaagatgagatagattaatttagaaagatgtgttatcaaacatgtgtgccgaaatgcgttgtagtagtgattgcgttaacttgaacaaagagtctcaagtgcatgtcgtgctatggttgtatttgagatagtaaattataagagttgcgcaatatgaggttcgatcgatgtagttaatattgagtggactgtagagaggtggtgacatgccgaagtagtcatcgcttcctctacggttaagtcgaggtcatgtgtgatgatgctatttacgtggtgaatgtgtttgttgaatgttgatggtaattttagtgcactaaatgacacggataaaaattagtagtgctcatgtggtgtctaagctaagatgcaaaatattgggtgaaaagcgcttcgatattgattatcggggagaacacgttgttaattaagtatggtacttctagcgcccgaaataacttggataaaattagtaagtcgacttattgatcctaatttgatttttttaactctaacaaacggtaaagtgttagagtaattctagtcgccaggacagggtaatttttgaagtaaatagaagctgaaaattattagttgctgttttggactgcacgcagtgatgtcctcgtgttgaatgtttgatgaacaaaatcatgttttctatagagaagccatatagat

SEQ ID NO: 343 - DNA, 2726 bp, Zea mays
aggttttggatgcttcctggtacatgccggtagagaatagggatccatggaaagaatatcaggttttcagcatcagctatctcatcttcctttatgagataattgttggagctaaagtgttctggtatcctcaggtggcacacatccccggtgcgctattcttcgacttagatggcatagttgatcggacaactgatgtgagaattgtttctagatatactttgcaccctcatttttttcattattttagctgaagtatagatacaacgacgattttcctaggattgcggtgattcatacatctttctgcaaatctcatgtacttagatttcgccgccaactggagacttattctttcaattagtttgcacaagacagtagcgatatatggcttgtcattttaactaatgcatactaagtttattgttttagttaccacacatgctgccatcagaagaggctttcgcagcagcaatttctgagctggatatgaaaaaccaggataaagttattgtttatgatggaaagggattcttcagtgcgcctcgtgtttggtggtacgcgctgaagtctgtatccagtatccacttcataaaaaatgatgaaatcaatactccattagacacttgctattcagttgtgctgtcgatataagaagcgataaacacacgatcaggaaactggttatagccgacagttattcgtcatgtttatcacattgatattcggtgtaggtaactgcagccctgtttagtcagtttagggttctttaggtgcatgttattcggtgtaggtaacatacagttttctgtgtttccatatgatccaggagccaacgatgatgaaactatttaggctttcctccactgtccttccagcagctcatcgttgcatgccttgtctgcccaagttgaacattgattaatctgaaaaataggagacgatgtgggtccttggtattgtgcatgtttctactgaatccatgcttcctttgtgtacttttactggtaatctgttttcattatggaaaaaatgaccactagtcttcttgatatatcattcttccacatgttgttgttatacttggaggaatggtacctctagagaactttgcactttttctccgcaaagttcttttaaaaatcctattgcaatgccttttgatgctggctgcacacaacctttttttacttattttcttaaacaatggatgtggtgatgtgatattagttttatattttctctgattcgtgaacttgtaggtttaattcttgatggtccatcttctgttgatgacttatggattcttttttcttgtggtcagtcctgcagcaattttaaaacagaattaatacatttttttcattttcaaggttctgatctcccatgccacaattttataacgttgaaggattcaaaaatctacagaactagatgatacttgcataatgcagccctcagatatttggaaggcgcatgttggttcatcacagtcagagggttcgggtctggatatggagaggaacggatgcaatcatatttattgtccatctcctttccaaccaattgcctcagctggtcagcactctgaaagcagcgctgcatacttttcttggcctacatctactctaatgcacgggtcagctgaaggccgtgctaattactttgggaacctacagaagggtgtactaccaggacatcttggtcgcttgccaaagggccaacaagctaccaccttacttgatttaatgattataagagcattccacagcaagatcctccgccggtttagtcttcgtacaacaataggctttagaattaggaaaggaacattgactgacacacctgccatccttgtgtttgttgctcgaaaggttcacaggaagttgctcagcgctactcaatgtcttccaactgcccttgaggtaggcatgatgtttgtttcatgtagtttacaatgttatttaagccatctgaaaccacatattcagtttcattgcgttccataaacagggacctgggggtgtgtggtgtgatgttgatgttgttgaattttcttattatggtgcaccagccccaacaccaaaggaacaactttatgatgagcttgttgatggattgcgtggtagcgaccctattgtaggcttaggttcacaggtaacattcttttgttttcaaacaactagatgctgacaaaagagtatttccatcacttgccattcctcaaatataaatatattgcatctattatatggctcttctgacaaaagaagtttgaaaacagagaggaaggataaggacgcaaagaaaagaagtaaaaagaggagaaaggtatactctagcttatgacctgctgcctatttgtgaaattgttgcgatttacctaatggaaatatatttagttatgataactatgttctaggtactttgcttacttaaaatttgtttgacgccctcacctttaaatctttaacaacacaaaagttcatcagagtcaagttccagctcatcttcagaatcttcaagcagcgacgatgagagttcaaggaagtccagatcacggtcgagatcaaagagaacaaggaaggaaaagaagagccggtcaaagtccaagcgcagaggcagtgaaagcgaggaggaaggcccggtacgcctctctaaattcttcgggaagtaaggagtagacgctactgtagttggaaatcgcttgattagcagcctcatta

SEQ ID NO: 344 - DNA, 2721 bp, Zea mays
aaaaactaggagagactcccaaccactagatgcggattgacggctcacagcccttgctccacactgagctcccggccccagcaaataaagctcgaaaaactacagtacaatagagatattcgcctccccaaactacaaactccagagacacagagcgcgaaagaagagggaaaagaaatttaacttcttttcataaaaattcgggtatcagagtcgtactgtaagacatacttgtttaggcatgttaccttaaaacatatattgtgctatttgcaacattcctcagttgtgaacacatcaacccaagtttaaggccgatcaaaataggagtatgggactaatgggtattatatttgtacaaattttctgcatgatacaacgatttctgatgggcgtcaacttcaatggattttgaagacctaaatgttgtattgtttagacatacagttttttcggatggacccaacgtgttgtttcgcagaaaccatcattaacccatgttcaagacaaccataacatgagtatgtgaccctagattgtcgcatgctagcactagatttagtcatatgaatgatacggtgactctagaagagcttgaagcataacttgtagatctttttcagatcatcaatttactataggcgtgagctatccaacatgttgttttacatgcttcatcatcaacctaagtgtaagacaacctatagcatgagtttggggcccaagatattagatgttcgaatgctggcactagagtttgtagatatgaagaatgaggtaactttagaaatgtttatagtgcaacatgtatattttttagattggtaattttccggagttgacagctatattaatgtaattctacttttatttcgatccatgttttaagatactttgttattattctattacagttatatcaatgatatttataacaaaagaattaaacacagaaaaaaatttattccaatttaataacaatttgcattatgccagactctaaacaatactactttaggcatgctatcttaaacgatatgtagtgctattttaaatgattctcggttatagacaataatgaatgttttgaggccactcaaaaaacaagtatgggactcatgatatttatcacaaaacaaattaaccaaggaaaaatacattacaatttgctcattgccaaactgtaaacatcacctgtttggacatgttacctcataaaatatgtggaaagatttaaattgtgtcatggttgtggacattaatgtcagtttgaagcggttcattgccctaaatgatgtaatgtttagaatggtaatttttacaaaaaggacccaaaaaggtttgtcatcaaagttttcgcaatacactgatttgggagtaaagggtcatgatttcgtgcatgttttctcgaaaagattgtgggatgaaccatgcaaaaactttgaagcttttcgaagcactaaattatgtggtagatttatagaatgaaccaacatgttgtttcacacgctccaccataaactaaaatttaacacaatcaataacttgagtatgggacccacataattagatggtcgcatgacgattaaagttcaatgttttaaagaatgaggtaactttaaaagtattcgaattgcaatatgcagatttttcaagataaactattttgcagaattacgacctcttttaacggaaaaatagttaatggaagaaaaattatattttcactttcattactcttttctaaatgacgtattgtaagacatacttatttatgcatgttaccttaaaacatatatagtgttatttgcaatgttcctcagttgtgaacacatcaactcaagtttaaggccgatcaaaacttgagtatgggactaatgtgtattaatttcgtgcaagtttactacatgatatatttatttctaatgtgcatcaacttccatgcattttaaagccctaatattgtattgtttagacagatagtttttatggatggacccagcttgttgttttgcgtgcaccatcattaacccattttcaagacaaccataacatgagtatgcgaccctagattgtcgcatgctagcactggatttaatcgtataaaggacgaggggactctagaagcgcttgaagcataaaatatagatatttttcagatcatcaatttactataggcgtgagctatccaacatgttgtttcacctccttcatcatcaacctaagtgcaagataacttatagcatgagattggggcccaagatattagatgttcgaatgcaggcactagagttggtagatatggagaacgaggtaactttagaaatgtttaaagtgcaacatgtatattttttagatctgtaattttccggagttgagagctatatttatgcaattgtgcttttattttgatccatgttttaaaatactttgttattattttgttacaattataccaatgatattagtaacaaaagaattaaatatagaaaaaatttcattccaattttaagtacaatttgctctatgccagactataaacaaaactagtttaggcatgttatgttaaaccatatgtactgctattttaaatgactcttggttatggacaatattgcatgttttgaggccactcaaaaaacaattatcataaaacaatttaacctaggaaaattacattaaaatttgctcattgccaaactgtaaacatcacttgtttgg

SEQ ID NO: 345 - DNA, 2719 bp, Zea mays
tgtatgtgtggactatgggtcctatctcggattcgactaactcgctcacggtaagcggcgatttctcattctccggtagcgtctcagtttccacgtcgtcgggttcacagtggtctacgtctaatcagcagctcatcaagacgatcaaccgtactttctcgccactgtatggcggcgcggttacgtctagcttctccggctcactgagtggcattgaggctgtcggcgggtccgtcacggctacggcttcaggttctacgacgacagccaagcggccaccctacgcaccggatgcgccaaccgctgtaactgtagctcgcacggattcgacgcggcacacggtctcgtggacgcgcacgaatgccacggatccaacgaagatctatgacacgcaaacgatccagcgcgcagacgttctaggctccggctcatacgtcacgatctccacgctcgcgggttcatcgtcgtcattcgtggacacttctacggtctcgaataagaaataccgttaccgtgtccgcgccaacaatgacagcggttcttcggcgtgggcttactcgcccaccttttacaccgcgccaatctcgccaaccgatgtcaaggccgcgaagtctggcggcgatattgccgtttcgtggactcgacgcgcacatgtcgaagcgcgctacgaggtcgaggactgggcgaacggtgttgcgacaacgccaacgattctcacggcggcaaacgcggcatctactgtcgcaacggctcccgatccagctaagacgcacgcttaccaggtgcgcgctttcgttgacgatgcaacctttgggcgactctattccgtctattcggtgcaatcggccacggtgcaacttatggcaccgccgaacgcgccaacgaatctcgcaccaagtggcaacgctgcggatggcgcaaaggcgatcacgctctcatggcgtcacaatcccgtggacaccaccgcgcaaacgtactactcgctacgtcaccgcgccgtgggtgcttcgacgtggactacggtcgccaagacggcaagccctacacagtcccgcgcgctcgcggctggaacctacgcgaacggcactagctttgagtggcaggttcaaacgtggggcgatcatgctaccggctccgagtggagcgcggttgctgttgtgccactgtccgcaactcctatcgcgacgatccttagccctgaaacggttctaggatccaagctgaccgctcaatgggcttatgcggatccagagtcaacgaatcagtcagcttatcgcgtcacgctcattcagtctaggcagactctcgaaacatataccggatcaggttcggcatcatcgcgagttcttgcaacgcgactcgataacggtggaacttatacgctcaaagtcgccgttcgcgacggggcgggattgtggtccgcagatacttcgcaggtgttcacggtctcctatgcgccgccaccatctgccacggctacggctatctatgacacttccacaggcgcggcggttatcgaggtcaccattcccggccccgggtctggcgaagtggacgcggttacatggcacctagagcggcacactggcgcgggtgattgggttgcggtcactaactcaatctcggttactccaggtctttccgagtctgttgttgaccagctcccggccgtgaatgctctcaatcggtaccgcgtgatcacgacctcagagcttccatccacggccacatcggcagaagttatcctcgacacgtccaagcatcggggtttcgtctacgtcaacgccggccccggattctcgcaagtgatcaagtttgcagatttcgccacggcttcggtcaacgcgacacgcgagcgggtattcaacaactttgcagggcgctcgtatccagtagctactaccggcgagacgcgtgacaagacagttagcgtttcagggcgactaggggataactcttctacgccgtccgaggttgaagcgcttatggatctcgcgggaaccttctgtgtgcgcgctccttacatgaagcaaggcgcgggcgggaatgttcgcgagtttgtgcagcccaactctgggactgcactggaatttgagcgcatcaagggcactgtctcactgagcttccgaaaggtggatttcattgagtagcgtcgtattttcggatcttattgaccgtcggacttatgacgcgcttactgaccgccacgaagaattctggacgtatcagcgactcgatcgaaacctaaacctcatcgaggaagtggatggggttgacgcgtgttcggtcgatctgaacttcaattcggatgtgcgcggctccggctcattctcctaccttggctcaattgactggcgtaagggcaacttgattcgcccggtatacacagtcaaggctggggattctgtcgcgtcatggccgctgggtgtctacgtcccaatgtcgccgcaacgcaagcatggcgctacgggttcgccgtgggaatttcagatgtacgaccgcatgatgctgttgcgggacatcaagatgagtaacacctatacggcggcaaagggcatcaacgccattggtcgagtgaagtacctgctcacattctggggcttaccccaatacgtgattgacgactccgatgaagttttgcgcacggcgattacatgggaaccaggaacaacggttctgcgtatcgtgaatgctgtctcttatacacatctgacgctgc

SEQ ID NO: 346 - DNA, 2717 bp, Zea mays
ttgagctacttcagtagcccgctttacctgtaagttcttcctcttaattgtcccaccgtaacattctatcattgtcttaagttgtttccacacaaaattctttttcgtttgttatgctgaaatttcattgtgcttatataatcttaggatcttgtaagctttatttagtttcttaatctcttctataatatcttctccatttttttggggatccaaattgtcaatactaatctatgaaataaagtttagtcccaacaattcggatcgccaaaaaagtgaggaagatattaggtaacagataaggaaactaaagaacacttccaagatcatgagatcagataaggacaatgaaaattcagcataactagcggaaaagaattttgtgtggaaccagcttaagacagtggaagaagattacattgggaccattaagaggaagaacatataggtaaagcaggctactaaagctgctaaaaagcttttgcataatgtttatgagctgccattgggtgcccaaaagaaggatgatcaaatttttagactacaaatagtggcgacaaattccaatgagaggatgtcatttcttgaagatgagctgcaaaaattgtcgtctttggtcaaggataaagatcttgaaacttataaaaataaaatcaactagagactaaaatgcaagatatagttgtagtccagattaacaatccaaatgaggcctaactatatgaacaggtggttagcaggttactgggttctttttgggtgagaaacttctgatgttggtggatttttctatgtgggtaaacgtaaatcatgtcacatctactcttctagagactaaacacaagagttaggtgcagtttagtttaactaatccaattgaggttagcaggttactggggtgttattggttgagaaacttctgaggctggtcgattttttatgtgtgtaaaacctcaatcatagcacatccactcgtaagaagactcggttgtattcctattaatagaaatgggtgtttcctctcaaaaaatgtggactaacttgatatttatagacaagtttagtggtcttgtgggcaatttactctagcaggccccaaaagtcaaacaacaagttacttctccacaagaaagtggcaatcaataacatgcatgtttatcaaactgaccactgagacccgattgcagcaagagcgcacgacagttcttgacccacaagacccaatttgcacgatacaccataagggtgaaaattaagtcagatgtatgatcgcatgtaaatgcgagattaatttccaggcctgctcggacggtgtaaacaagcgacactatattttttagacctgctaaccacatgtcataaagttgatatagttagacctcatttggataagctaaactcgactacagctaactcttgtgttttagtgtcttgttgatcttcatttttattagtttcaagatctttatgcttaacaaaagagaacaatttttgcagcgtatccacaacaaatggcatactatctttggcatttctcgccactacttgtagtctaacaatttcatcatcctttatttgggctcccacttgcagctcatcagcattatgcaaaagcttttgagctgcttcagtaccccgttttacatgtaagttattcctcttaatggtcccaccgtaacattcttccattgtcttaagttgtttccacacataatttttttcatttgttatgctgaaatttcattatgcttctctaatcttaggatctagtaagctttctttagtttcttaatctcttccctaatatcttttctaattttctggggatccaaattgtcaaaactaatatatgaaataaagtttagtcccaacaatttggatcaccaaaaaagtgaggaagatattaggtaagagataagaaaactaaagaaagcttccaagatcatgagatcagaggacagtgaaaattcagcataacatgcaaaaaagaattttgtgtggaaccagcttaagacaatgtaagaagattacactgggaccattaagaggaagaaaatagaggtaaagcatgctactgaagccgctaaattttttttgcataatgttgatgagttgcaattgggtgcccaaaagaaggatgatgaaattgttagactacaaatagtggcggcaaatgccaaagagaggatgtcgtttcttgaggatgagctgccaaaattgtcatctttggttaaggataaagatcatgaaactttaaaaaaattaagtcaaccagagactaaaatgcaagatttaattgcagtacagattaactaatccaaatgagtcctaactatatgaataggtggttagcaagttactaggttcttattgggtgagaaacttctgatgccggtggattttgctatgcgggtaaaacctgaatcatgtcacatccactcttctagagactaaatacttgagttaggtgcagtttagtttaactacgacctatatataaaaaatgtggactaacttggtctttatagacaagtttttagtgatcttgtgggccaaaagttagacgaaaagttaccttcttctccatgagaaattagtaatcaataacatgcatgttggtcaaactatccactgagacccgattgcatcaagatctggcacacggacgaacttcagacagaaatgcaccatcaggactcacaaaatcaataggcctg

SEQ ID NO: 347 - DNA, 2709 bp, Zea mays
ctgtagctatcgtaatgttggaacgagttgaacccacatcaacccatgtttggttcaaaaggttcgctgattaggttggttccgggtcgaaatattcctttaagttgcgtgttctagggattcctaaaaaacaagcgaaccacttcaacccactccctctctaccccatatgcgcagcctgtgcaggggtgcagggcgcaccaccgccgccggcctgttctccagtcatcggctcccccgccggcttgccctccgacgcgctgcgccctcgaccacgcccactgtcagagtcctctgccgccctgccctccggcgtcggcgtgttctccagccatcggagtcccccacaggcctgtcctcccacgcgctacactcccatccgtgcctcccaatgacgttgttgtgccatgatcccgcccctgccaccatccatgtcccctaccgacaccactaggtgagaagcagcgacccccatcttttgttgtgcttatgaatttctcaaatactgaaaaagtgttggtttcatttattttgaatgttgtaatctcatttggaattaaagatatcatccttagtgtggtaatgtgactaggaagatgaccacattcagttcatcctttattcatccctcatcatgaaaccaaacaagagatggtgcagcttcaacccacttcaaccaagaaattgggttcaatcccgtcacttcaaccaaacaagatacgggtccaacccaacccacaaaattaggtcggtttcgacccaacccacctcgttccgaaaccaaacgcactagtattgaacccacgtcatgaggatcccctacacggtcccccatatagaggagagaggaaacaccccagggagcactattcgtcctatatttttatttcgtcatttatttatgatattaatcatgttcaagctgtataacatgataacaatgtgtattatggtagtacaaatactctataattttttaaaaaacttttaaaactgataaaaaatgttaaataatcgagttgtagtgtatagtgtagctggatatgaaaattgttgaaggcactatatgtggaagaatgtatcctttagatgatgtaataaaatataatagaaagcacaacggggtaatatggatgaaatggttggagggctttacacgacaaccccagtcgcagtcgtcggtcatgtggcgctgggcctaccaggtctgatggaaagcgagagccaccccatcgaaacacctgcccagggcccattgatttgcggcttggcggtttgcaacaattgcgaaatggtcacgatctgatttaattttgaatagtacgaaattttagcccctcgattcttgcttctaaacatatcattagagcaactccaagagctgccgcatattaacgagaatagcatttttagcttccaaactccaccattctcacctccaagggactgctattcctttctcggctccccacaaaggcaacgatggatcccgcatatatgcgcgagaaaaactctccctaatcctgccgagcgcgctcaatcaagtagctttccgtgaatttttttccagctgcgcatagttttgttcgacgaaaggtgcgcggcggcggtagagacaccatcgtcgttggaggaatacattgttgttcttcactggagcggcgctggcggctcaaggccagttgcttcggacggtcaggatatggtgttcagcggcacacgtttcccccaattgcagatggtcgggattggagttcctagaggcagagttgaaccgcgaggtggaggtccaccacggccaccgatgtcagctcgttccagggacgattcggatccactagcagcagcgaccatggatttccaggcggctggtgatgaaattgtccccttcaatctttctgcagtggtagtcagggacgacggactgaaatctggctggtcctgttcgctacacctgcaatgcctctgctcggcgattttttgttaattccacacggagggtgtgggttaagcttggccttcaccatgagtcgtcatcctctagctgttggtatacgtctggtccttgtacaaggggataaagcttggtactgcgcgtgtcttgtatatggatttttcaagtgggagtggtttctgcaaagtgatatttaattgcctcatgaactgctagtctcttgtgcctagtttctcaagtaaaagttctaagaaatcgacaagactttatattcagactgatggttgatagaaatgacaacactagatatattattgcagacaatgggtattaatggttgatgatactaatcttgaagatttggataataataacaacgcatatgctgaccagcaatcccaatcaatgcaagtcaatcgtgcactctacaagaccaaaccataaaagatcaaagaattttagtgaccatgaagatgaagttttggtttcagcgtggctgaatattagtttggatcctgtggtaggcaaggataaaaaggtggaaggtattggtctcgtatctatgattatttccatgaacacaagacttgtgcatcaaagcgtatcataaattctcttatgcaccggtgggagaccataaaaaaagtgtaaacaagttctgtggatgtcttacatgtattgagttaagacgtcagagtggcactacaatgcaagacaaggtacatactgtgggggacagatatcccccgggtcca

SEQ ID NO: 348 - DNA, 2705 bp, Zea mays
atctatttttattcctagctttttattaactctttaaactatgtatcttaattacttgatttaccgatttatctcaatcgatcatcacaatatacacgtgctaaattaataacatttattgagaccaataattctattcactctatttatagacccagttaacgggaatatgaatcaacttaccctgactaattcgacgcgatagtcgcaatcacgactacgggttccggttgacgtcatctaggggccttcttttcttcggtaatcaattgttgaagatcttttcttcgattgaataattcggacgaatcgaacttgagtcgcgcaggatgtccaagcttttgtcgcgcacttggtgaacaccacgctgctagcttcgtcttcacccgatttttgaaatttcttgctgacacgcggaacgacgacgatctccgatatgagctatctgtcgagcacccggtaaacgccatgcgggtttcttcacccaatttcccagaattcccctccacgcgaacacaacaaagcgtggacgacgtgcagggctggcagggtctccgcgacaacgggagcaaagatgtaaagcgaaggcgatggtagagacaagatcgatagccggttcttgcattatgttggcaggtggcgagcagcgagcatagtagcgtcttcacggcttactgtggacacggtgtgacgtagtagaatacttggcaccgagcagagaaacagtgtgttggggctgcaggtccgggcgggatcgacgacgcgaccatcctggccgagcagggaactgcgtgcgaccacgacagactagtcggccagcacgaggaggcgacggcgagcgatggcaaccgggaggagcgcgcaatatccaggacggcctggctgggtgccgaaggagctgggcagcagggatcgaccaccatggctgggaacgggaacgcgacgcggcatggtcagagctagagggagctgcgcgcggcgtgctggaaaaagcaacagaacgagcgcgcgggggagcagagaaccgcgcgcgcataggagcagggagaagcacgcgcagagggcgagcagggacagaggaccgcgcgcgcaggggaacttggagaaccgcggccatgggcgagggaggagctcggccgggcgtcgagaggaaaaggaaaggcggctgggcgcgcggcaacaggaagaagaagcagcgcttgagagaggagaccggaggggaggtgtccagcgcgacgaccaccagtggaaactcgcgcacgttcatggcgatggggcacgagcagggaggaatccgaggggaaatcgccatgggagcagctcgatctggacgaaatccaagcaggaggattgggcgcgagctggggcggtcgagcgctgggaataggaagcgccgagcagggaggaagaagctttggggagatgggacgagcagaggaacttcgacgcgcgcagggaggagccatggcgagtggctgggctgggcgcgcagagaaatcggctggggagtgagggggaagcagctgcgtgcagcgaggaggttccaggggcgcgcccgcgcggcaccagggggaagacgagggcgtagggagccatggagaggacgccgggaatctgagttgaggctggacaccgcgaggaagaagacgtgggcgcttggcttcggaacttctgccggcgagtaggatttttaacagcgcggcggctgagatcttttccagagataagatcggctggaaaaatccaagctgcgggcggctggaggataggatcgcgctggatttttccacggatccagaacggcggccggatgaagatgagcagaaaaatcacggcagaaaaaatcaaagggagggaggagagcgactgtagatagagatgaacgaggatatttttccctttttttttttagaaattacagatatttcggatcacgattcttttagcgatgtatacggggtagacagtaattatgacgcggttttatttagttgaacctaaacgaatttcgcaaatgcttttaggtttccgatttttagcgctgtacactgggtcgatacactagttatctacgcatcccattccccgaatctcgaaatggaaatccgaggactaatgatttgatttggcgaattctctaaactcggacggaatcgtgctgttaattcacttttgagatttaaatcgaggcgagaaacaaatggaccgaaccactatagttttggcttcgaggatttgctctgcgtaaattgaatgaagttagacgaaaccatatctgcgaaagcacacatgatttcgtcgctaaaacaacgtgcagacggataaactgaatcatattcgcacagacgatttcacttagacgacgcgcgatacagattattttgcctcgaacactttagtcgtggaagtctgattaatttgttcgggataaaatcatctagtgggtcgagcttccgaattcgtgttcgcgcgagcgatgtattttaaataatcatcggacgcaccgattttcggaacaacgatgttccgaacatcacgaaaatttcggaagagcccggatagataaaataaaaacgatgtcgcacttgcgacaaatgaaatagatgcgatattaaaccgcgatagatgaaaataattagaccttagtgtccaacttatttactgatatcacgtgctttaatccgtactcattgtcgagcggaata

SEQ ID NO: 349 - DNA, 2730 bp, Zea mays
tcaatccgatttcaaaaatcaacatcggcgatgatttttaggtgtcgcaaattgtttctttcaatcataaatccgaaagtcggtcatatctcaagacgatttatttttgaatcacgcgtaggaaattatttccgagcgaattcaaatcagactctcggccgaattaatcgctcaatcgtccgttcatcggaactctaattcgctctgttctccgcaaaaacgaattccgcaggagcatttttattcctgaaaataatttagcgcaaccccattcagtattttgggccaagcccattccagcccaataggccaactaaggaaccctaaccctagcccatgcctataaataggagccctctcccgttgcacttggcaactttgcactcccacccctccatttctttcagccgccacaaccttgctaccctgtctcttgttcctcacgacagcagcacgcgctccttctcccacacggcagcacgcagggagctccctccctgtccatggcgtctcctccccttcctcgagcaagctgcagcgcgcgcgtagggcagcaacccattcatttcccccgtggatccatggcgctcggcagcagggtacctccccacgagctccctccatcctggtttttcttgggcgctccatgcctctgccctggcttgagcaggccggtgtttcccccagcgacgcctctgctccatggccagcgcgccccttcttcctcactggtttccacggcggtcagcagggagcccagtttatccctccctgcacccagctcatatcctctgcccagtaccctccctcctctctatttcccttgagctcaagtgcagggagttgcgcccttcttctccacagcgctcaacgcccctccccctgttgttccctgaaccccattttcttccatgtaaaaccagcaggaggcccccctcccctcaactccaatggtgagcctctccatggccggtgccccgcgcagcgcctctgctcgactccctctccgcagcagcatgctccggatttctgtacgccgacatggagttgcgcagtcctggcccaaagcgtcgcgtgggtgtttggccagccccatgctgcgtcgttgatctgcgcggttcgaccgtctcctcgtctcgcttcgtcgggtctacacagcgccggcgtgccgtcgttgaaacccgtggtgagaccccgcagtcctgcgcttttcgtgttcgattgaatggccgcaccaacaaatcgtgttataaactgtgtcgtgctcgcagcccgtgtcgtcgtcacgcctcgcgcgtcgctcgtcggcaaagagcccaatctgatggcatgcatgtgcaactccgatcggatttcggccaggttgttcgccttgaatgattcgcgatttgttttatttacgtatttggtcgatgatgtgcatgtgtgaatatgtgcgtgaaattataattgtatgaatgcatgcgtatatagaagaaaatgaagtagaacaagaactcggatgtttttatatcttggtaggaaaaatatgtgatgcgttgtttgatgcgaaaaactaagttacaaaatgcggattatgttttgggagatgcatcgataggtgtttatgtgaaaagtgtaattgttttatgcgagtgatcggtgattgggattgtcgaggcgaatgaggagtatgagtaatcctgttggagtcacttgtacggttgatgccttgtgcgtattatggggacacgtaggtgcgtgggtgagccgaggtgttattttgttgttggattggatagatatgtggctgcgatagttccttggggcgtcgtagggattggtcgcgaatgtgttaatggtttgctaacatgcttcatcgtacattaatgtgttagtgcggcaaaaatttggtaaatcctaaagcatgcttggtgacttctgcactcggctagtgagtcagtctaggataattatatttatgtgttcatcgttggtgtaggttaaattaggtgaaaaatgtaaatttcgtgacataaaattggtgtttggaagatgagatagattaatttagaaagatgtgttatcaaacatgtgtgccgaaatgcgttgtagtagtgattgcgttaacttgaacaaagagtctcaagtgcatcctgtgctatggttgtatttgggatagtaaattataagagttgcgcaatatgaggttcgatcgatgtagttaatattgagtggactgtagagaggtggtgacatgccgaagtagtcatcacttcctctgcggttaagttgaggtcatgtgtgatgatgctatttacgtggtgaatgtgtttgttgaatgttgatggtaattttagtgcactaaatgacacggataaaaattagtagtgctcatgtggtgtctaagctaagatgcaaaatattgggtgaaaagcgcttcgatattgattatcggggagaacacgttgttaattaagtatggtacttctagcgcccgaaataacttggataaaattagtaagtcgacttgttgatcctaatttgattgttgtaactctaacaaatggtaaagtgttagagtaattctagtcgccaggacagggtaatttttgaagtaaatagaagctgaaaattattagttgctgttttggactgcacgcagtgatgtcctcgtgttaaatgtttgatgaacaaaatcatgttttctgtagagaagctatatggcttctctatagaaaacatgatttt

SEQ ID NO: 350 - DNA, 2697 bp, Zea mays
atttaggtcttgttcgctaatgaacaagccctattgtaataaagtacaatacatgtgtgtattgtactttacaaaccaatagcatagtctttcagtcctatttaggtcttgttcggcaggttagtatttattacacaatgggatctaatacaaggctggattgagtgaatccatctcatgtcacctaaaccatgtgtgtttcaattacaactaggatttaatacatggcccattttatactgttcggttaatccatactgacatcacacacacctacggtgaggcacctttcagttgatcggcgctcaatcacagctgacttatgctacgggtaaaacatatatgagttatgaggtcctatgggaaaagaacaaacttgagttaaaccataacacaaacatcatagcaaattggaccttatataactaacatatgaaagcaaacttgaggagcagcatgagaaacataagacatatagcacaaaaattggaataacatattttaatgtcacaacatcacaacatgataaatattagatgcaatccaacatccataaaaaaccatatggataaaatcatttgttgcatgcatataaaaagattgatgcaccacatatcaggttagcgaaataacagattaaacttgaagcatcaaaatcacaaccttgttgttggattagttctgttgtctcttattatattacaatagagtgcttgcatttagattaaaaatcaaacaaaaggcaactcagacgactccacctgcaagagaatacaaacgttaaacactagaattgtctgaaatgcacaagggactatgaatgtcatgaacatgtgagcagtgtcaaacagtgagcatagacaatgtgaagtatagctttaagtagtgatatacaatggagttcaaaatgctatgcctgtaattagacaagcaatagctactctgcaatttcctactcctaaaaaaccagtcatctttgacatgatcaaacaaaaggagagaaagatgaatggttatgcacttcttgatcaactaccagcagaattagtgtttcatgaactgaaaccatacatagtgctgaactaggaggaatctagacaactggttgataactgatgcttcaaattttaagaaggaatatagacagctggttgatttcttcaatgtaataagccgatgtttaaatttttaattcaaagatgcaaggcccgacctagcccttcgtccagggaagcaaagaactcggatattatgtttcacaacatgcttgaaatcatagctggaaagaggatagatgagggaagaggggaaggaagagagtgtaccagctaacccattccgtttcaaattatgtagaactgcaaaactgcagtactgtttcggttaagctaatcctaagcaaaactgctttggttcaagttatgcaaagttaattttcaaatcaataaaaccgtggtactgtttttgaattaaaagagaaatgcacaacacgaataaacagctaatgtacttctctcttgaatacatgctagaagtaattatagtctaattatgaacagataacctggatctagataaacagataacaaaattaaggcaataaacatatttctcctctagcaataaacatgctctcgaattaaaagagatatacacgacacgaataaacatataacctgcagctagataaatagctgcaaattctcctcctctattgaagtatgcagagttttattggttcaatctaataatactgcaggactatttcatttgcgtcccttgcatccagataacctgctagaagggaactttactcttttcgaattaaaagagatattttgagcaaaatctgtagcctagttctttgcagtagtctagttctttgcagataaccttgagtagcctagttctttgcagtggcggaaacttgatgaaataaaatccgtatgatgctagctaggactttggagaagaatacaaaagctacggccaacctctcgtataccaacccattattgtttactgaatcagtggcatgtatgcttggaaaatacaaaaagttcaatacgaatggaggaaacacaatctggatgagctatagccgattgacgtcgaaggcaaatgctactgcttttctatttggaatcgagattcgagattgctatagctggttacagcttggttagattcagactaggaagtaacgaatttcatgcacagatccttgcagcagcagtagcagccacgccgcctagcctcttctcaacctcgctggcgttcaactctgttctgccgaacaccatccgacatgcctcggcagggacatcacggcaggaaacccaaaccctaggacatagatatggaagatgagaaggggaggaagggaatgacgaactcataggatcgctgatgaagagggtgggcgacgacggaagaggtcttgtgtagccgtcgtcaattcctacgaatcgtgccgccgccatcgcaccgtgacatggatgagttccacggtcgttgatctgtggattgattccagacctggattgaagtttttcatagggattgagcctggtttacaaatatgtgtgggctaaacgaacaactatttcttcatggactggtatttgatacagcccgggatgacacccctggatcaggcggtcttcccggtcagttccagcccaatcgaacaaagcc

SEQ ID NO: 351 - DNA, 2697 bp, Zea mays
ccaaacaagtgatgtttacagtttggcaatgagcaaattttaatgtaattttcctaggttaaattgttttatgataattgttttttgagtggcctcaaaacatgcaatattgtccataaccaagagtcatttaaaatagcagtacatatggtttaacataacatgcctaaactagttttgtttatagtctggcatagagcaaattgtacttaaaattggaatgaaattttttctatatttaattcttttgttactaatatcattggtataattgtaacaaaataataacaaagtattttaaaacatggatcaaaataaaagcacaattgcataaatatagctctcaactccggaaaattacagatctaaaaaatatacatgttgcactttaaacatttctaaagttacctcgttctccatatctaccaactctagtgcctgcattcgaacatctaatatcttgggccccaatctcatgctataagttatcttgcacttaggttgatgatgaaggaggtgaaacaacatgttggatagctcacgcctatagtaaattgatgatctgaaaaatatctatattttatgcttcaagcgcttctagagtcccctcgtcctttatacgattaaatccagtgctagcatgcgacaatctagggtcgcatactcatgttatggttgtcttgaaaatgggttaatgatggtgcacgcaaaacaacaagctgggtccatccataaaaactatctgtctaaacaatacaatattagggctttaaaatgcatggaagttgatgcacattagaaataaatatatcatgtagtaaacttgcacgaaattaatacacattagtcccatactcaagttttgatcggccttaaacttgagttgatgtgttcacaactgaggaacattgcaaataacactatatatgttttaaggtaacatgcataaataagtatgtcttacaatacgtcatttagaaaagagtaatgaaagtgaaaatataatttttcttccattaactatttttccgttaaaagaggtcgtaattctgcaaaatagtttatcttgaaaaatctgcatattgcaattcgaatacttttaaagttacctcattctttaaaacattgaactttaatcggcatgcgaccatctaattatgtgggtcccttactcaagttattgattctgttgaattttaggtgatggaggagcgtatgaaacatgttggataattctgtaaatctaccacataatttagggctttgaaaagcttcaaagttttcgcatggttcatgccaaaatctttttgagaaaacaagcacaaaatcatgaccctttactcccaaatcagtgcattgcgaaaactttgatgacaaatcttgttgggacatttttgtaaaaactaccgttctaaacattacatcatttagggctttgaacggcttcaaacttacattaatgtccataaccatgaaacatttgaaatctttcaacatatcttatgagataacatgcccaaacaattaatgtttacagtttggaaatgaaaaaattgtaatgtaattttccttggttaaatagttttgtgataaatatcatgagtcccatacttgttttttgagtggcctcaaaatatgcgttgttgtccataaccaagaaccattaaaaatagtgctacatatggtttaagatagcatgcctaaactattattgtttatagtctagcatagagcaaattgtaattaaatttggaatgaaattttttctatacttaattcttttgttataaatatcattgatataactgtaatagaataataacaaggaatcttaaaacatggatcgaaataaaagcagaattgcataaatatggctctcaactccggaaaattatcgatctaaaaaatatacatgttgcactttaaacatttctaaagttacctcattcttcatatctacacacgatagtgccagcattcaaacatccaatatctcgggccccaaactcattctataggttgtcttgcacttgggttgatgatgaagcatgtgaaacatgttgcatagctcacgactatagtaaattgatgatctgaaaaaaaatctacatgttgtgcttcaagcgcttttagagtcaccatccttcatatgaccaaatctagtgctagcatgtgacaatctagggtcgcatactcatgatatggttgtcttaaatatgggctaatgatggtgcatgcgaaaaaaacaagttgggcccatccataaaaaatgtctgtctaaacaatacaacatttagcgcttcaaaatgcatcgaagttgacgcacatctgaaatcgatatatcatgcagtaaacttgtaagaatataatacccattagtcccatactcatgttttgatcggccttaaacttgggttgatgtgttcacaaatgaggaacaatgtaaatagcactatatatgtttttaatgtaacatgcctaaacaagtacgtcttataggacgacatttagaaaagagtaatgaaagtggaaatataatttttcttccattagctatttttccatcaatagaggtcgtaactctgcaaaatagtttatcttgaaaaatctgcatatagcaattcaaatacttttaaagttatctcagtctttaaaacactgaactttaatcggcatgcgaccatctaattatgtggg

SEQ ID NO: 352 - DNA, 2696 bp, Zea mays
acttaacaatttgtgggatgtgtttttggtgacatccattatatttgggaaaatggggtgttacaacgacatttagaaaagagtaatgaaagtggaaatataaattttcttccattatctattttttaattaatagaggccgtaaccctgcaaaatagtttatcttgaaaaatatgcatattgcaattcaaatactttaaagttacctcattcttaaaaacactgaaattgaatcagcatgcgaccatctaaaaatgtgggtcccaaactcaagttattgattgtgttgaattttagttgatggtggagcgtgtgaaacaacatgttggatcattctttaaatctacctcataatttagggtttcgaaaagcttcaaagtttttgcatggttcatgccacaatcttttcgaaaaaacatgcacgaaataatgaccctttactcacaaaacttgttgagtcatttttgtaaaaactaccgttctaaacattacatcatttagggctttgaaccgcttcaaacttatattaatgtccatcaccatgaaacatttgaaaattttccacatatcttatgagataacatgcccaaacaagtgatgtttatggtttggcaatgaaaaaattgtgatgtaattttccttggttaaattcttttgtgataaatatcatgagtcccatacttgttttttgagtggccccaaaatatgcattgttgtccataaccaagaatcattaaaaatagcgctacatatggtttaagatagcatgcctaaactattattgtttatagtctagcatagagcaaattgtaattaaaattggaatgaaaatttttctttacttaattcttttgttataaatatcattgatataactgtaatagaataataacaaggaatcttaaaacatggatcgaaataaaagcagaattgcataaatatagctctgaactctggaaaattaccgatctaaaaaatatacatgttgcactttaaacatttctaaagttacctcattcttcatatctacaaactatagtgccagcattcgaacatccaataacttggtccccaaactcatgctataggttgtcttgcacttgggttgatgatgaagcatgtgaaacaacatgttacataactcacgcctatagtaaattgatgatctgaaaaaaatctacatgttgtgcttcaagcgcttttagagtcacctcatccttcatatgaccaaatctagtgctagcatgcaacaatctagggtctcatactcatgttatggttgtcttgaacatgggttaatgatggtgtatgagaacaacacgttgggttcatccgtaaaaactgtctctttaaacaatacaacatttagggcttcaaaatgcatcaaagttgacgcacatcagaaatcaatatatcatgcaacaaactgtacgaatataataccaattagtcccataatcatgttttgatcagccttaaacttgggttgatctgttcacaaccgaggaacgttgcaaatagcacaatatatgttttaaggtaacatgcctaaacaagtatatcttacagtacgacatttagaaaagagtaatgaaagtagaaacataaattttcttccattaactatttttccaataatagaggtcgtaactctgcaaaatagtttatcttgaaaaatctgcatattgcaattcaaatacttttgaagttacctcgttcttgaaaacactcaactttaatcggcatgcgaccatctaattatgtgggtcccatactcaagttattgattgtgttgaattttagtttatggtggagcatgtgaaacaacgtgttggatcattctgtaaatctaccacataatttagggttttgaaaagctttagagttttcgtatggttcatgccacaatcttttcgagaaaacatgcacgaaatcatgacccttttactcacaaatcagtgtattgcgaaaactttgatgacaaaccttgttggatcctttttgtaaaaactaccattctaaacattacatcatttagggctttgaaccgattcaaacttacattaatgtccatatccatgaaacatttcaaaattttccacttatcttatgagataacatgccaaaacaagtgatgtttacattttggcaatcagcaaattgtaatgtaattttccttggttaaattgttttatgataaatatcacgagtcccatacttgttttttgagtggccttaaaacatgcattgttgtccataaccaagaatcatttaaaatatcactacataaattttaagatagcatgtctaaactattattgtttatggtctggcataatgcaaattgaaattaaaattggaatgatttttttctatatttaattcttttgttataaatatcattgatataactgtaatagaataataacaaagaatcttaaaacatggatcaaaataaaagcagaattgcataaatatagatgtcaactctggaaaattaccgatctaaaaaaatacactattcaagtggtggtcatccctaaatatggtgttttttcgtatttgtttcttaactcgtgcacgctatgtttttcgtgaactgaacactttaacttatctcgttgttcctatttgaaatgtttgtgtaaactatgttggtgatgtgaagtttgtgatgtgtgaattgattatcaatg

SEQ ID NO: 353 - DNA, 2730 bp, Zea mays
ttggacgcgacctacctggactcggatcgaacgcgtgctggtccctgctcacgtccgtgggtggctccctgctgtctctgctcccgtgttgcccatgcggctctgccgagcacatgacacaacagctagctagctatcgtcgggacgtgacttctaaagacgcaaaatgatcacgcacaatatgtccttttttcgaatacaagaaaatttcctattttctgtgttttttcctgctaaagtaaactaatttgacaatttctttgcattccaaaggggccttatatctggaagaaatccagccggtccaccaaaataaagggagcgcatctaacctagacgtcattttcttgctgttccagctcgatcgcccatgtcgccgtcgactgggatgtttcaactacatggaaatgcagagttcatttcaacgagaaggcatcgttgcaacgtagagaaaacaactatattgaggaaaataccacagcccgaaatagacagttcaacctatcagttttctattttatgatgtttttaatgtaaaatagacatttcagacttatgtaatcctgaggtttgcagctcctttatgtagaacatttgatagaagagatgtgtcagttttatgatgttctaactcttgattttcaacacagacaaggtaagggataggctgacagaagaacactcaagaggtttgaatctcctttctgtagctgaatctaggaataaagaaattgctgcatgatgatcttgaaaaggtagcacaaaaagaaggcggagttacagacttgacagagaagctggctttgttagaaactgagaatagatgactggttcgaacgaagcattaaaaaagaaagtggatgctatgctggtcatgtttgatgagctacaggaacggtttggttttactcatcaagctgagaaggaagaaactgcagagaagctagcagttcatgagaggataatctcacacctgacagaggtacacacaagaaccttggagctccattctctagctaaatcaaagaatgaagaaattgaaactcagttccgtgaggctcttcaaataatataacagaaagaaggtgaaattaaagaattgtgtaagaagctagatgcccttgaaattgagttgggatattatgaggagcaggcaacggaagccactgccgctgaaaagaatcacaaggttaaatttgatgtagcacttatgttatatctgcagcacatattgttagaagtgaaggctaccttgagattgtgataggcttctgaacccatctgcattgcttattcaaagtttatagcaccagcaaggaacgatcatagtttcctacaaataagaaatgtttatagttactaaagaactacaactaaacatgttgatatggtggatatagatgaacaactaactgtcttaatatgtttctatttaggcaaaaggtgactcaagtgggccaaaaaagggaatggtgccttcaacttctcagattctgaaggtttggaggaatacttgaatgggaagaccatttccagcatgctttcaaccattaattattgtaattgcttacttatagagtggaacctacatagcaacaagcatccaatgttccgagaataagaattatgtgtgctggcatgacacatttatcaaattaagacgattttagaagaaaagcagcaccagctttgcaagctgcaattaacactatcagcatggcattggctccaagctcggcctgcatttcatgcaatatcatatctatttccatttggataaatttagttgccagaaataagggaacgaaatcaagatacaaaatattttatgttgtagtgctaagtggaaacacaaataaagtgaaaagaacatcattatttccaaacaaccaaatataactgaaataattagtatcctacttcccttatattgactatacccaatgtaaagaattgcagcaggccataggagtatcttacagttacaggaaaggaatctacaaacaaataaacaaacaggaattaccagaggcttaggagtagcaacggtacaactacaaacaaagataacgatccacgagatctgatgaaaccagaccagacatagcacagaggtacagggggggggggggggatgtgacatgattcaggttttacccacatagaaataatccaccggcatcagaagtttatcacccaataagaacccagtaacctgctaaccacctgttcatatagttaggcctcatttggattagttagtctagactacaaataaatcttgcattttagtctctggttgattttatttttacatgtttcaagatctttatccttgaccaaagacgacaatttttgcagctcatcctaaagaaaacgacatcatttcttttggcatttctcggtactatttgtagtgtaacaatttcatcatccttattttgggcacccaattgcagctaatcaacaatatgcaaaagctttttacttgctttagtagcttgctttacctctatgttcttacgcttaatggtcccattgtaagcttattccattgtcttaaactgtttccacataaaattttctttgtccttctctgatctcatgacattggaagctttctttagttttcttatctcttatctaatatcttcctcactttttttgtgatctgaattgtcgggactaaattttatttcataaattagtattgacaattcggatacccaa

SEQ ID NO: 354 - DNA, 2690 bp, Zea mays
gatgtgacatgattcaggttttacccacatagaaataatccaccggcatcagaagtttatcacccaataagaacccagtaacctgctaaccacctgttcatatagttaggcctcatttggattagttagtctagactacaaataaatcttgcattttagtctctggttgattttatttttacatgtttcaagatctttatccttgaccaaagacgacaatttttgcagctcatcctaaagaaaacgacatcatttcttttggcatttctcggtactatttgtagtgtaacaatttcatcatccttattttgggcacccaattgcagctaatcaacaatatgcaaaagctttttacttgctttagtagcttgctttacctctatgttcttacgcttaatggtcccattgtaagcttattccattgtcttaaactgtttccacataaaattttctttgtccttctctgatctcatgacattggaagctttctttagttttcttatctcttatctaatatcttcctcactttttttgtgatctgaattgtcgggactaaattttatttcataaattagtattgacaattcggatacccaaaaaattagagaagatattagcaaagagattaagaaactaaataaagcttacatgatcctaagattagagaagcaccatgcaatttcaacttaacaaacgaaaaacaattatgtgtgaaaacagtttaaaacaatggaagaatgttatggtgggaccattaaaaggaacaacatacaggtaaagtgggctacgaaaacagctcaaaaacttttgcataatgttgatgagctgcaagtgttagcctaaataaaggatggtgaaattgttagactataagtagtgacaacaaatgccaaaaataaatgtcatttgttgagaatgcgctgcgaaaattgtttctttgttaagcataaagatattaaatttaataaaaatgaagatcaacaagagactaaaacacaagagttagctgcattcgagtttagctaatccaaatgaggcctaactatatcaaatttatgacaggtggttagcaggtctaaaaatatagtgtcgcttgtttatagcgtcagggaggcctgaaaattaatctcgcatttacatgcgatcatacacccgacttaattttctctctttaaggtgtattttgttctatgggatagacatctctcatagttggagtcattgttgggttcatttataggcccaactaggtgtgctggagtcgggcaatgtaggatccgtctcctctaggtgtcaacaaaatcttatgcatgcttttctactacaaattgggtctcatgggtcaggaactgtcgtgcgctcttagtaatcgggtctctgtggtcagtttgacaaacatgcacattatagattgctactttcttatggagaagtaggtaacttgttgtttgactttttgggcctactagagtaaatttcccacgaggtcactaaacttgtctatagagaccaagttagagcatttttagagaggaaacacccatttctattaagtgtaatacaactaagtgttcttacgagtggatgtgacatgattgaagttttacacacataaaaattgactagccttagaagtttcgtacccaataagaccccagtaatctgctaaccatatgtcacaaagttcatatagttgggcctcatttggatcagttaaactaaactgcatctaactcttatgtttagtctatagaagagtggatgtgacatgattcaggttttacccacatagcaaaaatccaccggcatcagaaatttctcacctaataagaacccagtaacctgctaaccacctgttcatatatagttaggcctcgtttggattagttaatcaagactaaaactaaatcttgcattttagtctctggttgattttatttttataagtttcaagatttttatccttgatcaaagacgataaattttgtggctcatcttcaagaaacgacatcctctttttggcatttgtcgtcaatatttttagtctaacaatttcatcattcttcttttggcacccaattgcagatcatcaacattatgaaaaaactttttagtggcttcagtagcttgttttacctctatgttcttatttttaatggtcacattgtaaacttcttcaattgttttaagttgtttccacacaaaattcttttcggctagttatgctgagttttctttgtccttctttgatatcgtgatcttggaagctttctttagtttccttatctcttacctaatatccttctcacttttttaccgatctgaattgtcgggactaaattttatttcataaattagtactgacaatccgtatacctaaaaaattggagaagatattagggaagagattaaaaaactaaattaagcttacaagattctaagattagagaatcacaatgaaatttcaacataacaaacgaaaaacattatatgtggaaacagtttaagacaatggaagattgttatggtgggaccattaagagtaacaactcatatgtaaagcgggctactgaagcagctcaaaagattttgcataatgttgatgagctgcaagtaggagcttaaataaaggatgatgaaattgttagactacaagtagtggcgacaaatgccaaagatagtatgtcatt

SEQ ID NO: 355 - DNA, 2683 bp, Zea mays
agaactcctcgaagacctaggtgtactccctgtggcggcgctgcgcatccggccttggcgatggagaactctttctcagagacctcggtgtactccccatggcggatgtgaagatgccttgaattaaaaagaagtgctagaagtgcacataaagactttcaaacctgataaagaaagagaagcagttcatgaggaacaatagattaatcacagatcgcatgccttggctaactggtttcttgaaatcaaccttgtttaatcatggaggagaacttaattgctgatgaacaagacacataaaaaactcaccaattaatgacacattaattgaatgtttgaatcattaccttctcatcatcagaaccatacaattcagcatctgcatcagaaaataaaaggtgtttatgtagaaagatagaaggcagagaaacagagaacaccataagacataggaacagagaacaggtacatactatcctttctcttctaggtggctcaatcaagtttcttgaaatcaaacttgttttcatccttccagtaatcatggaggagaatttaattggtgatgaacaagacacataaaaactcaccaatttacgacacatgaattgaatgtttgaataattaccttctcatcatcaaaatcatacaattcaacatatgcatcagaaaataaaaggtgtttaggtaggaagacagaagatgtagaaatggagaaaaccagaagacacatgaacagataacaagtacatactatcatccatcttaaatttaatggcatcctctgcgaaccttttcatttttgcatcaagttctgatgttgctgatcgaatccgttctagatatcaaattacttcagagttggagattatcgcattgttccctatccccgcattattgtctatgaagcactttctacagagagcaaaagggaatatattagggttgaatagtaaaatatgatgtcaaaggagttggaacatcttacctcagtcctcgacgttggcgtcacaaatgtcagcagcagtagcaaccgcctgtcttcctcttccttgaaatctgcatgaagaaatcaatatcataatacacacatattagtggagtcaacagagaagtttttttaataaattgtaaatagtgtctaccccttatgtgccttactaacatatatatatgatttagaaacttctcatctggtccttgtcttataattcttctggcaatcccaatacaatgactaaagaaagagtgaaggtgtcttacttacatggaaatagtgcacactaaaagggttaatctatagacgctgaaacaaacataacttgtaatagataattctaaaagggtgaaggcgatcttacttccatggaaatagtgaacaccgactttgaccaacatagaatataccacaatcatttgttccaagatacgggtaccaagtcctaaaaatatgtctgtgtgaagactgctgaccgtatcatgctcttggctcccaacaaccctattcctaggttttcagtccaaagcgcagtgctatcgtccaaaaagaaaaaggaagatcaaaatgtcatggcaacgcactcctctcgtacatctgcaaagaggtcagagttgttgtatctctggccgccacttaggaatacagtccaaagcgcagtgctatcttccaaaaaaaggaagatcaaaatgtctcggcagtgaaactgccacgcgagaagagtcgtttagttaggatgtgtgtgcgcacgtgtgaaccttcaagtaagttgccagttttgctccgaaagagatgcccacaagcaggccctcttccatggccaacctcctcgcgttcgccatggcctcggggtcacgatgacggtctcgttcgttgatgaccatggtgtccaagactttaggtacgaaccctgccctactccctggatattatgcctgacaggcgcgccacctgaagaacaccaataatgcttatcaacgtgaagacacaatgctaaatcttatagcaaatactcactccgtcataatttataattcattagaatttttacactaagtttgactggttcatcttattcattttttgcgagtatcctttttatgactgtaatgaaatgagtatcctttttatgactgttcaatgaaacagtttttttccaataagtaatgagatgagtttgaagttggcaacttacaagaagatagatcgctatagtaagcatgaagaaaagcataggataatctggtatgaaacaaagaagccattttggctgtccatttggcatgctagacctgaaaaaaacttggtcacagtgtagaaaagcaaggtatttgagcaacatttttagttcagttgaattaactattgctatatgagaaaaaatatcagagttgaccttatatccagcatgctatatagttataggaatatattaccgcaaggctaaatggaagtacctccaataattaggaaaaaatatatgtagcagtgacacaagaatcatacctaagccaaatatggatctgagaaatacaagtctctagtataatcttaccaagccatctgtcacaaatagagattaatacttcacgatcgagtaagccaagaaaacacatgaagaatgtaggtattaaaagttgtaatgcaaattcaaatctaaacttagagatctaaggataaggtgag

SEQ ID NO: 356 - DNA, 2683 bp, Zea mays
aggccaggtttcttacccaacgtctaataagtacgacccaccctagcgacacaacttcagattagacttgccctggccttagttgcaaaacatccaagctaaagcagaaagggcaaccataacataggagatgtggagtttagtggtgaattccaagcttcggatcccactgtggtggatgcattttaacccatcacatatacctgccgttcactattatttagtgaaatgagatattatgatattttctgaattgtgattaaaaaggcaactttatgcccatgcaacagaaactataaaaaatacagagaatgaaaagaaacagatagattttttagttctttaggcccgtagtctgcaaatccttttatgattttctatcaaacaaaagaggaaaatagaccagttgcaatccaaacgagagtctaatagaatgaggtcgaaaagtaaatcgcgcgggtttgttactgataaagcaggcaagacctaaaatgtgtaaagggcaaagtgtatactttggcgtcaccccttacatattttaggtctttttttattgtgcgtaactaacttgccatcttcaaacaggagggctggaagaagcagaccgctaacacagtacataaaaaaggagacatgaacgatgaacatcaaaaagtttgcaaaacaagcaacagtattaacctttactaccgcactgctggcaggaggcgcaactcaagcgtttgcgaaagaaacgaaccaaaagccatataaggaaacatacggcatttcccatattacacgccatgatatgctgcaaatccctgaacagcaaaaaaatgaaaaatatcaagttcctgagttcgattcgtccacaattaaaaatatctcttctgcaaaaggcctggacgtttgggacagctggccattacaaaacgctgacggcactgtcgcaaactatcacggctaccacatcgtctttgcattagccggagatcctaaaaatgcggatgacacatcgatttacatgttctatcaaaaagtcggcgaaacttctattgacagctggaaaaacgctggccgcgtctttaaagacagcgacaaattcgatgcaaatgattctatcctaaaagaccaaacacaagaatggtcaggttcagccacatttacatctgacggaaaaatccgtttattctacactgatttctccggtaaacattacggcaaacaaacactgacaactgcacaagttaacgtatcagcatcagacagctctttgaacatcaacggtgtagaggattataaatcaatctttgacggtgacggaaaaacgtatcaaaatgtacagcagttcatcgatgaaggcaactacagctcaggcgacaaccatacgctgagagatcctcactacgtagaagataaaggccacaaatacttagtatttgaagcaaacactggaactgaagatggctaccaaggcgaagaatctttatttaacaaagcatactatggcaaaagcacatcattcttccgtcaagaaagtcaaaaacttctgcaaagcgataaaaaacgcacggctgagttagcaaacggcgctctcggtatgattgagctaaacgatgattacacactgaaaaaagtgatgaaaccgctgattgcatctaacacagtaacagatgaaattgaacgcgcgaacgtctttaaaatgaacggcaaatggtacctgttcactgactcccgcggatcaaaaatgacgattgacggcattacgtctaacgatatttacatgcttggttatgtttctaattctttaactggcccatacaagccgctgaacaaaactggccttgtgttaaaaatggatcttgatcctaacgatgtaacctttacttactcacacttcgctgtacctcaagcgaaaggaaacaatgtcgtgattacaagctatatgacaaacagaggattctacgcagacaaacaatcaacgtttgcgccaagtttcctgctgaacatcaaaggcaagaaaacatctgttgtcaaagacagcatccttgaacaaggacaattaacagttaacaaataaaaacgcaaaagaaaatgccgatatcctattggcattttcttttatttcttatcaacataaaggtgaatccgacgtctgtgctggtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttactggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtc

SEQ ID NO: 357 - DNA, 2681 bp, Zea mays
tatattccgctcgacaacgagtatggatttaagcacgtaatatcagtggataaaactaatgctaaattttaaacatcttcgtctatcgcgattttaatatcgcatctgtttcatctgtcgcgagttcgacatcatttttgtctatctgggctcgtcctaaaatttttgtgatgttcagaacatcgttgttccgaaaatcgatgcgtccggtgattatctaaaattcatcgctcgcgcgaatccgaattcggaagcccgacccgctcggatgattttatcccgaaaagatgatgaactcgatgactaagctttcagtgtaaaataatttaattgtctttttgtcatccgtgacatcgcgtctacggatttttaattaaattgttctcttatcgagtgttcgagtagcgaacgaaattcgtctaaattcaactaaatcgaacgtcgactaaaatgtttggggtaaaataattcgaatcgcgcgaaatcttgtgcgaggttatgatccaatctatccttcagcacgctgttttggcgacaaaaacgagtgtacattagcggatcgggtttcggctagtttcggtcgaatcacacagaacaaattatcagtgccgaaatcagtttatttcggtctgtcgtttctcgccaggatccaaatcttcggatataagcaattgttaaataatttgattcactaaatccggagaatgaaatgtgtattcgtgtagcgtgtcgacccagtgtacagcgctaaaaatcgtgatccaaaaatatctgtgatttttgtaaaaaaagagagagaaagaaaaagaaattaaaattggaaaatatctcttttatctttatctcttgccgctcaggcgttctcagattttttcagtcacgcgcgtcttcatctctagccaccgggcaccggcccaccgctcgtccatggaaaaaaaaaccagccgccactatcctctacacgcgccagagtttcttccagccgcagagatttttctttcaccgcgcagctttcatctctatctcctcccgtcgctatttctgttcctgctcgcgatgtgaatctcctgcgcgcacttcctcccctgcgtgtccctgtttctctggtgccttgcactggcagccgcgcgcagccggcttctcccccagcgcaccgtccctgctcgtcctctactccatcctcttcccatccgagctcgcccggccaccgttcttcctgcgcgccctcatgtcgccgtgtgcccagctcgctccagctcgtcggtcgagtctcgactgcgctcggcctccagctctgttgtcgcgcaggtcgccggcgttgcccctgtttccatggctgaccgcgcggctcctctgcgctgccgtgggcacatgcctccctcctcgagcaccaaccggagttcgggtcgtcagccgccgtgctgctcggcttcctgcagcacatgtctagccccatgctgtcgcgttcctgctccccggcctccgttgtgctcggcagcaagtaatttatgtcgaagcggcagctgcgattccttgcgtcgtgctcgccagatcgagtctcgcgacgtcaatctatgcggttcctgtttggctatcggttccgcctacgtcgatctcctatttgtcttgcacagcgcctcgacgccccattacagcagtctgtcggggaactctagtgtttgacgttaattcttggtcgtctctaactttgtcttgttgtcgtcgttcagtcgccccgtctcgatacgggtccctatatgatgcctccgactcgtgttcgcaccgacaaaagaatcctaagaagatgtggagaagtgagccccaggtcgatgcccccaagtactcggcgaaaggccagaacaagaatcatcgccagttgcggagttctagttaatatggagaaattccaagaattgaggatggaagagaaagtgaagctccgttctatactcatgaactgttttgatcgaagattttattaggaggctgtcgacgttctcgcaagctttgagttggacttgctttggatgagaaatcactgatgttcgagaaaggcgaggcccgtaagcgctctcttgggactcgaccaaatgactaaattggaaaatcgtcatcgctctcgtggatatcgaatccattcggtcttggtaagccaatttattatttcggttaatcgaattggattaactagcagatgcgtcgtgttcgtgttagatgtttactaaaatacctcagcccctccggtaatgtaattgtgtcaaataaatgcgtaatatggtgcgccttaggtctaaaatgcaggataaatgaaatatttaatttagtgggacttatgctgcataataattgagaatagtaattctagaagttaatggaatgatttctatttctagtctaagtttagatgttgtgctctagtcaagagagatagagtgcctgtaaacggttcgctatggtttatgatattcctatctatatgcatttatatgcataatgcatttcattcaggtacgttaattaatcgcgtaatgcggaagacaagctaggtcgatcccaagcgcgggctaatccgcatggtgatgctgatggacgaacaggaagatggataacctgatcaagtactaggacaaaggatagtcgtcaagtggacgtcacctaacaacactaacctagtgttattc

SEQ ID NO: 358 - DNA, 2680 bp, Zea mays
cctagtggccaggcacataataacatttaaaagcaataactcagtgctgagatattactaagtacaacgaggacacttctctagccttaaacggatctaactcaaacatcaagaacaatattctgaataagtcctataccatcattagctaacgcctaatgtcaaacgactcgccaaactttgattcactatttttaaataccaatagctcagaatatggatagaaatatattaatcaactttgtaaaccacttaaatcctaaaaatttaaaacactaaagatcaatgtccactaactagtttttaaggcggaccaaacgatgttcctcggattttgactgaaattgattttctgatgctattctcctttaattattcgggcagcagctaatacctactcaaggcatttaacaggtcacaagatatcgatgataatgactagtagagcaaggtatcgactccatcgcataaccaaaattcggcacaacatcactgtaaaaacactaaacttattttatgtctcatcaatattatattaaatccacgaattaagttaattaacaggaatagcaaactaaattcaccattatcgactcctaaaagtaacatatggataggcaaactaacacacttaacacaattagcctaaacagaacttatcggctaattaaatgctaaagttatccctcgcattattaattataccacctcgaccacaaagaactattttaattttattttgcaccacacatatttattcaatctatctaacattttgactaacaggaataacaaatcagctggccatactaaaatttgaacccacgaaatggaccacgctacccggtccgcgcataatactagacaccccgcaggcgttgcacacctacatcttcgacttctcccaaacatccgggatttctcctgtccataaaatacatatatgcacataattaatcacagggtattgacgccgagtaagaaatcgagtaaagcgataatagcaagtcactagcgagtagcgatgaacctgatgacttagcaatacttgaggttgaggatggcgagcacgacagactgtgctgagtggatggagacgaacaccaagatgagggacacgtggtgccgatgttggggagggcgatgacgtagtccgacgaggagacgcaagacagcatagcaccagcagggtggcttgctgtgggtagtgcccccatgtcaatgacaacggacggcatggacgaagtcaagagcagccacgacggagaagctgtgatggccggatcgacggtggtccgagacggtagctaccggcacgaacaagggaggaacggcgtggctttgtcgagctggggctgaagacgacgattgacggctatagggctggggcgagcccacgacggcgccgcagatcggaggtagaggaggcggccaaaaccgagcattgaaaaccatggctgcagctccgacggcttggggtcggactcggcgatggcaaccagggccaagggctggatgcagctagggcgcgacgaagggagctgcacgtccagagcgagctggagaaggtggccatgggtggagctcgaaggcgagctcaccggcgttgacgcaagggcgagatccgagcaccagggagcagcgacggccaacagagagagagctcggactggggcgctggagacagcaaacagagggtgaggaacagctgagagcatgtgctgaccggcgaccaaagcttgaagaagacatcacaaattgctcccaggcgtacggtatagaagtcactagcgttggagataggaacggctggtttcagaatacgtgacgtgaggcattctctggaaggagatatttcacaaatgttctcaccaattgcgagctctcatgaacgtttgttttgtttttttcaaggagctgacatcttatctgggataaaggtttaaaagggacaacaagaaattgaccgaaaataatatctgacataatatgtagacaagatttggttcgatgaatactctcagagttcgatgaccttgactagttatttattctgaagatctaaatctcgacgagaaacatatggaccaaactaaacgagatcggcttggatatttcaaactatatcaaatctagtttaaaacagataaacgtcatcggttctgaatattgggatttagatttaaaacgaggagtaaacgggccaatttaaagcgctatcgattaatagattattttattggatttttaaatagaaaagcgaatcggctaaccgttgttctagtttcatttagttcaagtttgatttattctaaacagtacaagcttaatattatcgctacagagttcgtagagatcgctcgaataagagcgaaataattaggtgacgtttccaattcgccttaatcgattaattttaaacccaaaagctttagtcgtcaacttctaataaatcttgtttgggacaaaatcggaggactgaactaagtttctaaattcgtgtttgcacaattaatgaattttaaataatcacaagacttgcgaatctccggaacaaatatgttctaaccttgcaaagctgttagaacaggccggatagacagagacgaaagtgatatcaaaattttgataggtgaatattaaaacatagagacggttattattgtcgatattccgtgct

SEQ ID NO: 359 - DNA, 2678 bp, Zea mays
  misc_feature (2512)..(2513): n is a, c, g, or t
ggcgtgttcgccttcgccccaacatctgcttttatttcgatccatgttttaagatactttgttattgttctattacagttctatcaatgatatttataacaaaagaattaaatatagaaaatttttcatccaattttaattacaatttgctttgtgctagacaataaacaatactagtttagacatgctatattaaaccagatgtagtgctattttaaatgattcttggttacggacaataatgcaagttttgagaccactcaaaaaacaagtatgggactcatgatatttatcacaaaacaatttaagcaaggaaaattagattacaatttttcattgccaaacaatacatatcacttgtttgggcatgttatctcataaactatgtggaaagatttcaaatgtttcatggttatggacattaatgtaagtttgaatggttcaaagccctaaatgatgtaatgtttagaacagtagtttttacaaaaatgtcccaacaagatttgtcatcaaagttttcgcaatgcactgatttgggagtaaagggtcatgatttcgtgcatgttttctcgaaaagattgtggcatgaaccatgcgaaaactttgaagcttttcaaagccctaaattatgtggtagatttagagaatgatccaacatgttgtttcatatgctccaccatcaactaaaattcaacacaatcaataacttaagtatgggacccacattaacccatgttcaagacaaccataacatgagtatgtgaacctagattgtcgcatgctagcacaagatttggtcatatgaaggatgaggtgactctagaagcacttgaagcacaacatgtagatttttttcagatcatcaatttactataggcgtgagctatccaacatgttgtttcacatggttcatcatcaacccaagtgcaagacaacctatagcatgagtttggggcccaagatattggatgttcgaatcatggcgctagagtttgtaggtatgaataatgaggtaaatttagaaatgtttaaagtgcaacatgtatattttttagattggtaattttctagaattgagagctatatttatgcaattctgcttttattttgatccatgttttaagattctttgttattattctattacatttatatcaatttataacaaaagaactaaatatagaaaaattttcattccaattctaattacaatttgctctatgcgatcttaaaccatatgtagtgctattttatatatttcttggttatggacaacagtgcatgctttgaggccactcaaaaaacaagtatgggactcatggtatttattacaaaataatttaaccaaggaaaattacattacaatttgctctttgccaaactgtaaacatcacttgtttgggcatgttatctcataagatatgtggaaagatttcaaatgtttcatggttatggacattaatgtaaggttgaagcggttcaaggccctaaataatgtaatgtttagaatggtagtttttacaaaacgacccaacaaggtttgtcatcaaagttttcgtaatacactgatttgggagtagagggtcatgatttcgtgtatgttttctctaaaagattgaggcatgaaccatgcgaaaactttgtagtttttcgaaaccctaaattatgtggtagatttatagaatgattcaacatgttgtttcacacgctccaccagcaactaaaattcaacacaatcaaaacttgagtatgggacccacataattagatggtcgcatgtcgattaaagttcagtgttttaaagaatgaggtaaatttaaaagtatttgaattgcaatatgcatatttttcaagataatctattttgcacagttacgacctctattaatgcaaaaatagttaatggaagaaaattaatatttccactttcattactcttttctaaatgtcgtactctaagacatacttgtttcgacatgttaccttaaaaacatatatagtgctatttgcaatgttcctcagttgtgaacacaacaacccaagtttaaggccgatcaaaacatatgtatgggactaatgggtattatattcgtacaagtttgctgcatgatatatcgatttctgatgtgcgtcaacttcgatgcatttcgaagcctgaaatattgtattgtttagacagacagttttatggatggacccaacttgttgtttcgcatgcaccatcattaacccatgttcaagacaaccataacataagtatgcgaccctagattgttgcatgctagcactagatttggtcatatgaaggacgaggggactctagaagcgcttgaaccattacatgtagatttttttcggatcatcaatttactataggcgtgagttaccgaacatgttgtttcacatgcttcatcatcaacccaagtgcaagacaacctatagcatgagtttggggcccaagatattggatgttcgaatgcaggcactagagtttgtagatatgaagaatganntaactttagaaatgtttaaagtccaacatgtatattttttagatctgtaattttctagagttgagagctatatttatgcaattctgcttttatttcgatccatgttttaagatactttgttattattctattacggttataccaattgtgacggaacctcccaag

SEQ ID NO: 360 - DNA, 2676 bp, Zea mays
aagtggccacaagccacgctagaaggaggctcccgtgtcgaatgcagatgggaacctagggtcgggacctagagagatgtgattagtctgacccagagagatgcgatttctttcaatggcatcatccggtttttcctcaatatatcacgaatttgttgggggacttgcgagacatagtggatgaactgacgaaggagattgatgcattacaaaataaggaacaagaacttaaggactctttggaaggtatgatgcagctattgaatttggagtgaaggtgtagtcgtgttcatgcagccttagcagtaagcccttattttgttttctgcctatttctcttttgtagccatgtcagttatttatactttgttctttttatgctgagaagggcttggggtgctagtgaccaatgtgctggtggttacctccattgtggcaactacgcacaagtagtagcacggaggaagtaaccatcagcatattgggcacacctccaccatccgccgtgacgctctcctggccaaaaggttggtcattgctgcaaggaggactagtcggctcagatgacaggctgcctcagctgctaccaagtcaggctacttagagtttgtagggtgatgtcatttggacctcgacgagatccaccactcgattatattgtactggatgctcacttatttatgttccaaattcagttattctatgatgaacgctcagttgttttatgtgccactcagttattttattctgaatagttattctaatatgtgcaactcagttattgtaatatgtgcaagttatttatgtgccactcagttattctaatggacgcactcagttagtctggtgtcagaactcagttattccattctaatacctcagttattcttgtgggccgactcatttattttcttctcgtgactcagttattctactccaatccctcaattattccgttataataactcagttattgtaacgtacccactcggttattctctgttcacaagtcaattattccgttccagtaactcagttattctagtgtggcgactcagttattcttgtgtcagtactcagttattctggtgacggaactcagttattacgttctactacctcagttattctaatgtgcacactcagttattctctactcattactcagttattccattctaataactcagttattctggtgtcagtactaagttattctggtgacggaactcggttattacgttctactacctcagttattctaatgtgcacactcagttattctgttctaataactcagttattctactgattacttagttattccgttctaatacctcagttattctactgttccgactcagttattctggagtcagcactcagttattctagtgggcgcacttagttattccatgttcatttctcagttattctcggttcagtactcggttattctgtgttcatcactcagttattctggtgacgaaactcagctattctctgctcgtgcctcagttcttgtgggccaactcagttattctactccaatccctcagttattccgttataatacctcagttattctaaaccctcagttattatgttataataccgcagttattccatgttcctaactcagttattctaatgtcggtactcagttattctaatgcgcgccttgagttattccatgttcaccactcagttattcaagtgacagaactcagttattctactccaatccctcagttatcccgtgtcatacctcagttattgtaatgtgcctactcagttattatatgttcatgactcagttattccgttccaacaactcagttcttctaatggacgcactcagttattctggtgccagaactcagtaattctgttccaatacctcagttattcttgtcggctaactcagtgattatgatgtgcagactcagttattctggtgtcggcactcagttgttcggttctgatccctcagttattctactccaatccctcagttatcctgtatcatacctcagttattgtaatgtgcccactcagttatgcggtgtttattactcagttattctctattcacattcagttattgcgttcaagtaactcagttatgctattgttcattactcagttattctgttgtgcacactcagttattctattgttcactattcagttattatctgttcattactcagttattctgttccaacaactcagttcttctaatgcacgcactcagttattatggtgacagaactcagtaattccgttccaataccttagttattcttgtgggctaactcagttattctcctccgatccctcagttatcatcatacctcagttattggaatgtgcccactcagttattattgtgtacagactcagttattctggtgtcggcactcagttgttcggttctgatccctcagttattatgttataatacctcagttattgcgatgtgcgactcagttattccatgttcgtcactcaattattcttttgtcggaactcagttattctaatgggcgcatatagttattctggtgtgatgactcagttattctctgctcattactcagttatttcgcagtcataactgaattattcagttattctctttgtaatcactcgatagtggggactccgttattc

SEQ ID NO: 361 - DNA, 2671 bp, Zea mays
ctgtaacacccaggtgtttatattttgctcgacaacgagtatggatttaagcacgtgatatcagtaaataaaacggacactaaattttaatcatcttgcaaaagttcgagtttggtgccgttttcatttcgataatttacacaattaaaaagggttcgagaaacttttggattatcgaatcttcgtttgctggcgaattttgaactgtttggatcgcgcgcgtaagtgaatacgaaaatcagaagacttctgattttatgtaaatttggagccccgcgctatccgaaaagaacaatgcgcacagcttctcgcccacatgtgcaatgtgtgacgtcgcttccggaaaggatcgcactttcgatgacgcatcgatctcgcgtacttatttcgcgaaatgtgagtctcgtgtctatttaaaaattatggattaagagaaaatgagattggaaatttagttcagctctccaatttcataccaaacagatttgatataactcaacgactaagttttttgtgtaaaataatttagtcctcttttgtcatccgtgacatcgcgtctatggatttttaattaaattgttctctaattgagtgttcgaatagcgaacggaatttgtctaaaatcaactgaatcaaatgcagattgaaataccgaagccgaatccgtttaatttagtctgttgcttttcgcctcgatttaaatcttcaaaagtgaattaacagtacgaatttatccgagttcagagaattcgccaaatcaaatcgaatccaaggatttataattgagatctgattctgtaataaattctctatggtagagaaatcccatttctctcttatcctctacgtgcttatcccttctgtttcctagccgtaagttaatttctttggaaattttatccatcgctcatctccttgctttctccttacacgagcatttcttgggagttaagcagctgatcaggatttctccacgttatcttctccttatccccaccgctccttctctctcctctcgatatttcctgcgcgcgccgctcggctctggtgaaagaaaatcccgccgcccctgttgatcttttcagccgtcgcgggataaaaattgcgcgcacccggccagagctcctgcgcgccttcttctctgctggctcggccccttccccgcgcgctcgtgctcagcctccggtggaatctcctcgccgtctcctgctgcgctcggaccgcgcccctggcttcccatgcccccccccctcccccggctctgttgccgcgcgcaaccgcgcttctcccagcctccatgcgctagcgcgcgtcgttctccctgcgctcgctcggccttgaagctccctgacgcgcgctcctgtgccatggtcgccgtggagcttccccagccgcgccctgctcgcccctgttttcctttctctctctcccctgtgcgcagctcgccgagctctccctctcccatggcgcgctctgctctctgcgcgcagtgtgcacgtcgcgatctcccaagcttgccatggctgccgcatccatggtcctgctcagatttcgccaagccccagtgcccggctgctcggctcctcaacggcgacgatggtcgcgctcgcccagctcgcagagctcccttgtcgtggtcgtcgcgtccctgcgcccagcctctagctcagtccctgtgcgcgcgagctcgccggtgtgctgctgttctaactcggatctcgcccatgaccgccggtgttcgccctcttgcgtcgcgcagcggcccatcctgctcaccgtgaccgagcggtcgccctggtgtccttcccaagccaactcgccctgcgctgacgcagggttcagctcagccctgtccttcacgctccctactcgtcctcgactctctggtgtggactccctccgtcggcgatctcctctggcaccagctcgcgcgtctgctcgtcgtcaccgcgacgcggacgttctctgttcgcttcgccacagcacccagacctcctcttctgtgtcatcgacactagtctcgcagtccctccttcgatcttgctgatcgtcgatgcgttgcacatgtatggcaaggtaaagtcagctagctattggaacggtgagccgatttactatttttactattgattttactatcgtcaaataacatgcttagtttgcgtataaagtttaagttaaagatgccaccgatgcaaggtgtgcctcgaggagtttagttgttgagtatattcgaactagttttattttgcagagtatagtatttcggtaacgcttaggttaaattcagtattttatgcaactgtcgataaatctgcgatgctaattatgttcagtgcgcataagatgaagtcaatgtcctgcgctagtagttagtatcgtctatgtttgtgatcgataatgttggagtaggatatgatcgacgattttcttatctagtgattggtgtgatgtggtataatttataaagcgagggataagtttagaatttaattaattagctgataagttgtgttaggctaatcatattaaatgtgtataaattgtggtttcgtgatgtttgcgttaggttcgtttaatttagagaagcgtgattattgagcttagtcgtacgtcgataattagtgtctccgtatgaaattgttcaacgcctcaccgctaggtgtttaat

SEQ ID NO: 362 - DNA, 2669 bp, Zea mays
agtttagtcctcatctatgtagttaatttctaattaatactcgtgattgacatcaacattggctaaactttagataggggaaccctattgtaggaaaaatattgtgcagcccgaatgcaaattagaatatgtatggttttagatttgaaggttccatcatcaaaaaattcagaatacacattcagaaccacatttctcttttattagaaactcctccaatatctttcaatctatccttaaccgaacgagcacccagtgagaaatggatgttatggaaagcttttccagtccaataatgttttattcgctatttgtagtcagaagttgacactgaaagagactggagtatcctcttctatctgtaagcatgggaaggcgaacatgttcaccattgtcaaccgtggaaacaaacctctgggttttagagaggtgaagacaacaccgctctcacaaggtggcaaggccaagctaattcgcctccgtccaccccatggctcgggcaatcttggagcgaatccggcgaactcgtgcccgctcacgccgctgggattcctggagcgtgcggccaccgtcttcagcgactgcccctccgtcgtctatcacgacacggtcttcacctggttccagacacatcggcgatgcctccgcctcgcctcggcgctcgtctccctcggcatcacccgtggcgacgttgtaagcctcgattaattccgcaaattgctcaccgtacccctctcatccctgccggcgcgggaaaatcaataagtctgatttggttaaatcaaatttcttggcatttttaggtgtccgtgctattgcccaacgtgccggccatgtacgagatgcagttcggagtgcccatgagcggcgccgtgctcaacaacatcaacacgcgcctggacgcacgcacggtcgccgtcctgctccaccactccggctccaagctcgtcttcgtcgacccatcgtcgctgcagctcatcggcgacgcgctccggctactcccgccggggcacccgattccacacgtgatccccgttgaggatcctcacgaggagttccctgctgcccctgcggacacgttaacgtacgagaggcttctcgacaagggcgacccggagtttgtgtgggtgcagccggagagcgagtgggacccgatggtgatcaactacacctccggcacgacgtcggagcccaagggggtggtgcactgccaccgcgggaccttcttgatcacagtcgactcgctcattgaatggtcggttccgccgaggccgacgtacctgtggacgctgcccatgttccacgccaacggctggagttacccgtgggggatggccgtggtgggcggcaccaatgtctgcctccgccgcgtcaacgccgccacggtgtacgccgccatcgcgagccgtggggtcacccatctctgctgcgcgcccgtggtgcttaacatgctggccaacgcccccgagggcgtgcgacggccgctccctggaaaggtgcacgtccgcactgccggctcgccaccgccggcggccgtgctacagcggacagaggccattggcttcgaggtcagccatgggtacgggctaaccgagaccgcagggctgccggtgtcctgcacctggaagggtgagtgggacagcctccccgcgtcggagcgcgcacggcttaaggcgaggcagggcgtgcgcacgccggccacgggcaaagtcgacatcatggacagcgaaaccggctgcagcgtgccccgcgacggttccacgatgggcgagatcgtgctccgcggcggctgcgtcatgctcggctatctcgacgacaacgcggcgaccaaggcggcgatacgcgaggacgggtggttctacacgggggacgtcggcgtgatgcatccggatggttaccttgagatccgcgaccgttccaaggacgtgatcatcaacgccggcgagaacatcagcagcgtggaggtcgagtcggtgctttacagtcatccggcggtgaacgaggcagccgtggtggcgcggccagatgagttacgaggcgagacgccgtgcgcgttcgtcagcgtcaaggactacgcggcgggcacggtgaccgcggccgacatcactgcatggtgccgggagcgcatgccgcagtacatggtgcccagaacggttgtcttccacaccgagcttcccaagacctccaccggcaagatccagaagtacgtgcttcggaacctcgccatggagatgggacccgcccgcaaggccgacggggcgacggccaacggtagcaggaggcagcagcaataagatgtagtggtttgttggggatttaaccacgcacaaatgcattccttgtcgtttccgagttgattaataacctttttttttgtctacttgatagtatatgtttccaagacgatgtttataaggaaaaacaaaataagtgaacatatcagttcattttaggacctaaagtaaagtcaaaagcgaataaaaaatgattcactttacaagatgtgaggtgaagtcaaaagtgagtggagcactggacgcgaaacctcactgacaaagatcatgtgccgagaagaaccttagaacatgtatctacaataaaataactgaatcacccttatataaataaataattgtatgtaaataaaatccctgtcgtttcgaagttaa

SEQ ID NO: 363 - DNA, 2666 bp, Zea mays
acctagaataagctgactaattaagaagggcatcgacttcaaccattaaccaaattgacataataatactagaaaatctatttttattgctagctttttattaactctttaaactgtgtatcttaattacatgatttactgatttatctaaattgatcatcacaatatacgcatgctaaattaataacatttattgtgaccaacaattctatttaatctatttatggacctagttgactcgaatacgaatcaacttacccttatgacatccgacttgaaaccacgatattgacgacgccttttagctcagcatttcaccgaaaatagggtgagtgctgtgtagaatcgcgcttcttctttgtccacatcgagaagtctccggctgcgtactaatttatttccttctgcgcctaatcttcttggatcttggcgtagacgaggatgacgatcgacgacttgtttgagcttttgtagagcacttggtgaatatcacctggctagcttcgtcttcacctgatgcttgggatttcttggggatgcacgaacgacgacgagatcgagtttggagcgagctggcgaggtgggggtcgagcagaggatgacgggttcgacaactcgacggtaaacgcgagcacaccaaaacccgatggatgaggagcgagcgcacgcagggcaagcagcacggaattgaaacgtggagaaattgcccactgcgaaacaaactgagcaaggagcgctcgtgaactttatggcagaatcggcggcggccgatgctagagcgcacggcaaggaagttttacagtttgatgggaccgtggctgagcgaattttatggcgtggattggggaagtacttggcgaaacggtaacatcatggcgacacgcatccggggcgcatggaactcgcagggttagatcttggcgaggatgagcacacacgacgcgacgacgacaaccggtgaggtcgttgacgtgatggggattaaggtcgagagggcgcgctgacgagcaggaaactccggtcgacgcaacaatagggaaatgggcgcgcgcgtggaacagtgggcgactaagcgaaatccgagcagagggcactgtcgcgcacagggaacagggtacggcgcggacggatgagctcgacgagcagaggggcaagcagggcgcgagctacgcgcaggcacgcgacgaatggccagggagctccgggctgggacggcggggaaactccatggccagagtcgcggtttggatagagcagagggaaaagcggccgggcactagaggaccgagcagatgaacgcgactgcgcgcagggagcttcgcgagctggagcaggcgatgccaagttggagatgtcgtaggcgtacagcaagaagaaagagcagcgtccatggcgagggaagaacgcgcgcgtatggcgagcggatgtctgggcggatacagccatgggggatgggcgcgtagccatggacgagctcgggcacagggagatggatggccgagcaggaagccagcgtgcggagggaatttggtgcggccatggaagaacagggagaagtgatcggcgcagagaaagaccgacagtcaggccaggccgagagggagagaagcatggctgggcgttggggccgagcaccagcaggggaaggccgccgcgagggagctcggggagagggacgcacagcacggggagctccgatggcgcggagagctaggcgatcgcgaccgagctggagagagctccgtgtgggcgccgagcgagcagaggaaagggggcgcgacgctgggaggagaggagatgggcacacggcgcaggataaaatcgatccccacgggcggcggcagaaaaatctaaaggcgagggcggcggtagagattatgaggggtagcgggcggcggggataaggaggaagatggctagtagtttgtttttttaataataatttttttataaaattcgcagatatttctatctccagattttagcgaaaaatgagtcgagtcaaatgagattgatagaaataaatgggatatgattttatttagtgagtacttcagaattagatgaatttgcatccgttatttatatccaaagttttgaatccggcgagaaacgacaacccgatcgaactgattttaattttgatattgtattcagctttggtttacatagaagtcagacaaaaatttatctggtaaggaatagattaaattatcaaggttcgagtttttagcctgatgtttccggatcaagctaaacgatatcgggttaaactaggaaacgactcagtttataattctacgcctggtttttcttggattttgagtgtggtccgatttaattttgcaataaaacttctgtcgccgagttctattaaatcttgtttcggacaaaatcacagagtgagttgagctttcgaactcgtatccgtgcgagcgatgaattttaaataatcaccgaacacatcaatttgcggaacacgacgttctgaacatcacgaaaattttggaagagcccggatagataaaagcgatgtcgaactcgcgaccgacgaaacagatgcgatattaaaatcacgataggcgaagatgattaaaatttagcatctgttttatccactgatattacgtgcttaaatccatactcgttgttgagcggaatataaa

SEQ ID NO: 364 - DNA, 2666 bp, Zea mays
acctagaataagctgactaattaagcagggcatcaactttatccattaaccaaattgacataataatactataaaatctatttttattcctagctttttattaactctttaaactttgtatcttaattacttgatttactgatttatctaaattgatcatcacaatatacgcatgctaaattaataacatttattgtgaccaacaattctatttaatctatttatggacctagttgactggaatacgaatcaacttacccttatgacatccgaattgaaaccacgaaattgacgatgccttttagctcagcatttcaccaaaaatagggtgagtgctgtgtcgaatcgcgcttctcctttgtccacatcgagaattctccggccgcgtactgatttatttccttctacgcctaatcttctcggatcttggcgtagatgaggatgatgatcgacgacttgttcgagcttttgtggagcacttggtgaatatcatccggctagcttcgtcttcacctaattcttgggatttcttggggatgcacgaacgacgacgagatcgagtttggagcgagctagcgaggtgggggtcgagcagaggatgaccggttcgatgcctcgacggtaaacgcgagcacgccgaaacccgatggatgaggagcgagcgcacacggggcaagtagcatggaattgaaacgtggagaaattgcccactgcgaaacaaactgagcaaggagcgctcgtgaactttatggcagaatcggcggcggccgatgctagagcgcacggcaaggaagttttacagtttgatgggaccgtggctgagcgaattttatggcgtggattggggaagtacttggcgaaacggtaacatcatggcgacacgcatccggggcgcatggaactcgcagggttagatcttggcgaggatgagcacacacgacgcgacgacgacaaccggtgaggtcgttgacgtgatggggattaaggtcgagagggcgcgctgacgagcaggaaactccggtcgacgcaacaatagggaaatgggcgcgcgcgtggaacagtgggcgactaagcgaaatccgagcagagggcactgtcgcgcacagggaacagggtacggcgcggacggatgagctcgacgagcagaggggcaagcagggcgcgagctacgcgcaggcacgcgacgaatggccagggagctccgggctgggacggcggggaaactccatggccagagtcgcggtttggatagagcagagggaaaagcggccgggcactagaggaccgagcagatgaacgcgactgcgcgcagggagcttcgcgagctggagcaggcgatgccaagttggagatgtcgtaggcgtacagcaagaagaaagagcagcgtccatggcgagggaagaacgcgcgcgtatggcgagcggatgtctgggcggatacagccatgggggatgggcgcgtagccatggacgagctcgggcacagggagatggatggccgagcaggaagccagcgtgcggagggaatttggtgcggccatggaagaacagggagaagtgatcggcgcagagaaagaccgacagtcaggccaggccgagagggagagaagcatggctgggcgttggggccgagcaccagcaggggaaggccgccgcgagggagctcggggagagggacgcacagcacggggagctccgatggcgcggagagctaggcgatcgcgaccgagctggagagagctccgtgtgggcgccgagcgagcagaggaaagggggcgcgacgctgggaggagaggagatgggcacacggcgcaggataaaatcgatccccacgggcggcggcagaaaaatctaaaggcgagggcggcggtagagattatgaggggtagcgggcggcggggataaggaggaagatggctagtagtttgtttttttaataataatttttttataaaattcgcagatatttctatctccagattttagcgaaaaatgagtcgagtcaaatgagattgatagaaataaatgggatatgattttatttagtgagtacttcagaattagatgaatttgcatccgttatttatatccaaagttttgaatccggcgagaaacgacaacccgatcgaactgattttaattttgatattgtattcagctttggtttacatagaagtcagacaaaaatttatctgataaggaatagattaaattatcaaggttcgagtttttagcctgatgtttccggatcaagctaaacgatatcaggttaaactaggaaacggctcagtttataattctacgcctggtttttcttggattctaagtgtggtccgatttaatttttcattaaaacatctgtcaccgagttctaataaatcttgtttcggacaaaatcacagagtgagtcgagcttccgaactcgtatccgtgcgagcaatgaattttaaataatcaccgaacgcaccgatttgcggaacacgacattccgaacatcacgaaaattttggaagagcccggatagataaaagcgatgtcgaactcgcgaccgacgaaacagatgcgatattaaaatcacgataggcgaagatgattaaaatttagcatctgttttatccactgatattacgtgcttaaatccatactcgttgttgagcggaatataaa

SEQ ID NO: 365 - DNA, 2665 bp, Zea mays
catgtatgagcacgagtataaagagtataagatagataatctacattattaatttgaccatttttcacaaacgacgaaccaatttttgcatacttaccttattcattctctaaaacattctttgtaaatcctgcattttagacctaaggtgtaacttattacgcaattatttcacacgattacgttaccggaggtgctgaggtattttagcaaacatctaacacaaacacgacgtgcctgctaaacacgagaattattacgactaataagtctagctaattcaatcatcaaataaacttacaagaattataaatcagctcaccagcatcaaacttgacgtgactcaatactcgtaagaatgctgataaatcctggctcggggttgtcgtcgaacatcatacgggtgtggtgcggcttcgcttccttcttcatctaattccattcttctattttgagcgattgcaaccaccacatagtatcaatagctagtaattcaggtcaaaattcacaaaaacaatggcgctcatcggttcactttattttaccgagcaggtggcgtatgaactcgacccaaggcttagacacaagctggagaagagtaggacgaggccagaggtccgaaatacgctgcgtggtggagattgacagccaggtgtcgatgaatgcgcgaagtcttatagaacagtgatactgaagatggcgtggtgacgagcgaaaacgtggccgagtgacgacgaggtgtccaagtgttgtacacggcgaggtcgaagagtgtcctacggcatatggaggcaaaaacgtagggacaacgctgacgttggggagagcagtggggagacggcgcaccgagctagaccacaacaaggtcggccagcaagttggctgacggcacgtcggacaggcgagccgatggcgtagcaagacttggggtcgagcctcggacgatggagccacggaggtcgatggcgcgcacagggaacgcgcatccggcaccagagaacggcaaggttgttgtgcggcgtccgatggcgagtagctaggcgagcgtgaccagagctaaagcagcggagaaggcggccatggatggagctcgaagcgagctcacaaccttgacgcaaaggctaacggctggaatacgaccgcgtggatcaggtgagaccgcgcgagcactgaacgaggagaacgacggctcaacggtacccgcggtcggagcgagctggagactattggcggatacataaagggcctaggaagggaagcgagcaccaaagacgcgtggtggcgctcgcagagcttgctggtggggaagaagacgatgagggcggcatcgcagagcagggagaactcgaaggctttcttgaagagccccgatcagcgcttggagaagcgcacctgccagcccacccggtccccgatctgccacagttacacacggccgcggcatgccatggtcgacggcgagctgtggaccggcccaacagcgagaacaagcagagaggggcctgctggagcagagggcagggtcgagctcaagtagcgaccaggcgcggccaaagttgggacgccgagttggagactggacgccgagcaagttgcagctgggagcgatgccccgcctggccgagctaacacaaggaggaccgggcgccatgggagatgggagaaagccgagcgccatggaggagagatggaggaagagagaagcaggaaccagggcgcgcgcgcatgggggatgccgagtcgaggacgtgcaccagttcttggagccgagcaggaagtcgcggtgccggaggagcaggggaggagcgccgtacagggggcagggcgagctcgccagggaggagaggggctgggagatgccatggcatggagctcggccatggtgcagtccgagcatgggccaggggcgcgcggaggggcgagccagggagctccgaccgggcgctggggagaaggccaagccagggtccgagcctggggcgcggcgcgcgtagggagatgagcttgaggggcgcggaacctgtagaggagatgaggaagagccgtgcggggaagaagatgcgagagagagaaaaaacaatgcctaggaagccgacgccagcggcaatccgcagataagaatcggccagaaacaaaaaaatcggcgagggtggtggaaaatatcagagaggagaaagatcggcggaaggatagggataaaagatattttctagatatttttatttttctctcctttttttataaagagaattgcagatatttggaactaagggttaaaaaagacataaacgagttggatccggacagtactagatacaaaattcggatataatctgatttagcgaacaccctggagttcaaatgaatttttaccagtcacttatattcgaagatttggacctgggagagaaacaacagactgaattaaactaattccggctccaataatttgttccaaaaactttatttgtcgagttctaaataaatttgtttggggataaaatcatcagagtgagttgagccttccggattcgtattcgcttcttcgattaactttgaataagcacaagactcccgtgattgttcctcgccgggggggggggcgtcttcctcggtgaattactctgatcttaatggaggtgttcatggtagagggcttcgtggg

SEQ ID NO: 366 - DNA, 2662 bp, Zea mays
aagcacaagcggcaccgactgaacttactaattcatctttcatataaccaacacaaatgcactctttacataaacaagtcatttaaaactaattccccacatacaaacacaagcatcttttagcctaaatttaaagaccatggtgtgaggataaattagcaggagcaagcgcataagctgcaagactatcaatttttccataaacattccaccaaccctagacataagccgatcgcaataacgacataataacggatctagccataattaccaagcgcacacctcgcatcacaggtatttctaacttaatcttatacgcatacgaagcgtcttattttacgatcataaaaccaatagtaaaaatagcgaatcagctcaccacatctcaattcgatttggtagttgcctgaacgacaacgtccttcagctggagtcctcgatcgaacatctggcgagcgtgatcgacgacctaaggctgatggcgaacgcaggagcaagagcaggtctggcgtttgttaggaaaggatctcgacacccggtctcgtgacgagctactgggtgaaaaacgacgactagagcgaggtgcgacagactggggacgccgcgatggccagcgaactctgctggccaagcacatggaacgacaacgagatcgaatttggagcgagctggtgaggtggggtcgagcaggggatgacgggttcgacaactcgacggtaaacgcgaacacgccgaaacccgatggatgaggagcgagcgcatacggagcaagcagcacagaattgaaacgtggagaaattgcccactgcgaaataaaccgagcaaggagcgcttgtgaactttatggcgaaatcggcggcagccgatgccagagcgcacggccaggaagcttcgcagtttgacgagaccgtggccgagccaattttatggcacggactgctttgcggccaagacagctgtcgcgacgcgcatgacgtcgccacaccacaacaccatcacggccatgaacagaggcgcgcacagggagctagagaccgagcgcggtgagatggacagggccgagctcgacaggagcgtgcgcgcgcagaaaaggatcgagctggagctgggcatgagctgaactgggcgccatgggagagagcagagctccggccagctggaaaaatgcgacatgggaggagcaagcagcgggcgcggggaatgagcagagaagacgcgcggctgggctggagcaggcgagctgagggacgcggcaccagggagctccgagctggggcgaacggacagagggagcgctggacgcgccatgggagaaaccttgaaggatctgcgcgcgtccatggcgaggagctggagatggctgggcgaggcaccagagagacgggacgcgcggcgcgcagagaagcgcgggggaaccttggctaggcgcagcacacgcagggaggagctcggctgcgcgcagagcgcgcacagggactgagctaggggctgggcgaccttgcgccaggacgccacggcggaaactgcgaccacggcgcagggcacgacgaagggagcagaggagtgataggtgagcactggcgaggaggctggcaccctggccgagcaacacgcacaccaggaggccgagcaccatccaccagggagaagcgaggagaaacagggacggtctgccaaggtgccgacgtcgagctgcaggaaccgagcagggtatgtcgagtagggaggtcgacgcggctagcgaaggagctagaccgagcagaggatgaagagctgggcgagctcagcatcccaagaggaagccggcgctcgacggcgatgaccggaccttcaccgacgttgaggacagtgggatggcggagcacgcatacaagaaaccatgagctgggacttcgtcgatcggaggcgagctcgagctggcagctgcaggagcgagcgacgctggggagataggaacaaaggctgagcgtggcctggtgtccatgtacggtgcagaaaaatatcaaccttcaacggtggctgagtacgggaggagcttctaggcaagcaatggatatggctgggacatgcggcgaggaattatctggagaaataaacgtgcggggagttctttggagaaatgaacgtggagggataaggaaaagatatttttctttcctttcttaaagaaatcaaaagatacctttatactattctgtttttaggactaagatttgaggggtctaagagcatctccaagagctctctagaaaatgactcctaaaaattagttttaaggggtatctaaaaaattagtggggtagattttaaccttttctccaacagatcccttaaagcgacagattgtttctggggagcccaaaaaacccctcatttgtagctacaaatgagggagttttaagggctatgaaaaagttgggagcattttaggggaactgttggagacacgtttttgtgtttttcccaaaattttgatttaattgagacttttgagaagctcttggagatgctcaacagatatataaaagagtcaagctaatcgacaataatatttagataataatatttagacaggacttgttatggtaaatattatgagagttagacgaacttttaccagttatttatatccaaagatttagaactggcgagaaacatagac

SEQ ID NO: 367 - DNA, 2661 bp, Zea mays
gagacgttgggcttcctccgtgcctgtgatggtggtagtaggggtggtcggtgcgtctattggggcaccgttggaggcgctgaggggtggggcagttggaacttggttgccaaccatggagcagcgcgtaggtgcagcaactacagacgtgcaacgcacaggtgcagcagactgtagattttagtggaaggtggaagaaacggaattgtcctgaacccgtggtaccatgtgagagagatatgatgtgtaggctattgtgtattgaatgaatagagtgccagtcggttacaatatatataggaagaggagatcatgtgtggcttatagaaatagcgccagattgatctcctctatcaatcagtatcaggccttcctagtgtgggttgatacagattgatcccctgcaccaatcacgatctctcctaccatagctagcctggtttctatccataatagcatagattgctatccttgcctagtacacggcagatttcaccaagtcagccaccatctttgcatagaaatatctgccaacagttatactgggacccacaatctgaaagctaagagatttcaccaagtcagccaccattttcgccacctgtgttgcatacagaaatagaagtgtgtttcgatcatctatgtatggcccatgggaaataaacatatgcaattgaaagttctgcagaagaaaggctatttgctcaacagttcaacctagcagtttcagagagtttagagaaagtggcaccttaaaggctaacaattccacatctccgtacaaatgctaaggtaaatgaattgagctccaaagattcactttcatttgtgaaggtgttgcagcctctgaacataggtctcgcaacctctagacaaggatcttcaccatagctgcactacacttacctagccaacagtagctaaaaacctaaaacaagaaaagagatgagcgtctcactctagcaaaaatttgaatcacataatgcccactaaaattaagctggtcaaatcttagcaccgaagagtacaacatgaacacgcctctaaaatgaggccattagatcatctacaactacgaccacacattcacagtctagatcaaccaaactcaatacgctcgcgcacatgttcccaaacacagtggaaagggtgggattctcaagaggtcttcacctccagggagtggaggtaccgatcgatgtccctaatgtacgacgcatgtgggctttcagcgtcacgtggccttgtgtccatcggtcagcgtgcgacgtccctggcttcacgttgtttcctcggctccttgcccaagacattagatttcaattaagtctatcgtcaaacaacttcactgcgtagtttcagtagaaatatatttaattaaagtacatatgaaatacaaaactatttcagctagacgaaaatgttatctttattttaataatgcgaaaactcacaccctaactctagaaaatgagcaaagcttcacattatcacaaggaaccatcagaggccggtgcaaattcatcatcaaagatgtgtgcttcatttattatcgaaataagcttgataaaaaggtttataaaatatataaggttcattcacaaacctaaggacctccaacatcctccagattagaatatgaaatagacataatcaagactgcaaaatagattacaaatacaaacacaaaattaatagcccaaattcagctcctgtttcagtagcaatgagctaaaagttgacaaatgatactccatttagtcttgatcttcccaaggtttgcatagatagaattttcttattcatgatgcagtagctacagtaagggtactttcgctgagctgctcaccgcgacgacgtcatagacgtatgagtatcaggtgcagtggtgctctaggaagcacatgtactcctccttcctttttgactccccatcacctgcaacacagacacaaacaacaatttcctccttcaattctttagtttattcaagcaacaaatttttataattttgtctacaaaatcttggcactgaaattcttattgctcacaacaaaaatgttcagatttaagtttggttccaaaacaaataaacaagaaatgtgggcatggttgacacatccctgtgaaactgtcaagtgtttcagattggcttagaaactgtcttgctgatcctatcatcatggcactaaaattcttattgcaaggtcatacatcatagaagcttattagaaatagaaaatacatcaaatctgacctatttgtatatttgtagggtggctgacaattggctacaagtgcataattgtaaccaatgaggcactaagcttgatttggcaagtaaatagtgcaattaggtgtcaacaacagctacatcgtgcaaatacctagtaccctatataaagaaacaagctatattgtatctatatatatctaacatcggttatttgcatatgtatatcaaatttaccaactgaaaagttataaagaaagtgaaaaataacatgcaaaataccatcaaacatttcaactttgagcacgccgcaaggggtcagcatcaccaattcgtgctatgatccatgtgcatcttcataacactcacatgcatcaacaaacataaaccgtataaaatgagagcaacttttggagcacatcaacctt

SEQ ID NO: 368 - DNA, 2661 bp, Zea mays
  misc_feature (794)..(799): n is a, c, g, or t
gtcccttgaagcccgggtgtgacaccccgacccgctaggttcttctcctctgcggcgaattagagcttgccggtggcgctgcgcgtcgatccgccacacctccatgaagtgcggccgatgcagctccaccccttgcccaagttgtggccctagatgtaacaaacccctcaacggagcctgtgctttcctcggtgcgctcgatagccccactctgtggttcggattgctcactagagtgcccctgacccaccaagttcttgtccactatggcgaattagagcttgccggtgccgctgcgtgtcggttcgccgcacctcctcggcgtccgaccgatgcagctccaccccttgcccaagttgtggccctagatgtcccaaacccctcactggagctcgtgttgtccacggtgcgtttgatcgccccactccgtggttggggttgcttgccagagtacccccgacccaaccggttcttctcctctgcggcaaattagagcttgccggtgctgctgcgcgtcggtccgccgcacctccatggtgtgcggccgatgcagctccaccccttgcccaagttgtggccctagatgtcccaaacccctcaccggagcccgtgctatcctcggtgcgctcgatcgccccactccgtggctgggatggctttacagagtacccccgacccgcccggttcttctcctctgtggcgaattagagcttgccggtgccgttgcacgtcggtccgccgcacctccaaggcgtgcggccgatgcagctccacccattgcccaagttgtggcnnnnnntgtcccaaacccctcaccggagcccgtgctgtcctcggtgcgctcgatctccccactccatggttgggattgctcgctagagtacccctgacccgcccggttcttgttcactgcggcgaattagagcttgccggtgccgttgcgcgtcggtccgccacacctccacgacgtctggccgatgcatctctacccattgcccaagttgtggccctagatgtcccaaacccctcatcggtgcccgcgctttcctcggtgcgctcgatcgccccacttcgtggctaggattgctcgccattgtacccgcgacccatcggttcttctcctctacggcgaattagagcttgccagtgtcgctgcacgtcggtccacaacacatccacggcatccggccgatgtagctccaccccttgcccaagttgtggccctagatgtcccaaacccctcactggagcccgcgatatcctcggtgcgctcgatcaccccactctgtggctagattgctcgcaagagtacccccaacccgcccggttcttctcctctgcggcgaattagagcttgctggtgccactgcgcgtcggtctgccgcacctacatggtgttcgaccgatgcagctccaccccttgcccaagttgtggccctagatgccccaaacccctcaccgaagctcccactgtcctcggtgcgcttgatcgccccactccatggctgggatttatcactagagtatccccgacccgcccggttcttctcctctgcggtgaattagagcttactagtgccgctgcgtgtctgtccgccgcacctccacggcgtgcggctgatgcagctccaccccttgcccaagttgtggctctagatgtcccaaacccctcaccggagcccgcgttgtccttggtgcgctcaatcgccccactctgtggctgggattgctcgccagagtacccccaacccacacagttcttctcttctgtggcaaattagagcttgccggtgccgcacttccacggcgtccgatgaccgatgcagctccaccccttgcccatgttgtggccctagatgtcccaaacccctcaccggagcccgcgttgtcctcggtgcgctcgatcgccccactacgtggctgggattgctcgctagagtaccctcgacccgcccagttcttctcctctgtggcaaattatatcttgtcgatcccactacgtgtcggtccaccgcacctccacggcgtccggctgatgcagctcgacccttgcccaagttgaggccctagatgtcccaaacccctcactggagcccgcgctgtcctcggtgcgctcgattgcccaactccgtggttgggtttgctcgctagagtacccccaacccgcctggttcttctcctctgcggtgaattagagcttgctggtgccgctgcgcgtcggtccgtagcacctccgcggcgtccggccgatgcagctccatcccttggccatgttgaggccctagatgtccgaaacccgtcaccagagcccgagctggcctcgctgcgctcgatcgccccactccacgtatgggattgctcgctagagtactcctgacccgcccggttcttctcctctgtggcgaattagagcttgccggtgcctctacgcgtcggtccgctgcacctccacggcgtccggccgatgcagctccacccattgcacaagttgtggccctagatgtcccaaactcctcaccggagcccgcgctgtcctcggtacgctttatcgacccacttcgtggctaggattgctctgtagagtaccctcgacccacccggttcttctcctctacgatgaattagagcttgccggtgccactgcgcgttggtccgccgcac

SEQ ID NO: 369 - DNA, 2651 bp, Zea mays
ccccgacccgctaggttcttctcctctgcggcaaactagagcttgccggtgctgctgcgcgtcggtccaccgcacctccacgacatgcggccgatgcagctccaccccttgcccaagttgtggccctagatgtaacaaacccctcaccggagcctgcgctttcctcggtgcgctcgatcgccccactccgtggctcagattgctcaccagagtacccccgacccaccaggttcttgtccactacggcgaattagagcttgctggtgccgctgtgcatcagttctccgcacctccacggcgtccgaccgatgcagctccacccattgcccaagttgtggccctagatgtcccaatccccttaccggagcccgtgttgtccacggtgcgctcgatcgccccactcggtggcttgggttgcttgccagagtacccccgatccacccggttcttctcctctacggcaaattagagcttgctggtgccactgcgcgtcggtccgccgcacctccacggcgtgcggtcgatgcagctccaccccatgcccaagttgtggccctagatgtcccaaacccctcaccggagcccgtgctgtcctcggtgcgctcgatctccccactccatggctgggattgctctgtagagtacccccgacccgcccgattcttgtctactgcggcgaattagagcttgccggtgccgctacacgtcggtccgccacacctccatggcgtttggccgatgcagctccaccccttgcccaagttgtggccctagatgtcccaaacccctcaccgaaacctgccctgtccactgtgcgctcgatcgccccactctatggttgtgattgatcgccagagtacccccgacccgcccggttcatctcctctacggcgaattagagcttgtcagtgccgctgcgcgttggtccgccgcacctccatgacgtctggccaatgcagctccaccccttgcccaagttgtggccctagatgtcccaaaccccccactggagccttcactttccttggtgcactcgatcgccccacttcgtggctaggattgctcgccattgtacccctgacccgccggttctttttctctgcgacgaattagagcttgcaagtgtcgctgcacgttggtccgcagcacatccacgatgtccgaccgatgcagctccacccctttcccaagttgtggccctagatgtccaaacccctcactggagcctgcgatatcctcggtgcgcccgatcaccccacctcgtggctagattgctcgccagagtacccctgacctgcccggttcttctcctctgcggcaaaataaagcttgctagtgccgctgcgtgtcggtctgccgcacctacacggcgtccgactaatgcagctccaccccttgcccaagttgtggccctagatgtcccaaacccctcaccaaagctcccattgtccttggtgctcttgatcacctcaccaatggctgggatttatcactagagtatccccgacccgcccggttcttctcctctgcggcgaattagagcttactagtgccgatgctcgtcggtccgcctcacctccatggcgtgcggccgatgcagctccacccgttgcccaagttgtggccctaaatgtcccaaacccctcactggagctcgtgttgtccttggtgcgctcaatcgccccactccatggctgggattgctcgccagagtaccctcgacccacacggttcttctcctcaacggcgaattagagcttgccggtgccgctgcgtgtcggtttgccgcacctccacgacgtccgaccgatgcagctccaccccttgcccaagtcatggctctagatgtcccaaacccctcaccggagcccgcactgtcctctgtgcgctcgatcgccccactatgtggctgggattgctcgccagcgtacccccgacccgcccggttcttctcctctacggcacattatatcttgacggtgccacttcgcgtcggtccaccgcacctccacggcgtcccgccgatgcagctccaccccttgcccaagttgaggccctagatgtcccaaacccctaaccagagcccgcgctatcctcggtgcgctcaatcgccccactcagtggctaggtttgcttgctagagtacccccgacccgcccggttcttctcctctgcgatgaattagagcttgccggtgccgctgcacgtcggtccgtagcacctccatggcgtccagccgatgcagctccatcccttgcccaagttgaggccctagatgtcccaaacccgtcaccgaagctcgagttggcctcgctgcgctcgatcgccccactccatggatgggattgctcgctagagtactcccgacccgcccggttattctcctctgtggcgaattagagcttgtcggtgcctcttcgggtcggtccgccgcacctccacggcgtccggccgatgcagctccaccccttgcccaagttgtggccctagatgtcccaaactccacaccggagcccacgctgtcctcggtacgctcgatcgacccactccgtggctaggattgctctgtagagtaccctcgacccgacatgttcttctcctctactgtgaattagagcttgccggtgccactacgcgttggtccaccgcac

SEQ ID NO: 370 - DNA, 2651 bp, Zea mays
gtgtgattacatttgcggcctaactgtggccagtccagttacgctggagtcactagtatttaggtgacactatagaagcggccgcgacaacttgtccacgaccacatggttgcaaacaattaataaaagtagattcccgtacttcacaggaaggaaagtctaaaacaattctgttgtgggatctttctaaaatatgcttcttgtatatgctatctgcatcatttatgtcaagatgctaaaaaagttgaaacagaggttaggtaaatttgcaatagaggttaaaaaattaacaattattctagttttacctcttacaagaagacttctcatgcagcactgcaaattgtctgaagcagctatcttcccagctaatcaactaaaaaggacatcaagggggtgcagtcagtttctttggactacacttccgcatcacctcatagaacaataatagaatagtacttacatcaacatcctccagcaacatcactttcttctgtgcctctgctgccctttccttttcctccgcagccagctgaaagggacataaagaaataagaagttgcattgcaacaatcagatgcagtcaaaatgtcttaaaggttccttttcgtaccctttttgtcctcttactgattttcttaattggttttgcactcaaaaggttatcgaccattgcctccgtatacaggttaattctgcaacattgtgtccaagctgttcctttgaatacagtccatgaaaacaacctgtgaaccaacgattcttcacttagtcactttcctacccaacatgagaaaaacaattactttaaggaattatggatatgctctgcattatcctggtacttactagaaacataaggacacatccattcatatgccccggattcttcttaaagtcagtgcaagagctttctttaatgaatgaaatatcacatatgaccagtcaacctttttcaacttttctaggtcatatacagcttgaagttcaggtgaggttacataaaaatagacttttgtggcagtagcaggttatttaagaccacactgaaaaaatgtctgacgagcatatctgtgtccatgtgcatggagatctcctcgttatccgaatgttgagccaactttacaatgttagtcacggtgaaataggttctcttaacactagcaggtacttcatcgttccgttgaccagcaccaccttcattggtctgttgtccagcaggtacttcattggtctgttgaccagcaccaccttcattggtctgttgactagcaccacctttatttttctgtctcagaggaaacttttcagatactattttcagcacttcgtacattttgacatattgttcatctgctgaagcttttgaagatggacttgggagaaccttctcagagcaggccaagaacttgttggattttcagttgtgggctgcaccgggtttgcagctccttgtcatgctcggcatatttggaaacagagtgcctgcagatgttgctaaaaagaaaattaatcaaaatttcagaaatctacagcttctttgatatgattttgatatttagctttaactgttttatcacaaagaagactatcaactaatgtaattgaaacaaccgcaaaagttgtctaagtggccttgtcggactttgctgcggctgaggcagcctgttcgctgagacgaccagtcctcctgagacttgaaaacggagccggcttccttacgctgggcgcgtatgacgcgacccatctggtcaacggcggcggcggcgggagaggacgcgaagggaagaaaccagagaataactgagtgcgtccacaggaataactaaggtattagaccagaataactgagtgcgtccattagaataactgagttattagaacggaataactgagtaatgagtagagaataactgagtgcgcacattagaataactgaggtattagaccggaataactaagttccgtcaccagaataactgagtaatgaacatagaataactgagttattggaacggaataactgagtaatgaacagagaataacggagtgggcatattataataactgaggtattataatggaggcaacatgaataaagcggaggaagcatggatgaaacatgcaccaggaggcaacatatacaaaaaaagggcaaacattatacaggaggaattgaggaaacatgtagggaactccgaggaaacatctaccagaggaggcaacatgtacataactggaggaaccgaaaaacatatacctggaggcaacatgtataaataaggggaaaatatgtaggaaataggagtgtgctagttatgtaggaaataggagttgaacaaagagcaatacgcagaacaaaacgaacagcatgcatgccgaccgcatccagcagatgctcaaactcgggcgcatatcaacatacagaagcattccaaaaggcaacaagctcaagtaggaaatatgaaaaaagtctgatcatgataaatgttgcggagtgtaactcagaattcctgacgtagtcaaacaagtacagctttatctagatacaataggtgtgagtaggggtaatggttggggatatgaggcctgagtggcaattcacagcaggtgtgttctctagagatgagctcatgcctggctttggaact

SEQ ID NO: 371 - DNA, 2648 bp, Zea mays
tctcccagttgactttctggcgccaaggatggattttagttcgatctatatttatattttattttgtaagacttctgtaacaccccaggtgttatctcccgttaaacagcgattacggacttaagtatggtatgttagtgaggataacaatatacatatcctaatcatcttcgtctatcgcgattttgatatcgtgtctgtctccatctgtctaaattgccctaatttattttgcaaaattcagactctagtaatcttccggaacatcaaatccagtatcgtttgggaataagccatcaacatcttgcctcgaactataatccttgaaatcaaatgtggttccttaataattcgtttgaaattctttcacgcttgcgtcgcataagtctatctgtggcctgacatcgtgtggcatgtgatgggtgcaaaatccgtgtctggacagcgcacaaactctcgcccacgttaacgatgcgtgtcgtcgcttccggaaaggatcgcaatctcgatgccgcatcgatatcgcgcatttgtctcgcgatatatcgagtcttgtgcctgtttaaaagttatagattagagaatacgaattcggaagctcgacccactctgatgatttttatcctgaacaaattaattggaattcacgaaaatagttttgagtctgaaacaaaccagaccagtgtaactagaactgaatgcgagtaatcggtaaataatttggttcgctaaatttggagaatgaaatgtgtatccgtataccgtgtcgacccagtatacatcgctaaaaatcgtcatccaaaatatctacgattttccttttaaaaaaaagagagaaaagaaaaacgaaaaatcctcaaatatcttcaatcgcgcgcgccgctcagcacagaaaaaaaatcttgtcgttgccctcagatttttttgcaccgtcactggccatctgtcttatcttcccacgtgagcttctctttcttccttatctccttccagccgtgctccctgcgcagctcactctccaccttccatggccaccgccctgccctgtcttccaatgtcgcgccctgccaagcccctctccatctcgtcgctatggcgcgcccctctccctgagccccttccccagccgcgtctccctctctctccctcacgtcttcttctccctccgagctcacccctagctccgcgcgtgcccatggcgctcgtcggccgcgatttcgcctgagtttcctgctggctcgccgacgtttctccctgcagccacgccatcggcgcgcctagcctgcctgtcgtggatgcgggctgctgcccatgccgagctccctgtgcgctccctctccctccacgcgctcccggcttggcatcaatgccagcaaacttggtccctgcatcctccctgttgtcgcgtccatggcgcccagctcggatttttgcttggtcgcccgccgtttcccagtgccatggtctcgtctcgcccggcctcatcctatcaaggttgttccagcacgcgcgccctggtacccctgctcgtactcgggccaaccgtcagcagctccccggcctccgtcatgctcggcagcaagtacttcatatcggagcagcagctgcgacgccctcctttatgtcgtgctcgccagatcgggcctcacgtcgtcgatctgtgcagttcctgttccgcaaagcccccgtcgaacccctattcgccatgacactgagctccttcaacactgtcccaccccgttgttgttgttctgtcgcctcgcctcgcttcgacgccagacccctacatgatgtctctgatttgggttcgcgccgacaaaagaatcccaagaggatgtggagaagcaagccccaggtcgatgccccaagtgctcggcgaaaggactgaacaagaatcattgtcgtagtgcagagttctagttaatatggagatattccaaaagttgtggatggaggagtaagtgaagctcagtttaatgctcgccaggtgttcgatcgaagactttatttggagactatcagcgttttctcaagctttgagtccaacttactttggataagaaatccctgatgttcgagaaaagcgaggccggtaagctctctcttggggctcgacaaagcacttgaactcgatgttcatcgtcgttcttacaaatatcgggtcgattcggtcatggtaagctggttattatttatgttatttggaattattagtggagtaattagatatatagtaatcgtgatgatcctcgtatttagcgcaggcgcgttgtggtggtgttaaatatatgtgaagtacgatgaagatagtaatgcgaaaggtagattaatttatgtgacattcgggcgagctgataacgtaaaaggtaggctttgtatttctatgggctagttgatagattttgtagtgttattatgtcgatttggttaattgatgtagtcgatgccttgcttaattagttagtttattctaagtttggtgtttagttccatgtcatgagggatgtgcgaattacctcgagtaattaacagtgaatggcatcgacctatttaattattgtggaattcaagataattgagaaatgcgagtgttgtagttagtatgtatagtttattattttgtgattattgcgcttagtcatatgtcc

SEQ ID NO: 372 - DNA, 2644 bp, Zea mays
gtatttttttagatcggtaattttccagagttgacatctatatttatgcaattctgcttttattttgatccatgttttaagattctttgttattattctattacagttatatcaatgatatttataacaaaagaattaaatatagaaaaaaatcattccaattttaatttcaatttgcattatgccagaccataaacaataatagtttagacatgctatcttaaaatttatgtagtgatattttaaatgattcttggttatggacaacaatgcatgttttaaggccactcaaaaaacaagtatgggactcgtgatatttatcataaaacaatttaaccaaggaaaattacattacaatttgctcattgccaaaatgtaaacatcacttgttttgacatgttatctcataagataagtggaaaattttgaaatgtttcatggatatggacattaatgtaagtttgaatcggttcaaagccctaaatgatgtaatgtttagaatggtagtttttacaaaaaggatccaacaaggtttgtcatcaaagttttcgcaatacactgatttgtgagtaaaagggtcatgatttcgtgcatgttttctcgaaaagattgtggcatgaaccatacgaaaactctaaagcttttcaaaaccctaaattatgtggtagatttacagaatgatccaacacgttgtttcacatgctccaccatcaactaaaattcaacacaatcaataacttgagtatgggacccacataattagatggtcgcatgccaattaaagttcagtgttttaaagaaagaggtaactttaaaagtatttgaattgcaatatgcagatttttcaagataaactattttgcagagttacgacctctattattggaaaaatagttaatggaagaaaatttatgtttctactttcattactcttttctaaatgtcgtactgtaagatatacttgtttaggcatgttaccttaaaacatatattgtgctatttgcaacgttcctcggttgtgaacagatcaacccaagtttaaggctgatcaaaacatgattatgggactaattggtattatattcgtacagtttgttgcatgatatattgatttctgatgtgcgtcaactttgatgcattttgaagccctaaatgttgtattgtttaaagagacagtttttacggatgaacccaacgtgttgttctcatacaccatcattaacccatgttcaagacaaccataacatgagtatgagaccctagattgttgcatgctagcactagatttggtcatatgaaggatgaggtgactctaaaagcgcttgaagcacaacatgtagattttttcggatcatcaatttactataggcgtgagctatgcaacatgttgtttcacaagaatcatcatatgtagtgcttttttatatgattcctggttatggacaacaatgcatgatttgaggccactcaaaaaacaagtatgtgagtcttgatatttgtcacaaaataaattaaccaaggaaaattacattacaatttgctcattgccaaaccgtaaacatcacttgtttgagcatgttatctcataagatatgtggaaaatgttagaatgtttcatggttatggacattaatgtatgtttaaagtggttaaaagccctaaatgatgtaatgtttagaacggtagtttttacaaaaaggacccaacaaggtttgtcatcaaatttttcgaatacactgatttgtgagtatagggtcatgatttcgtgcatgttttctcgaaaagattgtggcatgaacaatgcaaaaactttgaagctttttgaagccctaaattatgtggtagatttacagaatgatccatcatgttgtttcacacgctccaccatcaactaaaattcaacacaatcaataacttgagtatggaaaccaaataattagatggtcgcatgctgattaaagtccagtgttttaaagaatgaggtaactttaaaagtatttgaattgcaatatgcagattttcaagataaactattttgcagagttacgacctctattaatggaaaaatagttaatggaagaaaatttccatttccactttcattacttttttctaaatgttgtagtgtaagacatagttgtttaggcatgttaatagtgctatttgcaatatttctcagttgtgaaaacatcaactcaagtttaaggacaatcaaaatatgagtatgggactaatgggtattaatttcgtacaagtttgctgcatgatatatcgatttctgatgtgcatcaacttcgatgcattttgaagccctaaatattgtattgtttagacaaacagtttttacggatggacccaacttaatgttttgcatgcgccatcattaacccatgttcaagacgaccataacatgagtatgcgatccatagaattggactatcgcatgctagcactagatttggtcatatgaagaattaggtgactctagaagcgcttgaagcccaacatgtagatcttttagatcatcaatttactatagaggtgagctacccaacaagttgtttcacatgcttcatcatcaacccaagtgcaagacaacctatagcatgagtttggggcccaagatattggatgttcgaatgct

SEQ ID NO: 373 - DNA, 2642 bp, Zea mays
taaacaagtgatgtttgcagtttggcaatgagcaaattgtaatgtaattttctttggttaaattgttttgtgataaatatcatgagtcccatacttgttttttgggtggcctcaaaacatgcatttttgttcataaccaagaattatttaaaataacactacatatggtttaaaatagcatgcctaaactaatattgtttatagttcggcatagagcaaattgtaattaaaattggaatgaatttttttctatatttaattcttttgttataaatataattgatataattgtaatagaataataacaaagtatcttaaaacatagatcgaaataaaagcagaattgcataaacatcgctctcaactccggaaaattaccgatctaaaaaatatacatgttgcactttaaacatttagttacctcatttttcatatctacaaactctagtgccagcattcgaatatccaatatcatgtgccccaaactcatgctataggttgtcttgcacttggggtgatgatgaagcatgtgaaacaaaatgttggataactcacgtctatagtaaagtgatgatctgaaaaaatctacatgttatgcttcaagcgcttctagagtcacctcatccttcatatgaccaaatctagtgctagcatgctgcaatctagggtcgcatactcatgttatggttttcttgaatatgggttaatgatggtgcatgcgaaacaataagttggatccatccgtaaaagtgtctgtctaaacaatacaacatttaggttttcaaaatgcatcgaagttgacgcacataaaaaatcgatgtatcatacaataaacttatatgaaattaatacccattagtcccatactcatgatttgattggccttaaacttgtgttgatgtgttcacaactaaggaacgttgcaaatagcacaatatgtgttttaaggtaacatgcctaaataagtttgtcttatagtacaacatttataaaagagtaatgaaagtggaaatataaattttcttccattaatagaggtcgtaactctacaaaatagattatcttgtaaaatctgcatattgcaattcaaatacttttaaagttacctcattcttgaaaacgctgaactttaatcggcatgcggccatctaattatgtgggtcccatactcaagttaatgattgtgttgaattttagttgatgcagcatgtgaaacaacatattgtatcattctgtaaatctaccacataatttagagcttcgaaaagcttcagagttttcgtatggttcatgccccttgtactcacaaatcagtgtattgcgaaaactttgatgacaaaccttgttgggtcctttttgtaaaaactaccattctaaacattacatcatttagggctttgaaccgattcaaacttacattaatgtccatatccatgaaacatttcaaaattttccacttatcttatgagataacatgccaaaacaagtgatgtttacattttggcaatcagcaaattgtaatgtaattttccttggttaaattgttttatgataaatatcacgagtcccatacttgttttttgagtggccttaaaacatgcattgttgtccataaccaagaatcatttaaaatatcactacataaattttaagatagcatgtctaaactattattgtttatggtctggcataatgcaaattgaaattaaaattggaatgatttttttctatatttaattcttttgttataaatatcattgatataactgtaatagaataataacaaagaatcttaaaacatggaacgaaataaaagcagaattgcataaatatagctctcaactccggaaaattatcgatataaaaaatatacatgttgcactttaaacatttctaaagttacctcattcttcatatctacacacgatagtgccagcattcaaacatccaatatctcgggccccaaactcattctataggttgtcttgcacttgggttgatgatgaagcatgtgaaacatgttgcatagctcacgactatagtaaattgatgatctgaaaaaaaatctacatgttgtgcttcaagcgcttttagagtcaccatccttcatatgaccaaatctagtgctagcatgtgacaatctagggtcgcatactcatgatatggttgtcttaaatatgggctaatgatggtgcatgcgaaaaaaacaagttgggcccatccataaaaaatgtctgtctaaacaatacaacatttagcgcttcaaaatgcatcgaagttgacgcacatctgaaatcgatatatcatgcagtaaacttgtaagaatataatacccattagtcccatactcatgttttgatcggccttaaacttgggttgatgtgttcacaaatgaggaacaatgtaaatagcactatatatgtttttaatgtaacatgcctaaacaagtacgtcttataggacgacatttagaaaagagtaatgaaagtggaaatataatttttcttccattagctatttttccatcaatagaggtcgtaactctgcaaaatagtttatcttgaaaaatctgcatatagcaattcaaatacttttaaagttatctcagtctttaaaacactgaactttaatcggcatgcgac

SEQ ID NO: 374 - DNA, 2638 bp, Zea mays
actgatgacttccatttttttctttacatgccaggcaatataccacaattactaagggcagtgcaattgcaaatatacaataagcagttaataatagtaacctctacctttcagtgtttgatgaaccacctagaggagtcgagtgcaaggtaaactcccggtcatacagtggaacagaaccatcatctactgtatcactttcccttgcttggttatccacccaaaaggacttgtcagaataagaaaaacaagaaaacaaaacaaagtgaataactatattccagttaagtatcccacaaaaagcagaaataaaccatagtacaatacagcaatttgtttaaagattacatgaaatgttagatgcatattatcaatcagtacagtaacaaagaacagaggactatgcccatgtcagaatatgtagcatagttgttaaggcggtaaggcgagataaggcggccgacccctttttaccttttaagcggtaaggcgtaaggcgtaaggcaaggcgacgcctaactaatatataaatataggaatatgatcttaaataggtagggatggtagtacaaataagggtacaagttcaacctaaaccaacataatagaattaaaatattaacataactaatagatagtagtagaagattaggaaaaaatgaatacataactgatagatttactggtttaatagagaagtaaaaagaagagaaaaaataagagtttaaagacatatgggccatcagactgctatttcccggcccagtcagcccacttattgacctaactccatccctcagctgcaccttgcagcagccttcagccgccaccctgcagttgccagagaggggagagggagtcgccgccagagagagaggagagtgagcaggggaggtcaccgcccgcacacctgagagagagagggagggagaggacgtgcgcgaccatctccgacccgcgcgacgctgccgcgacctacgccgaccagcgcaacgccgccgcaacctgcgccgacccacgggacgccacgtcttccccgtacaacaccccaaggcgtcctcatagcgtcaccttatacctctccaaggcgccggggcgacggcctaatggccaaagcggatgccttaggctcccaggcaaggagacgcggacgccttatggccagagcacgccttagcatttaggtgtcgcctaagcatcgccttagggacgccttaacaactatgatatgtagtactaaaatgaggtgtttcaaatgaaaataataaaagcatatggctgcaagtgggaagtaacactgcattcagattccaaagtttatttctgttgaatacgaacacagttgtagcatatttgccattctgaacgcgtaagattgatttagtttccaacatgtcctcaaaggctaagcgtatctgaaggaagaggctaatgtcaccagataaatagaaaaatggaacaaggaccaaaacatggaagtccctactgcaaaattaaggcttacacatgggattatggggaaaaactattttcaaattagcacagttagatgcacatgcactatcatatgccaataaaggacatactcactttaccaggtaggtagctaagtcaagagtgatagcttaccaagaggcggtggaatacttttggcaatggaaagaaaaaaaacatttaaaacaaaaaaataggaaaatgaaaatagaaagcaacaatacattagagcatctccaagagtctctgcatggctatttatcacaaattacaaaatttcaaaaaaaatcaggttccaatagactttctaaccactctttcaactctccaaaaccactcttgttgctctgcactagcgaagaatctacatcactctttaaattccatatatagtagttctatcataaatttttgacacaaggaaagttactacaagtcattcgagtatagaactatagataatgaaattaagagagtccatgggaaataagagatacataaaagagaatattcatcggatggctctccaactagagataacagagatagaattttagagaagctctttgagttactattagttatcacatcaatcaatttgattttttatagtacctatagctaatttgacacatgttgcaagaaactagaacttccggggaccattccagaaacctacaacttcctcaccagaaacattgaaacatgagaccaccagtgacatgctacaggggctgacatgtgggttcacggttagaaagttatagtgatggtcttctgcaacaaggtgccaagaactcaaaataattgtaggtttctgcaatgagcaccagaagttgcttcctacaaatgtgtcaaagtagttgtcaatttttaaattttacttttaaagaaatcgttttagaaaaaagaacaaaatagacactaaaatgcatgcagtcttcataagtcaaaaagtatgaccacctctgtacatttagtttcttagattgcaaataattaagataggttttacgttaaagatggtgttaatgcccaactgtccaagtaacacccagctgaagccagagcataacgagaaaaagagaacacaagataaatcaccaatcatatattcaaagtaatcatataatattgtttctgc

SEQ ID NO: 375 - DNA, 2635 bp, Zea mays
caatccgattttaaaaatcaacatcgacgatgaattttagatgtcacgatttatctctttcaatcataaatccgaaagccgatcatatctcaagacgatttattttcgaatcatgcataaggaattattgccgagtgaagtcagattagactctcggccgagttaatcgctcaatcgtccgttcgtcggaactctaattcgctctgttctccgtagagacaaattccgcgggagcatttttattctgggaaaaatttagcacagcccgattacgtgttttgggctaggccaacctagcccatttggaaccctaaccctaggactcctctataaatagaagtgcctccccttgcaaattggaaaatttgcatctacccccctagccaccacagccttcttcctcctctcccacacgcacgcagctctcttcttctatgttcatggcacaggtaatttcctccccgcccatggcgtccttccctcctcccccttcttcttcctcaagcatgtaggccaacctctcctcctctgcatttcccagcgccaccatctttttttcccctgtctctttcttcctcacggctgcagcagggagctcagctccttctcccatggcgctcggtacccctgcagcagggcgccattcttccctagggacgcctttgctccagccagccttcttcctttcccccatccgagcgcccaagccagcgcccttccctgctccatgggcgcgagctccaccccctgtaatggacgctgcgtgagctcaccccatgggcgtgttccctgctccacggccagccggaagccagcgcccctctcctactcggccacatctgcgcacagagagttcttccccacgccaccctctttctttcccacgaagaaagcagggaacacgaccaacgttatcttcctcccatggcttcctccctgccacgtctcacctctggtcgacgccctgcacaacgccctctctcccatggcgagcagctttcctccctatggtcatggtccgcgacaggaagtcgcgcgctacatgtttgatgttttgcgcagcaaccacgacgtctccgcgtgctgcctgctcgctgttttgtgaagcccactggacagcacaccgtcgacgctcaccggttgtttgctgtttttacgcagccccaacatcgatgtcgttcacccccggtgagtcaccccgctgcccttgctgctatcatatttttgtgctcggtaaaatgttgaactgttgtgtgtgtctaatcgcagctatctgtcaatgccatccatcgcgcacgcgtgttcgatacaaggccagtcggttgaaccacatgcaagcacaactcgaatccgatctagtccaggttgattgatttatagtttaccatacgcatgatttggttgatgtcatgcagtgcatgtatatgtgtagatgtgtgtaaaatgtttcggttatacacattagtagggtcgcatttgcggttggagaacaagaggttgtttgatgtgtgcgatttgtagtttgtctaattatgttttggtcgatgtggtgtatattggtgtttgaatatatgtggctgcgatggttcatttatgtgtcacgaggatggttcgtggaggtattaattgtttgttaaaatacttcgtcgtaaagcagtgtgttaattgtgttaaatctaataaagtgtaaagcaggcttggtggtttccgcagtcggctaatgagttagtctatgttaaatatattttatgtattcatcgtggtgtgggttagagtgggttgaaaatataaattatgtgacatgtgattagtgttttaaagacgagatgtgcgaataatcacttggtgtttcactcgtctagtcgataagtgttatcataactaattgtgctaaaatttggtcataagaatgcagtggacacgtggtgttggttggatgtgaaaagtagattggaagtgtgggtttgtctgagcactgtattgtcaaacgtgtatatcaaagtgcattgtagtaatgattgcgttaagtaaacagtaatgtctcgagtgcacgccagaatatggttgtatgcgagacggggttacgctcatggtgagtttagtaaaattccatcggtgtcacttgtgttaagttgaggtttatttgtgcgtgtaaagtagtaaggtatttaatacttagaactcttagtcgatgatagaaattgtcttggcttaaatagagaggtggtgacatgccagagtagtcatcgctttctctatatttataggtcaagtcgtgacgatgcgtattatgcattcgttaaattatgcttcgcatatagtgtatgattgtgctcacggtttcgagtagactcttcgaataagtcaagtaggtttgtactgcaagatgtgtgatgaagttagtttgttttaggataatggtttaaatgctcgattcatgtgatagacatgtgtggttaattcaaatcgagtcgatgtgtgtgacgatgatattcatgaattaagtagatgtcctgaaattgtgtagtggagcttaggttaagttgcaagtgatgtgggaatgttttggtaaagatgtatgtaaattgcgaacgagtcattcaacgtattaggcatgtcgtgtagtggtggtatg

SEQ ID NO: 376 - DNA, 2632 bp, Zea mays
gtgcggcggaccaacgcgcagtggcaccggcaagctctaattcatcgtagaggagaagaaccgggcgggtcgagggtactctacagaccaatcctagccacggagtgggtcgataaagcgtaccgaggacagcgcgggctccggtgaggagtttgggacatctagggccacaacatgtgcaatgggtggagctgcatcggccggacgccgtggaggtgcggcggaccgacgcgtagaggcaccggcaagctctaattcgccacagaggagaagaaccgggcgggtcaggagtactctagcgagcaatcccatccgcggagtggggcgatcgagcgcagcgaggccagctcgggctctggtgacgggtttcggacatctagggcctcaacatggccaagggatggagctgcatcggccggacgccgtggaggtgctacggaccgacgcgcagcggcaccggcaagctctaattcaccgcagaggagaagaaccgggcgggttgggggtactctagcgagcaaacccaaccatggagtggggcgatcgagcgcattgaggacagcgcgggctccagtgaggggtttgggacatctagggcctcaacttgggcaagggtggagctgcatcagccggacgccgtggaggtgcggtggaccgacacgtagtggtatcggcaagatataatatgccacagaggagaagaactgcgcgagtcgagggtactctagcgaacaatcccagccacgtagtggggcgatcgagcgcaccgaggacaacgcgggctccggtgaggggtttcggacacctagggccacaacatgggcaaggggtggagttgcatcggtcatcggacgccgtggaagtgcggcaccgacaagctctaatttgccacagaagagaagaactgtgtgggttgggggtactctggcgagcaatcccagccacggagtggggcgattgagcgcaccaaggacaacgcgggctccggtgaggggtttgggacatctagagccacaacttgggcaaggggtagagctgcatcagccgcacgccgtggaggtgcggcggacagacgcgcagcggcactagtaagctctaattcaccgcagaggagaagaaccgggcgggtcggggatactctggtgataaatcccagccatggagtggggcgatcaaacgcaccgaggacagtgggagcttcggtgaggggtttggggcatctagggccacaacttgggcaaggggtggagctgcatcggtcgaacaccatgtaggtgcggcaaaccaacgcgcagtggcaccagcaagctctaattcgccgcagaggagaagaaccgggcgggttgggggtactcttgcgagcaatctagccacagagtggggtgatcgagcgcaccgaggatatcgcgggctccagtgagtggtttgggacatctagggccacaacatgggcaaggggtggagctacatcggccggatgccgtggatgtgttgtggaccgacgtgcagcgacactggcaagctctaattcgccgtagaggagaagaaccgatgggtcgcgggtacaatggcgagcaatcctagccacgaagtggggcgatcgagcgcaccgaggaaagcgcgggcaccgatgaggggtttgggacatctagggccacaacatgggcaatgggtagagctgcatcggccagacgtcgtggaggtgtggcggaccgacgcgcaacggcaccggcaagctctaattcgccgcagtgaacaagaaccgggcgggtcagggtactctagcgagcaatcccaaccatggagtggggagatcgagcacaccgaggacagcacgggcttcggtgaggggtttgggacatctagggccacaacttgggcaatgggtggagctgcatcggccgcacgccgtggaggtgcggcggaccgacgtgcaacggcaccggcaagctctaattcgccatagaggagaagaaccgggcgggtcgggggtactctggcaagccatcccagccacggagtggggcgatcgagcgcaccgaggatagcacgggctccggtgaggggtttgggacatctagggccacaacttgggcaaggggtggagctgcatcggcctcacaccatggaggtgcggcggaccgacgcgcagcggcaccgacaagctctaatttgccgcagaggagaagaaccgggtgggtcgggggtactctggcaagcaaccccaaccacggagtggggcgatcaaacacaccgtggacaacacgagctccagtgaggggtttgggacatctagggccacaacttgggcaaggggtggagctgcatcggtcggacgccgaggaggtgcggcgaaccgacacgcagcggcaccggcaagctctaattcgccatagtggacaagaacttggtgggtcaggggtactctagtgagcaatccgaaccacagagtggggctatcgagcgcaccgaggaaagcacaggctccgttgaggggtttgttacatctagggccacaacttgggcaaggggtggagctgcatcggccgcacttcaggtgtggcggaccgacgcgcagcggcaccggcaagctctaattcgccgcagaggagaagaacctagcaggtcgggg

SEQ ID NO: 377 - DNA, 2631 bp, Zea mays
gtctttcgactgagcctttcgttttatttgaccatgttggtatgatttaaattaatacgactcactatagggtcagtgcggccgcgacttcaagtcacgggcgtctggccggcggtagccagccatagccggtcgtggctgcatcatggccgaaccacggtcggccaagcaggcaacaacagccagttggagttgggtgcggtagggtgccgaccgaccacggctaggtcgcgagggggtgcggggctcggccgaggagacttggaggagtcgctggaaacgctatggttttagcagcattttgaccgggttttggctgcacgagttccctaccacctactatacctaaggggcatccccctcctaggacttcggggagttctgcctttagaaaaccagggcattttcctaggacgccacgaaacccatctaagatggccggacaccaggttttggctcagaatcaggggtttcgctagcgtgacccattttccctcacgggtggacccgaacttccacgtctcattcgacggaccatgggagggtcctgtgcccttccacgtgtccgtttttgcgatcgtggccgaaatccgtttttggttcacgcgccatggcgaacccctcgttttgagcccaaacgcaaggccgaacagccctgtcgcccgttgccttgcgcctctgagccgttttccctccattccaccgtgcccttcaaccgagtcctacgtagcagcatcggtgtctttccacacgcttggacttagcccgttttcgcggccgtggcggaaccgccaattttggcctgcgcgccatggcgaacacctcgtttttagcccgaaacgcaaggccgaacagcactgccgcccgtcgccgcgcgcctcctccagttttccctctgttccaccttgcccttcactcaagacatgccctttaggttcggtgtgtttccacacgcttggacttagcctgctttcgtggccatggcccaaccgtttttttggcccgcgcgccatggcgaacaccttgttttcagcccgagacgcatggccgaacagcactgttacccgtcgccgcgcgcctcctcccgttttacctccgttccaccttgcccttcactcaagacatgccataggttcggtgtgtttccacacgcttggacttagcccgttttcgcggctgtggcccaaccgtttttttggcccgcgcgccatggtgaacacctcgtttttagcccagacgcaaggtcgaacagcccagccgcccatcgccgcacgcctcctcctgtttcccctccgttccaccttgcccttcactcaagacatgcactttaggttcgttgtctttccacacgcttggacttagcccattttcgcggccgtggcggaaccaccgtttttggtccatgcgccatggcgaatacctcgttttcagcccagacgcaaggccgaacagccctgccacccatcgccgcgcgcctcctcccgttttccctctgttccaccttgcccttcactcaaggcatgcactttaggttcggtgtctttccacatgcttggacttagcttattttcgaggtcgtgctcgagcctcagtttttggcccgtgcgccatggcgaatcccttgtttttagcccagacgcaaggccgaacagccctgccgcccgtcggcgcgcgcctcggtgctgttttccctccgttccgtcgtgcccttcacccaagacatacacattagcttcggtgtctttccacacgcttggacttagcttattttcgggttcgtgcccgaacctcagttttcgacccatgcgccatggcgaggaacccctcgttttcagcccagacgcaaggacgaacacccatgccgccacgtcgtcgcacgcctccgacccgttttccttctgttccaccgtgcccttcaccaaagacatacactttaggttcggtgtctttccaaatgcttggacttagcttattttcaggttcgtgccccagccaccgtttctagcccgagcgccatggcgaaccacctgtttttagcccagacgcaaggccgaacagccctgccgcccgtcgtcgcgcgcctcctctcgttttccctccgttccaccgtgcccttcacccaagacatacacattagcttgggtgtgtttccacacgcttggacttagcttatttccgaggccatgccccagccaccgttttcggtgcgcatgccatggtgaacccctcgtttttagcctagacgcaaggccgaacagccatgtcgcccgtcgtcgcgcgcctccttgtcgttttccctccgttccatcgtgcccttcactcaagacatacatacaccttagctttggtgtctttccacacgcttggacttagcttattttcgaggttgtgccccagccgccatttgcggcccatgcgccatggtgaacccctcgttttcagcccagacgctaggccgaacagccctaccgcccgtcgccaacgttccatcgtgcccttcacccaaggcgtacgtagaagctccagtgtctttccacacactgggacttagcttttttttggtcgtgcacgaacccacgacggttttcagtctcttgccatgctgtgccttggtcgtttccgttcggaaga

SEQ ID NO: 378 - DNA, 2631 bp, Zea mays
atggcttttctacggacaacataatttggttcattaaacaaacagcgcggcgaaaacagtgcgtgcagcccaaaacatcaattaataattttcagctcctgtataattcaagaattgccatgttctagagactgaaattattctaacttatatcaagacacacttaagcatagtcacccaatagatgacgtgatggctacgcagtcatgccatcgcttcaccacacaatcccaagtaacaaaaaaactctaaccgaacttggcatttagctgattgatttctaaaccatttttcataccaccactacgcgacataccgaatacattggatgtctcgttcacatttcacatatatcattaccaaacattctcacatcgcttgcatcttaacctaagcttcactacacaattacaggacatctacttaattcatgaatatcatcatcacacacatcgactcgatttgatttaaccctacatgtctatcacatgaatggagcatttcaacaaatattctacaacaaactaacttcatcacacatcatgcattacaaacctacttgtcaactcgaaacatctattcgaagtcataaacacaaccatacactatgggcgatgtgaaatttaatgaacgcataatgcgtattgagtcgacttattaatatagaggaaatgatgactaccttgacatgtcaccacctctctatttaagccaagccaatttctaccgtcgactaagagttactttccacgcacaaataaacctcaacttaacacaagtgacaccgatggaattttactaaactcaccatgagcgtaaccccgtctcgcatacaaccatattctggcgtgcactcgagacattactgtttacttaacgcaatcattactacaatgcactttgatatacacgtttgacaatacagtgctcagacaaacccacacttccaatctacttttcacatccaaccaacaccacgtgtccactgcattcttatgaccaaattttagcacaattagttatgataacacttatcgactagacgagtgaaacaccaagtgattattcgcacatctcgtctttaaaacactaatcacatgtcacataatttatattttcaacccactctaacccacaccacgatgaatacataaaatatatttaacatagactaactcattagccgactgcggaaaccaccaagcctgctttacactttattagatttaacacaattaacacactgctttacgacaaagtattttaacaaacaattaatacctccacgaaccatcctcgtgacacataaatgaaccatcgcagccacatatattcaaacaccaatatacaccacatcgaccaaaacataattagacaaactacaaatcgcaaacatcaaacaacctcttgttctccaaccgcaaatgcgaccccactaatgtgtataaccgaaacattttacacacatccacacatatacatgcactgcatgacatcaaccaaatcatatgtatgctaaactataaatcaatcaacatggactagatcggattcgagttgtgcttgcatgtggtccacccgaccggccttgtatcaaacacgcgtgcgcgacggatggcattgacggatagctgcgattagacacacacaacagttcaacattttgccgagcacaaaaatatgatagcagcaagggcagtagggtgactcaccaggggtgaacgacgtcgatattggggctgcgtaaaaacagcaaacaaccggtgagcgtcgacggcgtgttgtccacagggcttcacaaaacagcgagcaggcagcatgcggagacatcggggcagctgcgcaaaacatcgaacatgtagcgcgcgacttcctgtcgcagaccatgaccatagggaggaaagctgctcgccatgggagagagggcgctgtgcagggcatcgaccagaggtgagacgcggcagggaggaagccatgggaggaagataacgttggtcgtgttccctgcttgcttcatgggaaagaaagagggtggcatggggaagaactctctgtgcgcagatgtggccgagaaggagaggggcgctagcttctagctggccgtggagcagggaacacgcccatggggtgagttcgcgcagcatccattgcagggggtggagctcgcgcccatggagtagggaagggcgcaggcttaggcgctcggatggggtaaaggaagaaggctggctggagcagaggcgtcgctggggaagaagggcgccgtgttgcaggggcaccgagcgccatgggagaaggagctgagctccctgctgcagtcgtgaggaagaaagagacagggaaaaaaggtggcgctgggaaatgtcagaggaggagaggtcggcctgcttgcttgaggaagaagaagggggaggagggaaggacgccatgggcagggaggaaatttccagcaccatgaacagagaagaagagagctgcgtgcgtgtgggagaggaggaagaaggctgttgtggcttggggggtagaagcaaattttccaatttgcaaagagagacacttgtatttatagacaagtcctagggttagggttccaaatgggctgggttgggctggcccaaaacacgtaatcgg

SEQ ID NO: 379 - DNA, 2630 bp, Zea mays
ccttccctgcaatcccgcccccgccagcacgccaagcgtggatctcgcgcaactcccagcgcgcagccgctgatcccatccccgcgctcccctccgctacccatccatctcgccgtcgtcctcgcccaccctgcctcccacgatggggagccccatccgcgacctccctcaatccccggtcacgccagcagcgcctcccagattcttccccgttcatcccgcccccgcccgtgatccctccccgcgctcccctccgtgaccatcggactcccttcgatggtgcggcccttccatcgacgccgacccgtactgctatttaaaaaatccaaagcgatgatgccaccccacccccatcctcctcggatgtgcagaaatatcaaacatcactaaggtgcgtcaactctattcttgatacttctgtttctgttgttctcaaggatttggattcaacattgtactagcagtttggaatcaccaggcagtgatgctttccatctagccttgtttagtagtgaagacaaaaacagtagtgaatcaggttatgtaatttttttcttttagattatgtgtaatatatttttgcttgaacgtctcggatttaactaatgttgtttctgttgtaatcaacatggtatcactgtttagggtttagggtgctccttactggcattgggcttcagttgaaacccatttaacatccgaactgttcggcattacaattcattgtatagtatcatgtggttgaagctccttactggcactgggcttgtttacaaactattttactaaacagttgaatccaattttaatttgaactcatagtatacatgattctatataaatcatgtctcattcacaagctttccggttcttcatttcagagctctaaagccgattacgtacacctcttcttaccacgtacgcactttaatctgctttctggtttagagcgcagtctcctcggcaacttcttctactgctaactcgggtgcaaggcaaggtacacatatatttcatatatagtagttgtattcaacatgatggtagctgcgaggaggattctattcagtatttatttggaaatgtagttctgaggcaatcccttggtgttggttgatttgtaaacctacaagttagacttaacacgcatcccacatctctaggctttccttattgcattgggcatgaactgattgctggtatgagttgatctttggagtgttttctaaaaggtttaagcacaatgggcatgggtacaaactaattggccaagggtttacactgttttttcatgataacacttgatacatagaaaatagacatatggtttttatgtttgaccatatttcggtaaaagcctcatgatggtagctgcgagcaggattctattcaggatttatttggaaatgtagttctaaggcaatcccttggtgttgtttgatttgtaaacctacaagttagacttaacacacatctcactgttggttgattttgtaacggtggatttaaacttaacgctatgagtagtactgatggtgtctcccattgtgggaaaagccctttcggtatcaacttttgacaacaaaaaatgacatttggtttacacatgatctagaatgccgattgcttcacatctagatgtccttgttagtggtgttatatgcttcacccatgatggtattgactaaaattgtgatgttgaacaatagtggctcttagttgtttctagtctagctacttggaatactgccaatagaaatcataatagtgccagtcagttattttggcaaaccattatccaacaattgttgcaggggtacggtcgatagtcatatgttttttgtgtttatcatttgtgcttgaaggtggtctgtttacagacaacgctcaactgccatataaatattcacactatgttccaaataaaactgacataaatatctgcactgttaggagatgaatcactaaacaccgtctatgatctgaccatacctatgctctgtttagccagtgcttgtcactgcgggcgaggttttcattatcataagagaattgcatcttcttttcattatcataagcatgtacctcggaaaacttgtatttaagaaacccaaatcaacgctgtctcaccactacgacgcaccctctagattttatctcccctgaagtttgtgttcctatagtttgtgttcctcgataactgtactactaaaaacagaccatatttctgatagtaatttgttctgtgacctgtgacacttgagggccatcttttgtgtcattcatgtctgttttgggtttggggtttttgtgtgggggataatagaaatacaaccagtcaagtgattccccatttgtttttgtttggagataatagaatacagttattctctagcttttttgtgttaatagaaataatagtttgcagtgggaaaagtgccacaacatgtcttttttttatgcaatggaatcaatctcgcttttttaataatagattgttgtgcggcaatagctgtgtaaaccagtcttagtctcttgtactaaaaacacatcttactaaaaaaggtactggatggagttcaaaaacagcagggaagataaaatatacagagtttagttccttttgtcac

SEQ ID NO: 380 - DNA, 2628 bp, Zea mays
ctaatccgttataatattgcacatgatatacttggctttaaataaaaactgactatgaaaccaaggaaacaatatgtgctaccttagttgtgcgcacaggtcaacacctcaccataaacgtagcaaatgaatttggtaaccaaagcaaggtcaacctatagcgcagtcagccaaaaagaacttctttgtgtgtgtggggtgggggatagataacctctataaattagacggagaccatttataatggaacaatgtcattaatataacagaataaataagagtaattttaatttataacagaataaataagcattgagtacttgcttgactccttggatttctaaaggtatgttacttgaccttttttcttatataaacatattttacagcatcttacaaatcatatttcctgctatcgtgaaagggtctctagcgtaatggttaaggcttccgaatagcacctccaggtctcgggttcgatcgccctcgggggcgaatttcaggcttgattaaaaaaaatcctcttgctgtgccccacctgctctcggagatcgatatcctgcgcgccaacctccggctgggccgttgcagagtgggcagttgatcggcccgttagtgatggggccagggtttgagggttttctcggctggaatcatgtttcggtctcttcttaatataataccgggagggcggtcttttccttcccgaccgggtttttttatttcctgctttcatgatacatttgttttacttagtcttcttatatttgtcatggtgtatgtgaagatagaggggacatgagtgtctgtgggaaaagcaatgcacatatcgggaattatatggtggtcaggcaaatagttctagccttaacaatttcagtgatgagtgtgaaaatcaaacaaccagcaatgatgaaatatccatatcagagtctaatttgtaggtcgggttatgtcccgagtggagcgaaggtcctgaaggagctagagaaaatcctctatcttcacataaccctcaggacctccaaattggaatccatagatacaaagttttgttagtacaacaactacaacattaagctaccaaatatttttgcaagagttgtcagaggtactggactacaggtggaagcatgagaaatattcctgtttgtgatggaaggcgcaagagcaagagctccagcatcatgatgattctaggagtactatagctactccttggggagaggcttccctctatccattgtacgtagaaggatatcaagcaacaattaccttcgagcctgattctcctctatgcaactccatggcctctttgccgaagattggtgtaggagagcagattaagagttgcagccctgcttcagcagcatgacccagagaaacccaaatatgtccactttctactacaccatcagatggtccagggaatgaaccacaaaaaggaatgtcgagcgcaatcaaaatggttgggcatagcaactgagtcactttagtgcattttataccattcttaaaaaaaaggaataaaagaggaatgagactcagttcggtaccttgaaagcacaaatgtatacccattcccaagcatatcctaaaccattccctggcatggtgcttggtttgatcattccaagaattaatgcatctagcacaaaaacctagaattggtttttacttcgacattagaagcctcacttacaaattcgatatgaaaatgtgtactgcaaaaaggagaccctttgcacctgcctagaatatggaaatgaacacatgttattgtccatgcaaattattgatgcatgaaaataaaatggcacactgccccccagatggccagacccataggtaagcgtccgcacacttggcttcgcgtcttcatgtaacacccaaaatcctaacttgggatttgaggaaattctttgtaatttttttatcacactatacaaaataagtgcctttgataaataattgaactttagaatccaccgctctctaaagagaatgattataataaaataatgttggtcaaaacaggtcttaatgaagattagacactggaaaatgatttcaatcaaaataaatgaatatgaacttcgggatatatctttaaattgattacacaccccaaacaatatcctatgtaataaatttggtgtaaatttcattacctaaataagataatcataataaatcaaacacattatgacgggcagtaggagcattattcatattatattttgtgtttaatatctgaagctaaagttcaaacaggaatttaaatttgaagttgatttgagtgtttgaaatttgaaatagaaaggaaaaagaaaacgaaaagaaaacacaggattcaccgtcatggaccggcttttcctccccctagcccactaccacacacgcgtctagatcccttctcctgtgcgcggcccactttacccacacccgcgctagctcttcaccacgcggggactttgacgcgtgggtcccattgcctagattccctcgccgcgtgcctctgctctttcagccaccgccacatggggccaccctgacagagtcgtcttcaacccgatgtccgttagccaaaaatcgtgccgagattcttgttggaacttgctctcctgg

SEQ ID NO: 381 - DNA, 2627 bp, Zea mays
tacatatagtttaagatagcatgcctaaaatattattgtttatagtctagcatagagcaaattgtaattaaaattggaatgagaatttttctatatttaattcttttgttatagatatcattgatataactttaatagaataatatcaaagaatcttaaaacatggatcgaaataaaagcataattgcataaatatagctctcaactccggaaaattaccgatctaaaaaatatacatgttgcactttaaacatttctaaagttacctcattcttcatatctacaaactatagtggcagcattcaaacatacaatatcatgggccccaaactcaagctataggttgtcttgcacttaggttgatgatgaagcaagtgaaacaacatgttgcatagctcacgcctatagtaaattgatgatctgaaaaaaatctacatgttgttcttcaagcgctcttagagtcacctcatcctttatatgaccaaatctactgctagaatgcgacaatctagggtcgcatgctcatgttatggttgtctcgaacatgagttaacgatggtccatgcgaaacaacatgttgggccatctataaaaactgtctgtctaaacaatacaacatttagggcttcaaaatgctttgaagttgacgcacatcaaaaatcgatatatcatgtagcaaacttgtgctaatataatacccattagtccattactcatgttttgatctgccttaaacttgggttgatgtgttcacaactgaggaacattgcaaatagcactatatatgtttttaaggtaacatgcctaaacatgtatgtcttacaagacgacatttaggaaagtgtaatgaaagtggaaatataaattttctttcattaactatttttccattaatagaggttgtaactctgcaaaatagtttatcttgaaaaatctgcatattgcaattcaaatacttttaattctttaaaacactgaactttaatcggtatgcgacccgctaattatgtgggtcctatactcaagttattgattgtgttgaattttagttgttggtggagcatgtcaaacaacatgttggatcattctgtaaatctaccaaataatttagggcttcgaaaagcttcagagttttcaaatggttcatgccacaatcttttcgaaaaaacatgcacgaaatcatgacactttactcccaaatcagtgtattgcaaaaacatggatgacaaatcttgttgggtcatttttgtaaaaactaccgttctaaacattacgtcatttagggctttgaaccgcttcaaacttacattaatgttcataaccatgaaacatttgatatctttccacatatcttatgagataacatgcctaaacaagtgatgtttgcagtttggcaatgagcaaattgtaatgtaattttccttggttaaattgttttgtgataaatatcatgagtcccatacttgttttttgagtggcctcaaaacatgcatttttgttcataaccaagaattatttaaaataacactacatatggtttaaaatagcatgcctaaactaatattgtatatagttcggcatagagcaaattttaattaaaattggaatgaattttttctatatttaattcttttgttataaatatcattgatataattgtaatagaataataacaaagtatcttaaaacatagatcgaaataaaagcagaattgcataaacacgactctcaactccggaaaattaccgatctaaaaaatatacatgttgcactttaaacatttctaaagttacctcatttttcatatctacaaactctagtgccagcattcgaatatccaatatcatgtgccccaaactcatgctataggctgtcttgcacttggggtgatgatgaagcatgtgaaacaaaatgttggataactcacgtctatagtaaagtgatgatctgaaaaaatctacatgttatgcttcaagcgcttctagagtcacctcatccttcatatgaccaaatctagtgctagcatgctgcaatctagggtcgcatactcatgttatggttttcttgaatatgggttaatgatggtgcatgcgaaacaataagttggatccatccgtaaaagtgtctgtctaaacaatacaacatttaggttttcaaaatgcatcgaagttgacgcacataaaaaatcgatgtatcatacaataaacttatatgaaattaatacccattagtcccatactcatgatttgattggccttaaacttgtgttgatgtgttcacaactaaggaacgttgcaaatagcacaatatgtgttttaaggtaacatgcctaaataagtttgtcttatagtacaacatttataaaagagtaatgaaagtggaaatataaattttcttccattaatagaggtcgtaactctacaaaatagattatcttgtaaaatctgcatattgcaattcaaatacttttaaagttacctcattcttgaaaacgctgaactttaatcggcatgcggccatctaattatgtgggtcccatactcaagttaatgattgtgttgaattttagttgatgcagcatgtgaaacaacatattgtatcattctgtaaatctaccacataattta

SEQ ID NO: 382 - DNA, 2627 bp, Zea mays
caatattggcagttcatataccaataggattttactccacaagcgcacggagaccgattttagcccttcactgggagtactccaagtatcatattttacacagtgaagcgacaggctagaagtggattgaccaaactcaacattgaattgaaatgtaaactttggtacgcgtatgcactagtgattagatagggtaaatgcaaaggagaggtatagaccctatgttctgtagcaaggaaaagttgcatgggaggacaacaagggttaaaaaaccaaactattacttttaatactctacaaaggattattcatggttaaccaattgtttatcaacttcaagaaagaacttgtttcgagcaaaatccaacgcaccaaagggtttctatagataggaggatgaaacaccaaaggtagccaactatcaccaacgaacctatcgaacgatggggtcaggatacataggccacactcccgctgtcaccatgaggtgctaccgatcatagctgtgtggataggatggcatgttataacagtggtcaagcgaagcatcatcactaaagctctgcatggatcagaggttaagaattagccagtttagcgacaaagagtagtgacttataacactgacaagtcagatgagacttgataaacaatgactagcataatactaagccttaaataaaagtgcctcgcaacaataaacaagaagtaaaggcaaagtatacctaagtgtaataacaatgtaaagtagagatagaactcacaatgacacccaagataattggtttccaactgatagtcgatgatacaagagggagatatgcaggacatcaagaaggatccaaaactctcaaggtaaaagctcagactcaatttaactcctaagaactaacgtaaactactaaaatgaaaagaggtgactctctatggtgaactatattctctctttatcttcctccaaatgacctcctaggggctatttatagccctcccaaggcagggggcatttacagtgttacaaggtcaatttatgggtcaaaatggttgcatggacgtggcatggtatgtcgagacgccttccacgtggccggttggccaaggaggagaccctatgttctgtagcaaggaaaagttgcataggaggacaacgagggttaaagaaccaaactattacttttaatactctacaaaggattattcatggttaacgaattgtttatcaacttcaagaaagaacttgcttcgagcaaaatccaatgcaccaaagggtttctatagataggaggatgcaacaccaaaggtagccaattatcaccaacggacctaccgaacaacggggtcaggatacataggccacactcccgctgtcaccatgaggtgctaccgatcatagctatgtagatagaatggcacgttataacagtggtcaagcgaagcatcatcactaaagctctgcatggatcagaggttaagaattagccagtttagcgacaaagactagtagtgacttataacactgacaagtcagataagacttgataaacaatgactagtacaatactaagccttaaataaaaatgtctcgccacaataaacaagaagtaaaggcaaagtatacctaagtgtaataacaatgtaaagtagagatagaactcacaatgacacccaagataattggattccaactgatagttgatgatacaagagggagatatgcaggacttcaagaaggatccaaaactctcaaggcaaaaacacagactcaatttaactcccaagaactaacgtaaactactaaaatgaaaagaggtgactctatggtagaactatcttctctctttatcttcctccaaatgacttcctaggggtatttatagccctcccaaggctggggagcatttatagtgttacaaggtcgatttatgggttaaaatggttgcatggacgtgacatggtatgctaagacgccttccacatggtcggttggccaaggaggagaccctatgttctatagcaaggaaaagttgcatgggaggacgagggttaaagaaccaaactattacttttaatactctacaaaggattattcatggttaaccaattgtttatcaacttcaaggaagaacatgctttgagcaaaatccaacgcaccaaagggtttctatagataggaggatgaaacaccaaaggtagccaactatcaccaacggacctaccgaacgacagggtcaggatacataggccacactcccgctgtcaccatgacgtgctaccaatcatagctgcgtggataggatggcacattataacagtggtcaagcaaagcatcatcactaaagctctacatggatcagaggttaagaattagccagtttagcgacaaagactagtagtgacttataacactgacaagtcagatgagacttgataaacaatgactagcacaatactaagccttaaataaaagttcctcgcaacaataaacaagaagtaaaggcaaagtatacgtaagtgtaataacaatgtaaagtagagatagaactcacaatgacacccaagataattggattcaaactgatagtcgatgatacaagagggagatatgcaggacttcaacaaggacccaa

SEQ ID NO: 383 - DNA, 2625 bp, Zea mays
tgtaacacccctggtgtttatattccgctcgacaacgagtatggaattaagcacgtaatatcagtggataaaacggatgctaaattttaatcatcttcgcctatcgcgattttaatatcgcatctgtttcgtctgtcgcgagttcgacttcgtttttatctatccgggctgttcctaaattttcgtgatgttcggaacatagttgttccaaaaatcggtgcgtgcggtgatttcttaaaactcatcgctcccgcgaatacgaattagaagttcgacccactcggatgattttatcccgaacaaattaatttgaactcgacgactaaaatgtctgagaaaaatcatgcgcgagattgctaaaaatcatgcgcgagattgctaaccaaggaattataattgagatttgattctccaattaatcatctatggcagagtgatctggtgttcgagtggcagacgaagttatctgatttcaagtggtatcaaatatagtttaaaatatcagtctcgatctcatttgggttcattctatttgcatcctatctgaacccgatattatccgagacaaagagaataatgtttgattttatagcagctaatactgggtccgaaagaatactccggatcgcttgcgttaccaagaaaccgtgcacaagattaacaattgggattattcattagtgtgctattctaggtagaaaatcaaatcgattcagaaaatacataaatttttatttgagttcaactaaattaatagagtctcaagtaccatatccggatagtgttttggtccttgtgtttctcggccagatccaaaacttcggatataaataacgggtgaaaattcatctaatttcgagagtattcaccaaatcaaatcctatctaaatattgttgtcggtctcatttttgtttgatccttttgtatattttttagactctaatttcataccctaaaatatgcatattttattgttttaaaaaaggaaggaaaatagggaaaatctttctctaaatatttccactgttccttggtatgattttcaacgtatttggatttttcactagagaaactatctctctatcgttgttttcttctcatgtacgtaaacttcctagaatatcattggccgtcatcgatattttctttgccagcaatcgtattcaatgcatttttttcattgtctctgtcgccgcttaagtgggtaaccggtagaatatcttcttctacatgcgcatcctctcccagccttatcttcttctgcagatttttttcctcggcattatctctgctctccacatggcagcaggcgctcgttctcacatcttcctactgcagccgcgccctggtcccggacatcctagcgccgtcccatctcctcccttccagtcgattctctgctcttccatggctgcttgctcccctgcgcagccgctcagctcctcgacctccccttgactttctccagccgtcggtgctcgccaagtcaatctcccatggctgccggttagccctgctctccaacgcaagccacgctcctccatcgcgtcgttcctccgctcgcccacctcgtccatggctgtcgtgccgagttcacacagcgcgcagccggcgtttctctctgtcgcgctcgcacagccatctcccatggcgcgcgcctcccctgcgcgtccgtctccctgctccaccttcctatcgcacctctctccgtcgaagctccctgctgctcgccatggcatcttccagtctctgcctcgccctgctccctgttgccgcgagctccagctcggattcagcccagctcggatctttttcattgtcgctgcgcactggccctgctcggattctcgtcgtgctcgcctgggcgctgcccagtggccgcctgctccaatcgccgctcccagtcgagtttacccttgtgcgcaaccgtgggtttcgctgcgcagcgttccttctccccggcctccgtcgtgctcggcagcaagtatttcatgtcgaaacagcatctgcgatcccttgcaccgtgctcgccagatcgagtctcgtgtcgtcgatctgcgcagttcctgttcggctatcggttccgcctacgtcgatctcctaattgccatgggtcatgtatcgacgtcccattacaacagcccgtcgtaaaactctagtgcttgtcgttgatatccggacgtctccaacctttgtcttgccgtcgtcgttcggtcaccccgtctcgatgttggtccctacgtgatgcctccaagtacgttggagtcgtgctgacaaaagaagccccaagagaagatgtccaaaggttggatggtggggtgtgtgaagttcggatagtatctgccaagcgctcgacaaattgcctaaattggagaatcattaccgatctcacggattcgagtcagctattggaacggtgagccgatttactatttttactattgattttatgatcatgaaataagacgcttagtttgcgtataaagtttaagttaaagaggccagcaatgcgaggtgtgcttcgaggagtttagttgccgagtatattcgaactagttatattttgcagagtgtagtatttcggtgacgtgtaggttaaattcagtattttatacgattgttga

SEQ ID NO: 384 - DNA, 2623 bp, Zea mays
gttcttctcctctgcggcgaattagagcttgccggtgccgctgcgcgtcggtccgccacacctccatgaagtgcggccgatgcagctccaccccttgcccatgttgtggccctagatgtaacaaacccctcaacggagcctgtgctttcctcggtgcgctcgatagccccactctgtggttcggattgctcactagagtacccctgacccaccaagttcttgtccactatggcgaattagagcttgccggtgccgctgcgtgtcggttcgccgcacctcctcggcgtcagaccgatgcagctccaccccttgcccaagttgtggccctagatgtcccaaacccctcactggagctcatgttgttcacggtgcgtttgatcgccccactccatggttggggttgcttgccagagtacccccgacccacccggttcttctcctctgcggcaaattagagcttgccggtgccgctgcgcgtcggtccgccgcacctccatggtgtgcggccgatgcagctccaccccttgcccaagttgtggccctagatgtcccaaacccctcaccggagcccgtgctatcctcggtgcgctcgatcgccccactccgtggctgggatggcttgccaaagtacccccgacccgcccggttcttctcctctgtggcgaattagagcttgccggtgccgttgcacgtcggtccgccgcacctccaaggcgtgcggccgatgcagctccacccattgcccatgttgtggccctagatgtcccaaacccctcaccggagcccatgctgtcctcggtgcgctcgatctccccactccatggttgggtttgctcgctagagtacccctgacccgcccggttcttgttcattgtggcgaattagagcttgccggtgccgttgcgcgtcggttcgccacacctccacgacgtctagccgatgcagctctacccattgcccaagttgtggccctagatgtcccaaacccctcatcggtgcccgcgctttcctcggtgcgctcgatcgccccacttcgtggctaggattgctcgccattgtacccgcgacccatcggttcttctcctctacggcgaattagagcttgccagtgtcgctgcacgtcggtccacaacacatccacggcatccggccgatgtagctccaccccttgcccatgttgtggccctagatgtcccaaacccatcactggagcccgcaatatcctcggtgcgctcgatcaccccaatctgtggctagattgctcgcaagagtacccccaacccgcccggttcttctcctctgcggcgaattagagcttgctggtgccactgcgcgtcggtctgccgcacctacatggtgttcgaccgatgcagctccaccccttgcccaagttgtggccctagatgccccaaacccctcaccgaagctcccactgtcctcggtgcgcttgatcgccccactccatggctgggatttatcaccagagtatccccgacccgcccggttcttctcctctacggtgaattagagcttactagtgccgctgcacgtctgtccgccgcacctccacggcgtgcggctgatgcagctccaccccttgcccaagttgtggctctagatgtcccaaacccctcatcggagcccgcgttgtccttggtgcgctcaatcgccccattccgtggctgggattgcttgctagagtacccccaacccacacagttcttctcttctgtggcaaattagagcttgccggtgccgcacttccacggcgtccgatgaccgatgcagctccaccccttgcccatgttgtggccctaggtgtcccaaacccctcaccggagcccgcgttgtcctcggtgcgctcgatcgccccactacgtggctgggattgctcgctagagtaccctcgacccgcccagttcttctcctctgtggcaaattatatcttgccgatcccactacgtgtcggtccaccgcacctccacggcgtccggctgatgcagctccacccttgcccacgttgaggccctagatgtcccaaacccctcactggagcccgcgttgtcctcggtgcgctcgatcgccccactccgtggttgggtttgctcgctagagtacccccaacccgcccggttcttctcctctgcggtgaattagagcttgccggtgccgctgcgcgtcggtccgtagcacctccacggcgtccggccgatgcagctccatcccttggccatgttgagaccctagatgtccgaaacccgtcaccagagcccgagctggcctcgctgcgctcgatcgccccactccgtggatgggattgctcgctagagtactcctgacccgcccggttcttctcttctgtggcgaattagagcttgccggtgcctctacgcgtcggtccgccgcacctccacggcgtccggccaatgcagctccacccattgcacatgttgtggccctagatgtcccaaactcctcaccggagcccgcgctgtcctcggtacgctttatcgacccactccgtggctaggattgctctgtagagtaccctcgacccgcccggttcttatcctctacgatgaattagagcttgccggtgccactgcgcgttggtccgccgcac

SEQ ID NO: 385 - DNA, 2622 bp, Zea mays
agcgtgtgcagtccaaaacaacaatcattaactttcagcttctctataattccagaattagtcgcgttctagagacttaaattattctaacacttcaccgttgattagagttaaattagtcaaattaggaccatcaagttgactcataaattttatccaagtcattttgtgcgctagatttaccatactcaattaaccacgcgttctccacgaaaatcaacatcgaagcgcttttcacccaataatttgcattttaacttagacttcccatgagcactactaagcttcatccacgaccataaacatacgtatttagactacaacaaacaattcatcgtgattccgcgcttaacccagtcatctaacaagttggctaactaatataaaacttagcaagtattttagacttcgcaactcaaaaacagaggtgggagcaggttaattagtttttcttaaccattttctcaacttaaactggaaaacacacaagtccttaaaacaccatattttggagacctcacatgtcgagcatcaatttataacctaagtgactcaacttctatcacgtttgacaactaccacatcacccgatttatctatttggaacaccgcctgcccagcttgctactagtaccccgcattttgattcaagcttaataatacatcctttattcgattatacaacagcaacctaagcgtcgtgttacccaatgtgtacatcttttctcgttgcgagtgtaaccatatcacggcatacacccgcacacctcaaacaattatctcacgccaccactaccataatacaccacggcacacacgcacatacgtgtactaattcaatcctcacatcacatgtatttccaaacttactcatcacataaaacaagcatgacacacgtgtttaccaaaacgtgaatgcgaccttgccacagcataaaatcaaaacattttatacccacatctagtcaaacaccactatacatcacatcgaccaaaacgtaattagacaaactacaaatcgcacacatcaacaacctcttgttctccaatcgcaaacgtgatcctaccaatgcgtagtaccgaaacatattacacacatccacatatatacatgcattgcccgacatcaaccaaagcacatgtattattataaatcaatcaacctgaacgggatcggatttgagttgtgcaagcacgtggtgcacccgaccggtcttgtatcgaacacgcgtgcgcgacgaatggcattgacgactagctgcgattagacacacacaacggttcaacatttttaccgagcacactaaaaaaaatgtgatagcagcaaggggatcggggtgtctcaccacgggtttcgacggtgtcgcggatggggctgcgcacaacacgatgttttcccacaggcattctgtcgaacagccaatgggcgacggcgagctcactgctcgagctggggctgcggggaaatccggctgcgaggagctatgctgccgggagagggagccgagcagatacgtcgcgtcacggggaggggacagcagggctgctgggcgtcatggggataggctcccgcggtgcctgctcggactccaagctgccggcggggtggagaaccaacagggagctgcacggctgggaaataggggcgccatgctgaagaaagggaaagtgcagggggggctcgaccatgggaggaagaaggtgtgggctgcacaggggcgtcgagctccctgctaccctgcctgaaggtggcgccaaggggagagatggagttgtcccctgcgccagttccatgggaaagaagcagcgaggagcaaccgagggagggagccatggctgctaggagcgcctgctccaggggagcccgaccatggctgccctgcgcaagggagaccagggaggagggcgccatgggaggccccaagcttctgcgctgagaaggtgaggtcgccaggagatgcttcagcgcgccggaaggaagggacgcccggccatagaagggggctcggcggccatggagcttctgctcctgcgcgcacgaagcagagggaggaggagctgccgctatgcctagagggggcacgctggagaggaaggtctaggcgctgggaggtggaggcgccatggctgctagctgctccctgcgctggcgagaaggaagggaagttccctgcgctggcgtgctgctgctgcgaacagggaggaagaatggttgtggcggctagggaaaaatggaggggtgggagtgcaaaatgaccaagggcaagggagagggatccgtatttatagagaaaccctagggctagggttgcttagtgggctgggccgggctgggccaaaacgccaaacaggttgcgctaaatattttccggactaaaaatgttcccgcggatttcgtctgtacgcaaacagagtgaatgagagttcggacgatcgggcgaatgagcgattaatttcagccgagagtttgacttgaattcgctcggaaataatttccctatgcgtgattcgaaaataaaatgcctcgggatatgaccagctttcggatttttagccggagaaatcggatcgtggcattttaaaatcacagtcgatacggggttttgaattcggttcggacat

SEQ ID NO: 386 - DNA, 2621 bp, Zea mays
tatattccgctcgacaacgagtatgaatttaagcacgtaatatcagtggataaaacgaatgttaaattttaaacatcttcgtctattgcgatttttatatcgcatcggtttcgtctgtcacgagtgcgacatcatttttatttttatctgtccgggctattcctaaattttcgtgatgttcggaacgtagttgttccgaaaattggtgtgtccggtgattatttaaaattcatcgctcgcgcaaatacgaaattcagaagcccgactcactcggatgatttttgtcccgggcaaattagtttgaactcgacgactaaaatgtttggggtaaaataattcaaatcgcgcgaaatcttgcgcgaggctatgacccaatttatcctccaacacgctgttttggcgagcgcaagagtaataattaggcctctttttccagtatgttgtcttcggcagagaaatcgggtgcttgattaaggaatgagactatcaggttagacgagttaggcaccgactaaataccgaagccgaaatccgactaattcgatctatttgcatcctgtccgaagcaaaccaaaccaccgtaattactactgacagcaagtaattagtagatgatttagttcgctaaatcatcagaatgaaatgtgtagctgtacagcatgtcaacctagtgtatattcctaaaaatcgtgatcgaaatatctgtgattttcggttaaaaaaaagataagaaagagattaaaaaaactaccagccgatcctatcgtggcgtgagaatttttctcatcctcccgtcgctatcctctccctggatctttcttcaccagtgcttatctcctccagccgagcgctccaatcttcatctgtgcacacatttgttttccatcgccgttctctctccgtggatatttccttgcgcgcgggcatctccagccgcccagcttcttctccctggtgcacgctgctctagcccttcgctccctgggcgtgtcgcgccctggcccggcgtcctctgctcgccacggccacgtgagctccagcgccgtgctctgctcgcggagctcctccagctcgccggagttctctgccgcggcttccttcctcttccgctctagctcggagctcccctgcgaccccgcccatggctggcgcttagtccctgcgcacgcccttgtgcccctgccgcgcccagctccagcgccctggtcttgctggtcatctcccctagcaagccccagctcgatttggtctctgtctgcgcgcgcgctgtgttcagcgtcgtcccctgccgaagtttccctgtctaatggcgctcggcttcttctccgtggagctcgcccctgcccaagcccggctgcctgtgcgctctttcttcctcctcccctgccgcacctggcttgcctcgatgctcttgctccagctcgccgtggagctctgcgccgagcttatccctgatctccctcggcgcgctgttttctgtcagccgaggttcttccccatggcgccccagcccctgtttttttcccagcgcccgactctagctccctactgtcgcggctcccagcttctctcctctgctcgctctcccagttcatggcgcgagcaagctcccacgcgcgtcctggcgtctgcgccgtaagactccttgcgtcctccctctgcttgccacagctgccgagctcccttgccgtggctgtcgcgtccctgcgcccagcctttagctcagtccctgtgcgcgcgagctcgccgatgtgctgctgttctagttcggatctcgcccatggcgtcgatctgtccgtcctgccgtcgctcagctcgcgtccaccacctttgttgttaacaccgtgtgctcggcttctctggcgctgatccgcgctcgcccatgtcaccatcgtagtgtcgtcgctagtgatagcttcgcgtgttgtcgagcccgtcgttttccctgtcctgtgctcgtgcggtttcctgttcgccagcatgccctctcggctcgctcggccttaattcccaatgtgtcatcaacctcgctggttatcatcgttcgtcgtcgcgtcgtgtgtgcagcagccctgggtctgtgcagctctatatacgtcactcttccgtattgtcgttgaaccgtcgaacctcgttgttccctcctcgaacatcctgcgcgactcaagttcgattcgccaaaattattcagtcaaggagaagatcttcagcaattaattaccgaagaagagaaggcccctggatgacgttaaccggaaactgtcgtcgtgcttgtgactattgcgtcgaattagtatgggtaagttgattcgaattcccgtcaacaaggtctataaatagagtaaatagaatcattggtctcaataaatgttattattttagcatgtgtatactgtgatgatcgatttggataaatcaataaatcaagtaattaagatacatagtttaaagagataataaaaagctaggaataaaaatagattttctagtgtaatatgtcaatttggttaatggatgtagtcgatgccctgctatgatatccatggtgcttaatgcttggttttaaagtgtttcatcctttttagtgtagattatctatattatactcgttatactcgtgc

SEQ ID NO: 387 - DNA, 2619 bp, Zea mays
gatttaagcacgtaatattagttgataaaatggatgctaaactttaatcaccttagcctattgcgattttcatatcgcatctgtttcgtttgttgcgagttcaacatcgtttaaatttttatccgatttcgactaaaccattgttgtctcaaatattgaatccaacatcgtttggtttgatctatcaacatctggccaaaactcagccttgcaaatttttcctcaaacaaattaatctagaatctagcaaataaagttttcagttcaaaataatctcgaccccgtgtgttatctgagaaatcgtgttcgaagtcaatgacgtggtctagcccattatttcttgctctactctgagcattcgggtagtagatgaatttatgaccaatataattttggtttggtcctttacatcccgttaaaaccataatcccataaatcgtagttattggaatgcttttgtttaaaaaggaagtaaaaaagaatccaattttctatctccatccagattttgtgtcaagtaacctcaatcttatcttgtgcacacactcaaactctctggaactcccctacgcacacgttattttttctcctttatccttacatcgtcggcttcctaatttttttcctctagccttatctctacgtctcctagtactcttccgtggacaccgtaccagtccttgatcttttctctggccttatccccatcgtggactcagcgtaatctccacgctgctctttctctctctagcttctcagccgcgtcggtctggtcggctccacacgcttgccatggatatcatgctttggcttcatctcatccgtgcctcttcgttctaggcacgtctctctctctgctccaccggtcgccactttaccatgcttcttcggtcgaagtcctctgtgtcggcaccctctgttcctccaccgtgtgtacgccagccagcaccgtgcgcgcgccctcctcaagcttgcttccttctgctctcctccctctccttctcccacgcatgcttctctctccagcgcccaacctctcctgcgcacggctggagctccacgctcgccctctccagttctcgagctcgccggcgctcctcaccggattctcctctgcgcgccccctgattcttcccgagccgcgcgcagcttcttccctgccgcgcccctgctttcccaagtcgtgcctcatctccaacggcgcctggccaagcttccctcatctccctcaagctcgtcgtggagctttgtttccccatgccgcgccccagatccagcttcctcccttctcccaactcgaccgctcctcctctctcccagcgcgtcttcttctttgctgctcgctggtgctctagctcggctactcaccggcgggatcctggtaccgcgagctcgctggacactgctccttggacgggctccactacgtcgctgccactgggtggcgcggtcggagccaactgatccatgcgctggggagccgtcctccgccgctcgccgtgcccctctgctcgccacggcgcgccgacttccccagtagcgccctgctaagtttctccctcgctgtagcccctggtcaccgcacttctgcaccctctcgttccccagttcttcaccctcctataagcacgccacttttcaacctctccgtgcatcgcgcatagagcgcagtcctccgctggtgaagccctgatcccgtggtgctggcgacactcgtcctcggcacgcttgtggttggtgcgactagagaaatccgtgacttgctgattttcctctgcatccagtatccgcggagtgcatccatggatttgtctacagtagggatgtctggtcgtccacctccgcgtgcgttaggtgtctttccgcgctctaactgctcggcctcaagctcagcacatctgagttccacaacacactccatcgtgctcagacaatgaagtttggttgtgtcggttgctagttgctcagacatccgaggtcctcttttggtgaacctaattgtgttagccttttatgtatcgtgctttagctatggaaaatatagaacatgttataatttatatattccttgatatatgagtccggttcaatccctcccgatgaaacacacacgctaagtattcggggagttgtctgaactagggatcattactgttttcgtgacttctgagtcaaattagtactagtgaatcgattcgctaatcctcctagctagtttgataattggatatgctgttaaaattaaatctgattaagttagaataccataactatagttttaatgtgatatcaacatctaatattttcgtactagatttgagataacttgctataggtgtttaatattctttgagtagctttatctatattataatatttatacttgcactcatacatgtgcatcatgcatttcaattaggtacgttagttgagcgcgtgatacagaaggcgacccaagttgaccagacgataacacggagattggacatctctgcaagacgacgtcgtcagtcggaccatcctgaagatggacatacaaagcaagtatcggaacaaaggttgatcgtcaagtgatcgacgtctaacaaacactaacctagtgtttattccaggcaagcc

SEQ ID NO: 388 - DNA, 2616 bp, Zea mays
tagagcttctgtgtactagtgtcactgcagtagcaaacaaagcaataggtcggtgagctttcacgtccatggaggagggcaaaacgaggtacaaaagggatgcaacctaccctagttgacccggccacagagacgctcacggctcaccagtcaccactacggagccgagaacggcgatggggaagatgacacttctctggagtttctaaagggagtggactggtttgcacgagctctagggtgcgcaaagggatggggaagcattgccttggctcaatttaaaggagggcggtaggaatccgactgaatttcaaaaagatctcgtgctctcccgccgtgctggcgagcctacgaaggtgtagacgaccacaacgagagcccaagtgaattcaccggccggaacggtgacaccctactcatgtttgcatgcgccgtgtagctagaggaagatatttacccttgcacacggtgagagcaagtagtgaatggagtaacggcggtgtcattatccacggttcagggcccgttggttccatctggaaccagcggccggaataattctggggtggaatgattcaaaccgttgatgatgtaaaacaaattttgcaattcgttgatgatgtaaaacaaatttttttggcaaaccaaactacggttactgatactgatctgtacgtgttcaacaaacagatggtccatctcagccagagccagccacaaaggaattcagaacacagattttgcccaaaatgcaaagcaaggaagatacttttgatggtgatggtactaaagaggactatgttcgtatctacaaagggtagtctaagtgacatgcagtcaaaaactctgaaggcaggcttcgtaagcttttggctgcacttggccgcaaacactattgttgaattttgtgatgttgcagtatcattttttttattatcttatatgaaaatagccaaactcaaaagtctactaaagaacataaactgagcaatgctgctgcttcaagaaaaagcttatcttcttatatgtgaatagtagttcgtgtaggttcaaaccaattcacaattttgcaaaagtaatgggaatggagccttcaaagatactactattgttcacccaaggttgctagatggaccaaatgaggagcagacgaagctcaatatgactgttcagcagctaaaaagaagagaagagcaatagaagggaaaaggtgatttgtcatccttctggtaccaaccactgtagccggtagccacatttcacatgatccggtcattctcacagtggcagcataaaaaaaagacgatacatttggtccatatataaaataacctattatagcatactttgtttaagaatattaatataaagcaaaatagaacaatgcatctagaagatacttcattggccttcttacaaaaaaaggggtgatcctaaggcgatcaaggtgcacagcaattatcaatacaaacaactcaatttgttatagaaagcccgaaccagaatatcggtccacgaacgagggaaaaaaatttggtgcagccctgctgcaaacagtttggtttgcagcccctcacaaaaatgatgatagaccccacctgcagtagcaataacacaactacaacgttatctggtggacctgcaggtgggatctatctgtctttttgtgaggggctgcaaaccagactgtttgcagcagtgctgcaccaaatttttttcccgaacgaggcacccaccactacgtttttttgcttcttttttgtgtaaagcttttttttgtaaagctgatacaaaagaagcgtaaaactgtgtataatttagcgtaaactactgataacgttatagtggcaagagatccactattctaggcgtaaaacacacgcacgatctgaggtggcgtaaagttgatataaaagaaatgtaaaattgtctattttggcataaaactaatacaaaagataaaattatgtataatttagcataaactatagctgacattatagcaagcaagagatccactatttagggcataaaagtcacgtgtctctcacttcgaaggaggttgccgtaaaatgcataagaaatgtcataaaacgcaacaagatgacatttagggtaattttagcgtaaaacataacaagtgtcataaatttagcattgatctgatacatgtttattcaacaattgccgatgtctatactgatgcgtacaatgaccagtggtttccacataaaatgcgccagcgttattagctgaacgaagagataagcaccctcttttttctcttgttttttctctcctctacctagtattgttatgatgtggtattccttttcgctagcagccttaatatacaagctccaataagaataggttgggaagataaaagtaagacttatgttctagaatctgaatatctattgaaacactgatattcgaagacttcttaacgtgcaaataaaacttcagatcagcactccatgaagcaaattaaaagaacaccaccagcttagccggatggtctggctctataacaatttcttcagaaatgtatcctgttcacgacatggtaaaaacagaaaacagaatcagaataacacatatgactgcattgcc

SEQ ID NO: 389 - DNA, 2614 bp, Zea mays
ctatgtgaagcgtacttggggatcgaccccctcctaaggttgtggcagtatttcttcggtgcaatcaaatgttatcgggtcgtggcaaccaactattagttagatcagccgttagctagctttgctccagtcggaagtcagagtacttcaagatccctctcccttcctccatttggtatgagggcgagtggttttgtgtgaggaatgtggctgcgagcgctccgttgttcaccagctgtgagtcagtgtcctcggatgagtggcaatgcagtggagaggccagcctcaaaatcgaggtaggaaacctgttgatggcggtcagtacgttgaagcagcggggtctctctagcgcgcggctggtgcgaaccttcatgcatcgccggtccagcctctgatggctcaccagaaactgatgcatcaatactccaaggtcaacaatcccgaccatcattcccctatactgcttgctctatctaagatcgaggccaaggttacaatcatcacggtgttgtcgttggatgaagtgacggtaaaggatgaagtgacggtaatgccacacaaatcagtaaaggatgtggtcgcgacggtgaggggagggcctccggctcctttagcccctgatcttcctgcgctggatgaagtgaccaccaacgaagaatctgggccccccgtgccaacctctctgcctgtctaaggggtgccttatagtgatgccttcctccatggtctccccgagggaggtttcagctgctggtgtgtctccccttaacggagcttcatcggaggagaagggtgctccagccccgctgctgccgccaccaaccccatgtgctgaggtggagatcgttcaacctgaggcggtgtcattattggttgtcgcttctactctagcaagagtcatggtcccttcgcaggcaagagggcgccgggtggaccatccttcttctcttcgtgacacgcagggcctagatgtggaggattggaggcgagtcgaatcggcttcgtctcttcacgctatccgcccagcaggagatggagaagctccgtgtgggggtcgtccattccatggcaaagtagcatgaacttgttgagctctgctctaagaccaaacgacttgagagtgaggtgacccaactacattctaagggcgaatgtgcctgggtcgaagccaatcaccttcatgtagaggagacccaactccagggggccttcatgaggtgagcttccgggtcagcgaggccgagtcatcccttggtaaggccaacgtccacctggagaggacaaatgcagagctttcgtgagagcacgacgctacagggggtgggtccctttctcactcttgtacctttttgtctttggttgatttatccttccttcctcctcagagctctggaagatgttttctcgggctgatgacgccaagagaacaacataggaggtgaaggcaacaattgtggcctaggtgcgagagctttcgcttgctggcgatgacgccattctcgtattggccgagacggtcactgcactcttcgagcagagcacgggctttaggagttccgcctggtcgttggcaaggtgtgcgccttgcttttgtcgtcgcctctaatcgaggtgcccttggtcgactggttgcggtcgcttcctggccatgtggagcatgtcatcgttgagggtgtgttccatgggagcgacctagctcttgggtaggtggtctcttactttgatgagatctacgttgttgtgatcgccgaaggcttcgccttgggccaaattgacgaggagctagactctattaaagatcaagtccacacttacgctagattgctcgccgaacgggtggatgtgaagcccctgctgactggcccctgaagtctagcatcgcccgctagtgacctgcccactagcgccaaggtcgcttcttgtttttgtccctttttgtaataatttccttggatggacaagatctccacatgacatgttatttccgcttcaaaactttcgccctttggattccggtctcaatgcctttttcggagtccacggatcattgtggtagtggtttcttctatgttagttggctggcgtgatcttcggtaggtgtagatccttttacttgcttcctgcggggcgtggcggcctaatcgccttggtgacttggtcatgacacttcgatcgaaaacatagtctggggcattggtacttaggtcggggaaaactaatcttctgtttggtggggtcttacgagggcaaagcgattgatgtgaatcttttgatcttcattgatttctctcttagcagatacagggtttgcgattcatatttgattgaatctgccttttcttacaaaacctatatgctaaaaattcccacacacgggcttccccttgcctcccttttgcctagtaatgatccgatctacgcgcgcttggcgatgtccacgacgctggctggtgtgcctgcctcaccgccatggtccttagagacaggctcctagagatcgatcaacgtggatgcgagctcgcaatttgctcatttgcatgtgtacgccatcttgatagacgtggaggctgtgatgatcctgtctcttatacacatctccgagcccacgagacgg

SEQ ID NO: 390 - DNA, 2496 bp, Zea mays
ttaccgatttatctcaatcgatcatcacaatatacacgtgctaaattaataacatttattgagaccaataattctattcactctatttatagacccagttaacgggaatatgaatcaacttaccctgactaattcgacgcgatagtcgcaatcacgactacgggttccggttgacgtcatctaggggccttcttttcttcggtaatcaattgttgaagatcttttcttcgattgaataattcggacgaatcgaacttgagtcgcgcaggatgtccgagcttttgtcgcgcacttggtgaacaccacgctgctagcttcgtcttcacccgatttttgaaatttcttgctgacacgcggaacgacgacgatctccgatatgagctatctgtcgagcacccggtaaacgccatgcgggtttcttcacccaatttcccagaattcccctccacgcgaacacaacaaagcgtggacgacgtgcagggctggcagggtctccgcgacaacgggagcaaagatgtaaagcgaaggcgatggtagagacaagatcgatagccggttcttgcattatgttggcaggtggcgagcagcgagcatagtagcgtcttcacggcttactgtggacacggtgtgacgtagtagaatacttggcaccgagcagagaaacagtgtgttggggctgcaggtccgggcgggatcgacgacgcgaccatcctggccgagcagggaactgcgtgcgaccacgacagactagtcggccagcacgaggaggcgacggcgagcgatggcaaccgggaggagcgcgcaatatccaggacggcctggctgggtgccgaaggagctgggcagcagggatcgaccaccatggctgggaacgggaacgcgacgcggcatggtcagagctagagggagctgcgcgcggcgtgctggaaaaagcaacagaacgagcgcgcgggggagcagagaaccgcgcgcgcataggagcagggagaagcacgcgcagagggcgagcagggacagaggaccgcgcgcgcaggggaacttggagaaccgcggccatgggcgagggaggagctcggccgggcgtcgagaggaaaaggaaaggcggctgggcgcgcggcaacaggaagaagaagcagcgcttgagagaggagaccggaggggaggtgtccagcgcgacgaccaccagtggaaactcgcgcacgttcatggcgatggggcacgagcagggaggaatccgaggggaaatcgccatgggagcagctcgatctggacgaaatccaagcaggaggattgggcgcgagctggggcggtcgagcgctgggaataggaagcgccgagcagggaggaagaagctttggggagatgggacgagcagaggaacttcgacgcgcgcagggaggagccatggcgagtggctgggctgggcgcgcagagaaatcggctggggagtgagggggaagcagctgcgtgcagcgaggaggttccaggggcgcgcccgcgcggcaccagggggaagacgagggcgtagggagccatggagaggacgccgggaatctgagttgaggctggacaccgcgaggaagaagacgtgggcgcttggcttcggaacttctgccggcgagtaggatttttaacagcgcggcggctgagatcttttccagagataagatcggctggaaaaatccaagctgcgggcggctggaggataggatcgcgctggatttttccacggatccagaacggcggccggatgaagatgagcagaaaaatcacggcagaaaaaatcaaagggagggaggagagcgactgtagatagagatgaacgaggatatttttcccttttttttttagaaattacagatatttcggatcacgattcttttagcgatgtatacggggtagacagtaattatgacgcggttttatttagttgaacctaaacgaatttcgcaaatgcttttaggtttccgatttttagcgctgtacactgggtcgatacactagttatctacgcatcccattccccgaatctcgaaatggaaatccgaggactaatgatttgatttggcgaattctctaaactcggacggaatcgtgctgttaattcacttttgagatttaaatcgaggcgagaaacaaatggaccgaaccactatagttttggcttcgaggatttgctctgcgtaaattgaatgaagttagacgaaaccatatctgcgaaagcacacatgatttcgtcgctaaaacaacgtgcagacggataaactgaatcatattcgcacagacgatttcacttagacgacgcgcgatacagattattttgcctcgaacactttagtcgtggaagtctgattaatttgttcgggataaaatcatctagtgggtcgagcttccgaattcgtgttcgcgcgagcgatgtattttaaataatcatcggacgcaccgattttcggaacaacgatgttccgaacatcacgaaaatttcggaagagcccg

SEQ ID NO: 391 - DNA, 2611 bp, Zea mays
aggtgttactatacacgtaacaacaagtatggacttaagcaagaaatgctagtgtgagtaaagattttgatattatgtctatctctgattaccgagattattcaagaaatcccatttagcttggaatttaaccatctcacaaaagttcgagtctggtgtcgtattcatctccataatctaaacaattaaaaaggtttcaagaaacttttggattatcgaatcttgtttgctggcgaatttggagatgttcggatcacgcgtgtatgtgaattcgaatatcagaaaacttctgagccccgcgctgtccgaaaagcacaatgtgcttgctcattaattgaattgttactctcagcatgttatccttggcgtcaaatcaaatgatcgatagctggtgagaatcgtaaaaattatacgcaactaaatacagtctaaaatatcgaggtcgatctcgtttggttcggtctgtgtgtttcttgtctcgatctaaatcttcaaatagaaataatgggtacaaattaatcttacttcggagtagtcatcaaatcaaatcgtgtccaaatattgttatcgatctcgttttgttcgaccctttatacatcactaaaaatcctaattcgaaatatctgcaattttctttaataaaggggaaactggaaaaaaatctgaaagaaaaatcttctatcgtcgcccctcatccttctgattttttttcactgccacgcgcagcccacctccctcggccacgccctgcccggcgtttctgtcgccagccaccgtgccatggtccctgctcccaactcggatctcgctcgaccccaagctgaagctcgatccatggcgcatctccctgtgccctccccagtcgcccctgccctcctgctagtgagttttcccagcgtcgtcagctcgtcggtcatttgttcgatggtagagtatgctatggacctggctgtcgcgccttcacgctcactttgtcggccaccccgagctcgcccctatgctcgggccttgctagcagccgagctccctctacgttgtgcccttccggcccggtctcgcagacgccgagttcgatcaggtcgcaagcctatgtgtcctcaccgcttccttgctcggcttctccagcgcgcctgccgccagctcggttcctcgcttccaatatggacctgtttctcctcttgtcacgcctgtcctctgtgtgcacgcgccattgcctcctctagccattatgatcggtcgatgactcgcttcgtgccccttcttcgatgtatgcacaggcctacgacctcccgccttagctgtccttcagccctaccatacgcctcgtgctatcgatggcggtccaggacttcaacatcgacatgaaccttgagtcggtgattgtatgtgtgtgtggtggtttggttaaaatagtgatgtggatggagtaagggtgaagccccagattgacgctggtcggatgctcaacgaaaaacccaaaccatgaattatgggcgttcttgcgaatctcgatccaggttaattgtggatggagctatggttaaagaagaaagtgaagtccaaaagtgacggcgtgcaacacttgtcaggtgttcggtgttgtgtgcggacctgatagcgccgttgatttcgtggtttcaagtcggatttaattttggtaagctattttgttacccctgtcagctaatttgattggtgaattaaatagatggtggtcgatgattcttttgtttgtcgcaagatgtgctgtgatataccccgttccatatagagatgtgattaagttcttgattgtaaagtagttgcgtcgttcagtgaagtttaggtttaaggtgtggttgatgtagtcgatgctatagtaataatgatattctatatttagtgataacaatcactgtaatttgctgattgatatatatatatatatgaatatatcttgaccattatgctgatattaccattggcttatgtctagagtggtagaaatgtttgtcgcagtattagacatttgttaaaatgattcatatatacggtgtgtggtttagttaaaattgcaagtataaatttggtagcggtgagtgtttgtggcgaaggtttgattgttcgttggtgtaggcttctcgaagtggtttgcgggtttagttggaataagctgacgaagaaccaaattagtgtgatatttaacatgtgatcgacgaaaagcccgaattagtatttgttaatcgatgtagtggattcgagatgaagttaatattagcgcgcatttttgttattcctattagccaaaatattagaattaatggtctctatccttagactgagttaggtatccctaaataataagactaaatctggtccgcccttttggtgtgttctctagcttagaaatatacataagacttgtgtttagtttgttatcgcttgctgttcgaattggactcagttaagttaaaatagcgtggacgtggtatttagtaccatctcgacatctagtatttgcttttaagtgctattatgtgcctcgctgctaagtgtttaattcgctatcgtgcagcatcatttaagcttgtgctattcttgcttataactattcatgtgcaccatgcatctc

SEQ ID NO: 392 - DNA, 2609 bp, Zea mays
  misc_feature (129)..(131): n is a, c, g, or t
acaatttgctctttgccaaactgtaaacatcacttgtttgggcatgttatctcataagatatgtggaaaaatttcaaatgtttcatggttatggacattaatgtaagtttgaagcggttcaaagccctnnntgatgtaatgtttagaatggtagtttttacaaaacgacccaacaaggtttctcatcaaagttttcgcaatacactgatttgggagtgaagggtcatgatttcatgcatgttttctcgaaaagattgtgtcatgaaccatgagaaaactttgaagcttttcgaagccctaaattatgtggtagatttatagaatgatccaacatgttgtttcacatgctccaccagcaactaaaattgaacataatcaaaacatgagtatggtacccacataattagatggtcgcatgccgattaaagttcagtgttttaaagaatgaggtaactttaaaagtatttgaattgcaatatgcagatttttcaagataaactattttgcagagttacgacatctattaatggaaaaatagttaatggaagaaaaattatatttccactttcattactcttttccaaatgtcgtactgtaagacatacttctttaggcatgttaccttaaaacatgttccttagttgtgaacacttctatccaagtttatggcagatcaaaacatgagtatgggactaatgggtattaattttgtgcaagtttaatgcatgatatatcgattaataatgtgcgtcaacttcgatgcattttgctgccctaaatattgtattgtttagacagacagtttttacggatggaccctacttgttgtttcgcatgcaccataattaacccatgttcaagacaaccataacatgagtatgcgaccctagattgtcgcatgctagcactagattgggtcatatgaaggatgaggtcactctagaagcgcttgaagcataacatgtagatttttttccgatcatcaatttactatttgcgtgagctatccaacaagttgtttcacatgcttcatcatcaacccaattgcaagacaacctataacatgcgtttggggcccaagatattagatgttcgaatgctggcactagagtttgtagatatgaagaatgatgtaactttggaaatgtttaaagtgcaacatgtatattttttagatcggtaattttccggagttgagagctatatttatgcaatcatgcttttattccggtccatgttttaagatactttgttattattctattagagttatatcaattatatttataacaaaagaattaaatatagaaaaaaattcattccaattttaattacaatttgctttatgcgagactataaacaatactagtttaggcatgctatattaaacaatatgtagtgctattttaaatgattcttggttatggacaacaatgcatgttttgagaccactcaaaaaacaagtatgggactcatgacatttatcacaaaacaatttaagcaaggaaaattacattacaatttgctcattgccaaactataaacatcacttgtttgggcatgttatctcataaaaaatgtggaacgatttcaaatgttttatggttatggacattaatgtaagtttgaagccgttcaaagccctaaatgctgtaatgtttggaacggtagtttttacaaaaatgtcccaacaagatttgtcatcaaagttttcgcaatgcactgatttgggagtaaagggttatgatttcgcgcatgttttcttgaaaagattgtggcatgaaccatacgaaaactttgaagcttttcgaagccctaaattatgtggtagatttacagaatgatccaacatgtttcatacactcctccatcacctaaaattcaacacaatcaataacttgaatatgggacccacataattagatggtcgcatgccgattaaagttaaatgttttaaaaaatgtggtaacttgaaaagtatttgaattgcaatatgcagatttttcaagataaactattttgcagagttacgacctctattaacggaaaaatagttaatggacgaaagattatattttcactttcattactcttttctaaatgtagtactgtaagacatacttgtttagaaatgttaccttaaaacatatatagtgttattgcaatgttgctcagttgtgaacacatcaaaccaagtttaaggccgatcaaaacatgagtataggactaatggttattaatttcatgcaagtttactgcatgatatatcgatttctgatgtgcgtcaacttccttgcattttgatgccctaaatattgtattgtttagatagatagtttttacggatggacccaacttgttgtttcgcatgcaccatccttaacccatgttcaagacaaccataacatgagtatgcgaccctagattgtcgcatgctagcactagatttggtcatatgaatgacgaggggactctagaagcgcttgaagcataacatatagatttttttcagataattaatttactttcacatgcttcatcatcaacccaagtgcaagacaacctataacatgagtttggggcccaagatattagatgttcgaatgcag

SEQ ID NO: 393 - DNA, 2605 bp, Zea mays
taggacagtggcctcatcaagctatagttacctctagtgagtgggttgactttcacagatgtcctctggctcctggtgcccatgccgacacttccacttatcctccacgatgtaaatggtagcaaatgtaacactaacacctaagggaaataaaagataggagagtattctgtggggaacaatgccatttggttctgactaaatcattgcatagaaaagcctagatagaagggaacaatttcaattatagacattaaaacaagtttgttgtaccagtttagaactattaagataaaggttttgtcaagcataaaaggacgttaaaattcaaagaaattatttgttcatattgcccttatattttgtgtagagttccttcaagttcgttttctcataatttaatcctctgtatttagcttcaaatgcttcaatgtcaacctcggtgacctgagaataacgattataattaagtagctttatataaaaaatatactacctctatccccaagataatgtcattttggctataaatctgaataagccatcgagacattctaaagaatactgatgaaattaaaatgaaacatcttgtaaaaagaaatattattggattctaaagaatgctaattcaagagcaaaggacatcaatcaagaagcaaatgtatgcagtgcatgaagctattgagtacaatgcttttatcaagtagaggacataaatcatacttacctcaccaacagcaacattaataatatgcagtgtaaagttagcacccggaaacacaagctaccaattcacgtgcccaacaccaaacatcatattatttgatattatgtacgcctttcattttaattaagcacgggggatacaaagactaccagatgtcagtcgtataatgcatacgacaaccttattcaaataatgcattgatatatagatcgatttagctacacgatagcttctgcaatgatatatagaaagaaatatgcagagagaaatcacataaacacaaggtgaattacaaatatcgcatgcacctcctctcattgaaatgctctccggctgattatttttgtaatgattaatctcatttacagcaccctaggtcttccttctggcacatgacacagacaattattcaaacacaaggggtgcattgcagtttacagctatacggataagagtagtcggaacaaacaacaaagcggcatttccacaagcacttgcgcgcatgtcgcagagcgtatgtacctggatgtcggcaagcgtcatggggcgggcgacaaccccgtcatcgtgttcattttctccatcgactgcagagaggaggtggtaatgaggctcattgcagcacgtgtagttccgtaggtggcgtgcgatgggtggctcgtcttgttgccaccgcgacatggttgaactggaaccctatgagcacctcaatcagcgcgttcttagtatctagtggtcgacgaccatgaccgccagcgccaccggtttgccgcctagatcggatgcacgtgcctacagctctgggtcgctggagcgtgggcgagaacatgaggtgggtgcatggcgtgtcgggtggcctccgagacggccgaccacacagcgtctacgcggagggaaaggcgaggcggggacatgacacgtcgagggacggcctccgagacggcggacaccaccgcggctatgcgtctgcacggaggggaaggcgaggcgatggcatggcgggtataggggtgtttttgagcagcgtggagaaggcggggattgggctggggtgttgggatggcgggggcggaggaatagtggacggggctgcgtacctcccaggcgtgatgcggggatgggcaggcgcgcagagtgatgacgacgtctcggcgggggaggggcgggcttggtggctgagcccaaagtggatggcagcaacgacgtggagactcatggcgagctcgagctcggtgccctcacctcgtcgctcgagcacccaggcggcgcgctcggcgaactaaagcgcgcgcggcggagccaccttcgcccaataccatggcttgaggaggaagggcccccagatccgggttgtcgagtgagtcatcagcgtcggtggggaaggctgcgggagatgacattggtagtgagcgatgcgggagcccagaagatctccttctgaggcggattcctgcaactgctgctgcgcgggccttgcgtcgtgcttcttcctagaggacgccgtgcttcctccactcctccccatctcccacacccaccatgctccctgaccgccatggtgggtccccgacgaggcgaggaaacccgagcgaaccccagatccgaatatgcgaggacgacaggggtgggggaaggggcaccgaggacctgcgcggaggagggcaaggatggcaaggtgtgtgggcgggcgtggggcgaggatggtagaggagcgggggcatggtgttgccttgtggatggtagcggcgacgatggcggagagcaggcggggcgaggatggtgggatctgctggggaggcaatcccaggaaccatgcccttccatcgatggagtgttgggcgagggcgagaatggcagggcggtgacttgaagtcgcgg

SEQ ID NO: 394 - DNA, 2603 bp, Zea mays
acgcctacataaaattacaacaaactaaaactgtaattctaatacgaaatataggtgataacctttgtctaaaagaaaactagtcccttactaataccgaacataaacggttgtgtggtggtgaattgcggaagattttaaagataaagccccccaccccacccacccccccagcgtgctgaaaatacacctactatattccaaaatatgattattagcaagtcatgatattattaaaagttctcattacagggaaccgcacgcagctcagtttttcatgctccgctccctgcctccccgtgccttcacggcttcacatacggctgccatgcgttctactccctgcgacctcaaaagctctcgtggcacaaatcatggctagtctgaacgggtcgaccattagcatgctttgtcaaaaaaaagaacgaacaaaacaaattaaaaccggatagacaaattagccttcatatgtatcagtacacttatgacaacccattaccacaaaaaatagtgatttcgttaaaactatcattaaggaagtgccataatcattcatggacatagaaaaatacacatatcaagtatcattcaaagcataaggtaaactgatcatattttcaagcatccagtactccacgaagaaagccatccacgtagaaggaacaatacttggcaaaacaaccataaagagggggaataggtgaatatgcataccttcgacaacctagacagcccatacttaaccttcgcaatgattataatatgtgtaggagcttgtggtgatatgtctctacatgcaagaacctgcagttatagacatacaaatgtgacatcacaacaatttaactgtaatcacatactacactaatatttcaatccgattctcgatatccatgaagatacgtttcagaaggtgtttggcttgccaaggaaatcaaggtgttatttcaggagcacaatttttttatgatagaccaattaatatccttcttaagcattaaagatttgaatgtgagatcctctgctgacatggcagcaagggtgatagagacaacttacaaagattttggagcccagaatttcaaggaggaatatgcagggataactggttcttgagttttaccaatggcatatcaaggaggaacatcaacatagcaccaaggtgacaaaggcattgaggcaacattaattttaaagtgtaacatactaacattcatagcattataaacaataggaactctaccctgatggcatagataatactaaccttctcatcctcataaaccacctcagatgggatctccttccgaataattttgtcaaaactacataaggcagagaagtaatcatgtgaatagaggcgtttgcgagctgtatgtgtgaagaggataaattgtaaccatatacaaaaattatcagaacagccaacaccaaagcttttcaagtaaaaaagaatggagctcgaatttagcacaggttagctagtatttcacatatataagtaacaataatgatgcccaagcttgattaactaacagaaactgctatgcagagaagttatctgaagatttctgcaagtttccctagccataggttgggtgcatcgtgacggataaacaaatgctgccaagccaatgatatattttcaggagctcgataaccaattccatcagatgccataacgtgtgggattgttaagccagatgatgtgagctaaccaaaaactgctccactattgagcttgtcttatgacaaatgagctcctgttgaggagaggagattgtgctcctgctcctgcatgtggtgaaccgggggtttcaattgcatacctcaaacttaaaacaagcaaggcccttaggtaatgttgccatctgaatgaccactatggacatactgcgttgagattatcttgattcgcccaatcgagtgacaatcgaagcacataggcgtctcctataaaacctaccaaactcaacagaataggaccctgactacatgaaccgtctctcacagtgggaatgtgggattcagtactgaagtccaaccaacacctaggactaggatacaaaatccagggtactctctgcttttgcttatttcactagaacgaattactcgccaaaatagatatacgctcactacggcagcttccctaccgaatcgaaacgacggtgcaggatttggagagaactgatagaggctgacatggtgggggtgctgttgaggtcggtggcgagggcggcttccttctccccggatatggctgccggactgccgagcggagggagggataagtgggaagcgatgaccgcgaggcggttgccgctcgccgtcggcgggctattgcgcctcatccccactgatttccgtcgcaccttcgctgctcgcctgcccgtcttccgaaggtgaagaagacgtgaagttgtagagcagttgaccagttgatccccgcctgcccacgcagcgcggtgagttaattgactttataacagtctcgtcccggcttcgtctgtatactactccgcagctccgctttaccagattggtattatggaatacacacgctaaattggtaaggttaatctcgagaaaattggatttat

SEQ ID NO: 395 - DNA, 2602 bp, Zea mays
gagatgcatggtgcacatgaatagatataagcaagaatagcacaagcctaaatgatgttgcacgatagcgaattaaacatttagcggcaaggcacataatagcacataaaagcaaatactagatgtcgagatggtactaaataccacgtccacgctattttaacttaactgagtccaattcgaacaacaagcgataataaactaaacacaagtcttatgtatatttctaagctagagaacacaccaaaagggcggaccagacttagtcttattatttagggatacctaactcagtctaaggatagagaccattaattctaatatttcggctaatagcaataacaaaaatgtgcgctaatattaacttcagctcgaatccactacattagttaacaaagactaatttgggcttttcgtcgatcacatgttaaatatcgcactaatttggttcttcgtcagcttattccaactaaacctgcaaaccacttcgagaagcctacaccaacgaacaatcaaaccgtcgccacaaacactcaccactaacaaatttatacttgcatatttaactaaaccacacaccgtatatatgaagcattttaacaaatgtctaatactgccacaaacatttctaccactctagacataagccaatggtaatatcagcataatgatcaagatatattcatatatatatatcaatcagcaaattatagcgattgttatcactaaatatagaatatcactattactctagcatcgactacatcaaacacaccttaaacctaaacttcactgaacgacacaactactttacaatcaagaacgtaatcacatctctatatggaatggggtatatcacagcacatcttgcgacaaataaaagaatcatcgaccaccatctatttaattcaccaatcaaattagctgataggggtaacaaaatagcttaccaaaattaaatccgacttgaaaccacgaaatcgacggcgctatccggtccgcgcacaacaccgaacacctgacaagtgttgcacgccgtcgcttttggacttcactttcttctttaaccatagctccatccacaattaacctggattgagattcgcaagaccgcccataattcttggtttgggttttttgtcgagcatccgaccagtgtcaatctggggcttcgcccttactccatccacaacactattttcaccaaaccaccacacacacatacaatcactgactcaaggttcaggtcgatgttgaagtcctggaccgccatcgatagcacgaggcgtacggtagggctgaaggacagctaaggtgggacgtcgcaggcctgtgcatacatcgaagcaggggcacaaagcgagtcatcggccgatcataatggctagatgaggcgatggcgcgtgcgcacagaggacaggcgtgacaagaggagaaccaggtccgtagtgtaagcgaggaactgagctggcggaaggcgcgctagagaagccgagtaaggacgcggcgaggacacataggcttgcgacctgagcgaactcggcgtctgcgagaccgggccggaagggcacgacgtagagggagctcggcagctagcaaggcctgagcataggggcgagcttgaggtggctgataaagtgagcgcgaaggcacgacagccagggccatagcgtactctaccatcaaacagatgaccgacaagctgacgacgctggggaaaactcaccagcaggagggcaggggcgagccacgattggggagggcccaaggagatgcgccatggatcgagctttagcttggggtcgagcaagatccgagctgggagcagggaccatggcacggtggctggcgccagaaacgccgggcagggcgtggccctgggaggtgggctgcgcgcggcagtgaaaaaaagatcagaaggatgaggggcagtgacagaagatttttctttcagattttttccaatttcccctttattaaagaaaattgcagatatttcgaattaggatttttagcgatgtataaagggtcgaacaaaacgagatcgataacaatatttggacaagatctgatttgatggctactccgaagtaagattaattcgtacccattatttctatttgaagatttagattgagacaagaaacacatagaccgaaccaaacgagatcgactttgatattttagactatatttaatcgcgtctaatttttacgattctcaccagctatcgatcatttgatttgacaccaaggataacatgctgagagtaacaattcaattactgaacaagcgcattgtgcttttcggacaacacggggctcagaagttttctgattttagaattcacttacacacgtgattcgaacatctccaaattcaccagcaaacaagatttgataatccaaaagtgtcttgaaacctttttaattgtttagattatggagatgaatacgacaccaaactcgaacttttgtgagatggttaaattccaagctaaatgggatttctcgaataatctcggtaatcggagatagacataatattgaaatagttactcacactagcatttctcgcttaagtccatacttgcagttacgtg

SEQ ID NO: 396 - DNA, 2595 bp, Zea mays
ccaaacaagtgatgtttacagtttggcaatgagcaaattgtaatgtaattttccttggttaaattgttttatgataaatatcatgagtcccatacttgctttttgagtggcctcaaaacatgcaatattgtccataaccaagaaccatttaaaatagcactacatatggtttaacataacatgcctaaactagttttgtttataatctggcatagagaaaattgtacttaaaattggaatgaaattttttgtatatctaattcttttgttacaaatatcattggtataactgtaatagaataataacaaagtatcttaaaacatggatcaaaataaaagcacaattgcataaatatagctctcaactccggaaaattacagatctaaaaaatatacatgttgcactttaaacatttataaagttaccttattctgaatatctacaaactatagtgtctgcattcgaacatctaatatcttgggccccaaactcatgttataggttgtcttgcacttgggttgatgatgaagcatgtgaaagtaaattaattatctgaaaaaaatctatatgttatgcttcaagcgcttctagagtcccctcgtcattcatatgaccaaatctagtgctagcatgcgacaatctagggtcgcatactcatgttatggttgtcttgaacatgggttaaggatggtgcatgcgaaacaacaagttgggtccatccgtaaaaactatctatctaaacaatacaatatttagggcatcaaaatgcaaggaagttgacgcacatcagaaatcgatatatcatgcagtaaacttgcatgaaattaataaccattagtcctatactcatgttttgatcggccttaaacttggtttgatgtgttcacaactgagcaacattgcaataacactatatatgttttaaggtaacatttctaaacaagtatgtcttacagtactacatttagaaaagagtaatgaaagtgaaaatataatctttcgtccattaactatttttccgttaatagaggtcgtaactctgcaaaatagtttatcttgaaaaatctgcatattgcaattcaaatacttttcaagttaccacattttttaaaacatttaactttaatcggcatgcgaccatctaattatgtgggtcccatattcaagttattgattgtgttgaattttaggtgatggaggagtgtatgaaacatgttggatcattctgtaaatctaccacataatttagggcttcgaaaagcttcaaagttttcgtatggttcatgccacaatcttttcaagaaaacatgcgcgaaatcataaccctttactcccaaatcagtgcattgcgaaaactttgatgacaaatcttgttgggacatttttgtaaaaactaccgttccaaacattacagcatttagggctttgaacggcttcaaacttacattaatgtccataaccataaaacatttgaaatcgttccacattttttatgagataacatgcccaaacaagtgatgtttatagtttggcaatgagcaaattgtaatgtaattttccttgcttaaattgttttgtgataaatgtcatgagtcccatacttgttttttgagtggtctcaaaacatgcattgttgtccataaccaagaatcatttaaaatagcactacatattgtttaatatagcatgcctaaactagtattgtttatagtctcgcataaagcaaattgtaattaaaattggaatgaatttttttctatatttaattcttttgttataaatataattgatataactctaatagaataataacaaagtatcttaaaacatggaccggaataaaagcatgattgcataaatatagctctcaactccggaaaattaccgatctaaaaaatatacatgttgcactttaaacatttccaaagttacatcattcttcatatctacaaactctagtgccagcattcgaacatctaatatcttgggccccaaacgcatgttataggttgtcttgcaattgggttgatgatgaagcatgtgaaacaacttgttggatagctcacgcaaatagtaaattgatgatcggaaaaaaatctacatgttatgcttcaagcgcttctagagtgacctcatccttcatatgacccaatctagtgctagcatgcgacaatctagggtcgcatactcatgttatggttgtcttgaacatgggttaattatggtgcatgcgaaacaacaagtagggtccatccgtaaaaactgtctgtctaaacaatacaatatttagggcagcaaaatgcatcgaagttgacgcacattattaatcgatatatcatgcattaaacttgcacaaaattaatacccattagtcccatactcatgttttgatctgccataaacttggatagaagtgttcacaactaaggaacatgttttaaggtaacatgcctaaagaagtatgtcttacagtacgacatttggaaaagagtaatgaaagtggaaatataatttttcttccattaactatttttccattaatagatgtcgtaactctgcaaaatagtttatcttgaaaaatctgcatattgcaa

SEQ ID NO: 397 - DNA, 2594 bp, Zea mays
agctcttctcagtccacagcttcccgctgagtcaatatcacgcagaattttaacactgcttgtcacagtggaaccgagtgacaggacgtccagggggagtgtgtctcatcacaattcgacgggttttttttgcataggttccttctcaggattctgatcatcattgtcattgaactagtgaaaacagaatgaaaggtatctctagtgaggtgggggcacagacaagaattgcttacagtatcagcaactgtatctccagtgataccggcatcatgctgaacattttgatcaccttgcatctgaaaaatataaaacagaaggcagaagaataaagactagcataaaaatgacagagacatagtaaagcagaatgactgacaggttgttctgatgaatcgcccctgccacgagcggcgttagcatcacgatccggcgactgtgctggaggagatgaatcttgcctctgaaaaattatatatcaaaaggcagaacaacaataactgacagcacaccagagtattaagtggctgtgacataacaaagtagattgaatggctgacagtttctatatcacgcacaacatgagctgtgtcagaatcacggcccggtgaccgagcaggagaaggtgaaggtgtatggcgggtatcctccacttgagcagtatctcgcccttcagcaataatcacctttttgcgctttctgttgttttcatgcagcctagaggcagttatctggtgcaacaatgacaaaggcattaataaataaataaatgacaacaaaattaagggaatgaatgaggccagcaaactcacagaagaacaccgttttgcatgttcttcgcatggagaggatgcaggaggttgtgtctcatcattaaatttcataattgcattcacctcatccaacattttcttctgcgccttttgcaaatccagctgccctctctggatttgtctctttgcattctcaatagcgcgctcagcatcagcaaacctacgctgaccctctgaaatctcgcaagacgctctttccacgctgcaatcatattctctcagtgcatccttcacagcatccttctgggtactatcaacaacataagaagcaatagactgcgccaacaacggctccaactgaacgaggccaaattgaatactttcagatccagcactttttgacctggcccgtacaacatcagaaggagcgggctgctgcacattttgtcctctagtctgtggctcgtcgtcagcccgtatgttggaataaacagtacgatccctgctcaacaactaaaacatggaaacaatttagtgaccaagataaaaaaaaaccaaaaaatcgatctcatcatgccaaaagagacacaatgactgaatggacactgcactacatttaaccacttgcatatagctcgtgttaacgcggggagaagagggggagggatcggtggcggctgcgcgagcaagggggagggatgatccaaataagggaatgacagtgggcatggtatataataactgagtgaacaaacatactaactaagggacagaataaccgagtgaacaaacgtaataacttagcaacaaaacagactataaaaacagaataaccacagaagaaagaaatttattacttacattcaactttccataggacacactgccatctctcgacgtcaatcggtcagcatccattatttttccaatacgatcattagagtactgtgaccatcgaggtgtaacagtataatgttcaacgcctgggcaatccaagttgtcaagatagtagagctgaaaacagcataataatatatgtgaaaatcaaaatatatattgacaaaacaattaagaaaatataaaaaagaagtgaacagtaaataaaattcatttcttaccatcaagagagcagtgcagccttggatgactggggtcttgttctttctatgattcttcctccatatggcagacttgtcctttatgtcattaaccacagcttgacaccaatcaaattcacttaaagcgttcaagtccttgcaaatgaggtaatctgaaccaagaggatagtagctgctggttggaaaaagaaagctgctacaaacgatgatgaagaaacactggacagcccaatcatcaaattcttcagcactagtggaagcaaaattctcaagaatccacctaggaacaacgtatgtctgtaaacggtcgtaattatccatcctagccatctcatacatacgtcgcattcccttgtcgtcgcatttgtttttaaggtcgcttcttgcttttatcttttcgtcctcaccaaactttgggattggctttccaccaatcggaaggccaaagatcaggtgcactacttgtggagtgacaggtaaaaacttttcagaaaattcgatccggagtgggtcacccttaacattcttcatcaaaaacatccctaaagatctgtctaacagcctgctaataccaaaccgcaaaaaatcaccaaatcccaaccttctcaacctctgcttgtaatgctcagacatagggttgattaaatcatacacaaccttgggagagcacctcatgattgagaagtgtcttttgttcttctac

SEQ ID NO: 398 - DNA, 2594 bp, Zea mays
gtaacactccatgtgtttatcttcggtttgatcacaagtatggatttaagcaaaaattatctgtgagagtaacagtctctatatcctaatcatattcgcctatcagtattctgatagcaccttcatctatatctatgtggactatccaaaatatttcacgaaagtttaggcttctagtgctgttcagattggtcaagcacgcgaatgcgaatatggaaattaactcagctttgtaattttgccataaataaatttatttagaatttgacgaataaagttttcgggtcaaaataatcttgaccccgtgtgttaactgagaaatcatgttcaaagatttataattgtgttttgttttccagcaatttatcaatggcagagaaatcaaatgggttcagataacagataactttttatcgaggtttaactaaattaatagcgtcttaagtatcatatcccgatagtgttttgatctggtccgtttatatctcacacaaactctaatcctagaaccaggatatttccgtattctttgagaaagaaagaagaaaagtaaaaatatctcagaaaaatctccttctcactgtcgtactccctcagcctcatctgattcccaggccctcgaccttatccaccgtcgttgattttttttctacgcgcaacaccgcctgggcgttttgctctcagcgctcaatctccttctgccattctcctcctgttcgccatggagctcaccatgagtgctgaccgccggccatctcctgctcaccccatggccgcacctcccctccacggcttcttccagctggagctcgctgccgtcctctggtgaacgccgtgctccctcccatggcgccctagccccaacgccgatcgcccctgctcctcccctggtcgacgtctccgagcccgaccccgccatggagctcacgagcgcctcctgctgctcagccttggacgccgaatcccgcgcgctcctgcgccatggcgccgtccccatgcttcctccgcgccagcgcgacaccggccctgctcaggctcctccctcgccgtagcacaggtcgtcacccgatggctgctcctcgcctccacacgcatcagagtctgccgtcgaccccgtcgttctcttccacctccggaacaagcgcctggacctcgccccagtcaagcttcatcgacgctgcacctaggtccgattgcgcgacgcgctcctcctccagctcgctccggccgtggacaccgtcgagctcgtccagcccgtcaacccccctgctcaaccgcgccctcctccactccttggaatcggcaccgcgtgccccttctttgtcaccctgcacgcgctgtcgtagagccaccgtctctgtcgccctgctcaagctgtgccctgttggcattgatgcgctcgcgcccaagcccgtgtggttcactggttcctgcgttcgtctggtgtgtggaattagagctgtgggtattggggaagaaattctgaaaatttagtgggaagtgatggtgatgtttgtgcgatgctcgacgaaaagcccgaaccaggagtggctgctccatcttcgtcgaatggaaatcgtcgtgctgacacgtcgatgtcgtcgatcgccatcatcgtctacgccaagtccgtgtagctcgttgccacaccctatagccgctttcacgacgttgctgtggggacttctttgcgtcacgagtgcttccgcttgtcgcgttaaaccaatctgcttccattgtgtcgatagcaagccgtgaagacactcttgtgctggccacgcaccaccagctcgacaaaatgaatcccatgagtatctggtcaagaatcgagattgtgtgtatcgctcgccaggtgtgtgtggtcaaagacatcaactgaaaaccatcgtcattcttccgactatcgcatcggattggtcatggtaagccaatttgttattcgtgttagttggattgatgaatggtctaactaggtatattaattgtgataattctgtggtgagtcgaattgctatttctgttattggttcgatgatgggatttgttagatatactaattatatcggtcctcttgccttaagcatatgtgtgtcgtggttgtaggtataatatttattagaatgcccgagtcgtttacggtgatttggtcgatgtcgtgtggcgaatcgccagtttgagatataggttttgagaagagtgcttggggtatatttgtcgaggatgtttaaactggttgttagtttgcagcatgtggtatatcagtggtgcgcaagataagtttggtatttgaagcaattatcgataagtctgttgatgttaattgttttcatggtgtgcgtatgatggagtctatgccctaagctaatagttagtataatctatgtttgtgaccggtaacgttggagtcagattaaatagattaatagctatgaataaatattcatagttatcttgtgtttggttgtccaaattaatttgaggcgaacaacatcattggtccgcttcagttgaaatctaaaaaactactcattggataaggttctttagtattttaaatctttaggatttaagtgtgtcggtaccctgaaactagg

SEQ ID NO: 399 - DNA, 2592 bp, Zea mays
  misc_feature (721)..(729): n is a, c, g, or t
ccgagcctgcctagctttttaacggtggtaatagtgatcccactgtagaccccctcgctgctcgctgcccgctgctgctacgtactacacgtatagtacctgctctgcagtgcttcttagccttgtggctgagctgaatgattccccaaccaccgagcgtcactggcacaaatgggcagggttatccggatggtgttgccatgtatagcaaagcaagcgccttcttcaccggtcaccactcattcactcactcactcagccctcttctctccctccttctcagtctcccactgcggagacgatcagacgggacgacgctggttggctgataaatggatggtccttcctggccgctgcccgccggccgggtaaacactaacgcagtgccagtgctgctgttcctgctgccgctgcgtcctagtcctagcctagctaccgctggctggatggtgggtgttacactgttactacccaggaggggggagagttaccaggtgcatgcacccacggtaaaaaaataaaacgaaaggccgccgcgctctcaatactgttgccgcctcccaacagtagagatccctgctcgaccgcctgcagcgtgcgtgcttgctgctaccgtccaagcccgggccttgatggtgtgccactgttcatccattcaggccacagttaggtcgtcgacgtggccgcttgcctgtgcctgccgctgcggtgctgcctgccnnnnnnnnnctcctctctctctctcttcgagtgaccaacccagcgatcgagccggcgctcattgccactctcgcaccagcccaccacccgtccgttccttgcctgtttatttgtttttaccgcggggttaaaataatccggcctgcggtgcttcctgaccgttgtgccctcgaggcgacgcctggattttccccggggacaggggcgtttcggtcgctgcggccacagtgcacggaggcgccctcttggtctcccgcggaaaggatggcgacgagccgccggtcaaagcgtcgcaattattaccggtgactagcctagcgggctcgtcagacgcccaggcctgtttcccgccccccaccccccacttcccttcccgctggaattattaccgcgcacgcaccgcgttgctcacgttataagttgcgcagcgcacagcacagcacgttcacatgcacgcaggaagaacgggtaaattcgatttacccatcattttacgcagcgtatatgtactgtgacgggctgtaccgtagtatttattgtataacgatgttactaatgatcgtagtgttgtctgtgtgtgactgtgtgctcgacttgttgggccaggtgcggaggtacgtgtacaatgacgtggtgcgccttgacgacctcgagaggctcatcgactgctccttcgtccaggtgatgcgcggaccgtcacgtaccagctactgtttctgctgccggcggcggctagctaaagggggatagtagcatgcagcggtggtgaccggacggacggacggcgccgcggcgtgctccgaatcgttttgaattattaaaaatcctgacccatcgtcgttctcatgcacgcatgcagccctacacgatcaacagtgccaaggtgatcttcctcaagccgcggccgcagtccaggcccttcaagggctctggcaacgtctgcttggcctgtgacaggatcctccaggagcccttccacttctgctgcctctcctgcaaggtacacagtgctattctgctgctgctactactactgtataccaccaccaccacccatacaagactacacgcgtgccaccaaaaatcttctacatatgcacatgcacgcgacagctgctaagctagcagcgtgatcggttgacggattattcaagcgtgcgtgcgtgcgtgccataatcagtcgcctggcacgtacgttagtaagttattaatcagccgtacgtcgcttcactcgcagtagtacgtttgcatgcacacgcacgcccatgcacgcttagattagatacggccccgtttccgtggttactgtacgctaaacccagctgtgggctgcacgcacgcacgcatgcaggtggaccatgtgatgatgcagggcggggacctgtccaacatcctcctgtacgtgccgggcgggccgccggacctgggctgcggcttcccgcgcttcgagaacctccgcttcgacgacgaccccgggcagtacgggcaggccacgcccagctccatcctcgaagaccccgtcgagcacgggggcagcgccagcgccagcggaggatccagcaacggcggctcggccaggaaccacgcgcggcgcgacgtcgacgtcccgacgaggaagaagaagagcggcgggggcggaggagggttcttccctcagatcgtcctctcgctcggcaacaggcggaagggcgcgccccatagggcgccgctcgcgtaacggacctgcatgcacagatgtcggacggactccaccgccgtcacgtcgccttgccgctatatatatatatatgtgtgtgtgtcctgcctgttaattatgtcgtttattactaccacccttagttagcagtgttgttagcaacattgcttaagtgt

SEQ ID NO: 400 - DNA, 2592 bp, Zea mays
tagcgaaaactttgaagcttttcgaagccctaaattatgtggtagatttacagaacgatccaacatgttgtttcacacgctccaccatcagctaaaattcaacaaaatgaataacttgagtatcggaccaacataattcgatggtcgcaagccgattaaagttcagtgttttaaagagtgagataactttagaagtatttgaattgctatatgcagatttttcaagataaactattttgcagagttacgacctcttttaatggaaaaatagttaatggaagaaaaattatatttccactttcattactcttttctaaatgtcgtactacaagacatacttgtttaggcatgttaccttaaaacatatataatgatatttgcaatgttcctcagttgtgaacacatcaacccaagtttaagaccaatcaaaacatgagtatgggactaatgagtattaatttcatataagtttactgcatgatatatcgatttctagtgtgcgtcaacttcgatgcattttgaagccctaaatgttgtattgtttagacatacagtatttacggatagacccaacttattgtttcgcacgcaccatcattaactaatgttcaagacaaccataacatgagtatgagaccctaaattgcagcatgcttgcactagatttggttatatgaaggatgaggtgactctagaagcgcttaaagcataacatgtagatttttttcagatcatcactttactatagacgtgagctatccaacatgttgtttcacatacttcatcatcaacccaagttcaagacaacctatagcatgagtttgggcccaagaaataagatgttcgaatgctggcactagagtttatagatatgaataatgagttaactttagaaatgtttaaagtgcattatgtatattttttagatcgataattttccagagttgagagctatatttttgcatttctgcctttattttgatccatgttttaagatactttgttattattctattatagttatacaatgatatttataacaaaagaattaaatatagaaaaaatttcattccaattttaattacaatttgctctatgcgagactataaacaatactagtttaggcatgctatcttaaacaatatgtagtgctattttatatatttcttggttatggacaacagtgcatgttttgaggccactcaaaaaataagtatgtgactcatgatatttattacaaaacaatttaaccaaggaaaattatattacaatttgctctttgccaaactgtgaacatcacttgtttgggcatgttatctcataagatatgtggaaagatttcaaatgtttcatggttatggacattaatgtaagtttgaagcggttcaaagccctaaatgatgtaatgtttagaatggtagtttttacaaaacgacccaacaaggtttctcatcaaagttttcgcaatacactgatttgggagtgaagggtcattatttcgtgcatattttctcgaaaagattgtgtcatgaaccatgtgaaaactttgaaactttttgaagccctaaattatgtggtagatttatagaatgatccaacatgttctttcacatgctccaccagcaactaaaattcaacacactcaaaacatgagtatgggacccacataattagatggtcgcatgccgattaaagtttagtgttttaaagaatgaggtaactttagaagtatttgaattgcaatatgcagatttttcatgataaactattttggagagtacgacctctattaatggaaaaatagttaatggaagaaaatttatatttccactttcattactcttttctaaatgtcgtactataagacatacttgtttaggcatgttaccttaaaaatatatatagtgctatttgcactgttcctcagttgtgaacacatcaacccatgtgtatgggactaatgggtattatatttgtacaagtttgcagcatgatatatcgatttctgatgtgcgtcaacttcgaagcattttgaagccctaaatattgtattgtttagacagacagtttttatagatggacctaacgtgttgtttcgcattcaccatcattacccatgttcaagacaaccataacatgagtatgcgaccctagattgtcgcatgctagcagtagatttggtcatataaaggatgaggtgaatctaaaagcgcttgaagcacaacatgtagatttttttcatatcatcaatttactataggggtgagctatgcaacatgttgtttcacatgcttcatcatcaacctaagtgcaagacaacctatagcatgagtttggggcccaagatattggatgttcgaatgatgccactatagtttgtagatatgaagaatgaggtaactttagaaatgtttaaagtgcaacatgtatattttttagatcggtaattttccggagttgagagctatatttatgcaattatgcttttatttcgatcgtggacaagttgtcgcggccgcttctatagtgtcacctaaatactagtgactccagcgtaactggactggccacagttaggccgcaaatgtaatc

SEQ ID NO: 401 - DNA, 2591 bp, Zea mays
gatataagcaagaatagcacaagcttaaatgatgctgcacgatagcgaattaaacacttagcggtgaggcacataatagcacttaaaagcaaatactagatgtcgagatggtactaaataccacgcccacgctattttaacttaactgagtccaattcgaacagcaagcgataataaactaaacacaagtcttacgtatatttctaagctagagaacacaccaaaagggcggaccagacttagtcttattatttagggatacctaacacagtctaaggatagagaccattaattctaatatttcggctaataggaataacaaaaatgcgcgctaatattaacttcagctcgaatccactacatcggttaacaaatactaattcgggcttttcgtcgatcacatgttaaatatcgcactaatttggttcttcatcagcttattccaactaaacccgcaaatcacttcgagaagcctacaccaacgaacaatcaaattgttgccacaaacactcaccactaccaaatttatacttgcaattttaactaaaccacacaccgtatatatgaagcattttaacaaatgtctaatactgccaaaaatatttctaccactctagacataagccaatcgtaataacaacataatgatcaagatatattcatatatatatatcaatcagcaaattacagcgattgttatccctaaacatagaatatcattattactatagcatcgactacatcaaacacaccttaaacctaaacttcactgtacgacaaaactactttacaatcaagaacgtaatcacatctctatatggaatggggtatgtcacaacacatcttgcgacaaacaaaagaatcatcgaccaccatctattagctgactagggtaacaaaatagcttaccaaaattaaatccgacttgaaaccacgaaatcgacggcgctatccggtccgcgcacaacaccgaacaccagacaagtgttgcacgccgtcgcttttggacttcactttcttctttaaccatagctctatccacaattaacctggatcgagattcgcaagaacacccataattcttggtttgggtttttcgtcgagcatccgaccagtgtcaatctggggcttcgcccttactccatccacaacactatcttcaccaaaccaccacacacacatacaatcaccgactcaaggttcatgttgatgttgaagtcctggatcaccatcgacagcacgaggcgtacggtagggctgaaggatagctaaggcgggacgtcgcaggcatgtgcatacatcgaagcaggggcacgaagcgagtcgttggccgatcataatggctagaggaggcgatggcgcgtgcgcatagaggacaggcatgacaagaggagcatcaggtccatagtggaagcgaggaaccgagctggcggcaggcgcgctggagaagccgagcaaggacgcggcgaggacacataggcttgcgacctgggcgaattcggcgtctgcgagaccgggcaggaagggcgcgacgtagagggagctcggctgctagcaaggcctgagcacagggacgagctcggggtggccgacaaagtgagcgtgaaggcgcgatagccagagccatagcatgctcaaccatcgaacaaatgaccaacaagctgacgacgctggggaacactcaccagtaggagggcaggggcgagcccacgactagggagggcgcagggagaggcagccatggatcgagcttcagcttggggtcgagcgagatctgagctgggagcagggaccatggcgcggcggctggcgccagaaacgccgggcagggcacggccctgggaggtgggctgcgcgcggcagtgaaaaaagatcagaaggatgatgggcggcggcagaagatttttctttcagattttttccaatttcccctattattaaagaaaattgcagatatttcaaattaggatttttagtgatgtataaagggtcgaacaaaacgagatcgataataatatttggacacgatttgatttgatgactactccgaagtcagattaattcgtacccattatttctatttgaagatttagatcgagacaagaaacacacagatcgaaccaaacgagatcgactttgatattttagactgtatttagtcccgtctaatttttacaattctcaccagctatcgatcatttgatttgacgccaaggataacatggtgagaggaacaattcaattaatgaacaagcgcagtttgcttttcggacagagaggggctcagaagttttctgattttcgtattcatttacacgcgtgatccgaacatctccaaattcgccagcaaacaagattcgataatccaaaagtttcttgaaacctttttaattgtttagattatggagatgaatacgacaccaaactcgaacttttgtgagatggttaaattccaagctaaatgggatttcttgaataatctcggtaatcagagatagacataatatcaaaatctttactcacactagcatttcttgcttaagtccatacttgttgttacgtgtatagtaacacctgaggtgttacagtag

SEQ ID NO: 402 - DNA, 2590 bp, Zea mays
catcactggtatttctaacttaaacttcatacgcaaactaagcgtcttattttacgatcataaaaccaatagtaaaaatagcgaatcggctcaccacatctcaattcgatttggtagttacctgaacgacgacggccttcagttgaagtcctcgatcgaatatctggtgagcgtgaccgacgagctaaggctgatagcgaatgcaggagtaggggtaggtccggcgtttgttgggaaaggagctcgacactcgatcccgtgacgagctgctgggtgaaagacgacaacacgacgatggcttgacacgaaagtggccaatgacgacaccaagattagaggcgaggcgagcgtgagggtttcacagcgaggatgagcgacatcgtggaatcttggtccgacattcaatcgaacaccacggaagcgggcacagcaggaatggcaggattaaccacgagcatgataaggggcgcgaagacgaacgatgacaacctacgatggcaggaacaggaagacttggccgaggtggggtccgagcgtccagagtttttgccgaggccgaacagagaggatgcataaatcctgggcgcgacggtggccatagccaagccaaagggcgcggcaaagggcggggcccgaaggctggatcttccgacggagcatctgcgcacgcggagggactcgacggcggacggcggcacgcgcgcagagaaggatctaggggacacaaggggaacagggagcaggagagcgcgacgactggagctccagtgagcagggcgcggctgcaagcagggggaagccaccatggacacaaggagagcgcgcgacgctaggcgaggacgcacggtccgagctggggacagggagagactcagttggcgctccagtgctccacacgacggctggagatggcgtcttgggaagaggctggacaggagaagctgcgcgtagggaggcttgataccgagcaacctgggacctgggggcgccatccgagccagaggcgagcagagggggcgcgatgcaagcttgccgagcgacccgcaaaccatgtcagtagagacctaggcggggatgctcctccgatccagaaactgtgattcagcctaccagggagagggcgcgctgggagatggagcttggctgcctgcaggggaggacacagcggccatggatgcgaggaagagcgctggcgagcagggagcttgggcgttggcagagaggagcgccatgggaaggacctccactgtctggacgagctggaggagcagaggagatgggtgcttgtccatgggaacgagcagaggactccggcttggaggagcgcacagccacaggggagcttcgcgccggcgagctggaacaaggtccagggcgcggcgaggaaactccaagcagggaaaaaaaagtctgcgcgcgtggaagggggaaggagcgccggcgatggaggctgggcgcagcgctgggagcagggaggcgggcgcgcgcaggagctagagcagggcgcggcggggaaacgaagctccacggcgagcagttgcaaggcgcggctgggcgcaatgcagagagaagcgcagggagaagctcggctggagaggagagcgctgggagagagagagaaaagaagggggctccgagcagggcgagctggagcaggcgacccggggcgcggcgagcttgcggcgccagaaacgacgggcagggaggactggagcaccacgacggggagaacggagaagataagcgcggccaggaaatatccaaagtgagagagaacggcggtggaaaaatcaggaacgcgcgcgcggtgtctaaaaagatcagggctgagggcggcgtgaggatattttttttaatttcttttaccaaaaatcacagatattttagaatcaagatttttagcgatataaaattggtcgaatcaaacgagatccataacagtatttggacacgatttgatttggcgaattctctgaactcgaatgaattcgtactgttaattcacttttgaaaatttatatcgaggcgagaagcaacggaccgaattaaacgggtttcagcttcggtatttcaatttacgactgatttcgttgaagtcaaaccgattagcaattatttgaatcggctctaattatctttatctgttttgaacgatttactactaaatactcatgattatcaacctcgcgcaagatttctctcaaataacgtgcgatcctaattattttgcaccgatcaatttagtcgtcgagttctacttaaatgtgtttggggataaaatcgtccgagtgggtcaggcttccgaatacgtattcgtgcgagcgatgaattttaaataatcatcgtacgcaccgattttcggaacaacaatgttccgaacatcacgaaaatttaggaagagcccggataaatgaaaacgatgtcgaactcgcgacagacgaaacaaatgtgatattgaaatcgcaatagatgaaaataattagaccttaatgtccgtcttattcactgatatcacgtgcttaaatccgtactcatcgtcgcacctgaaataaacacctggggtgttacaaagactaccttacccgaaagg

SEQ ID NO: 403 - DNA, 2586 bp, Zea mays
catgatttactgatttatctaaattgatcatcacaatatacgcatgctaaattaataacatttattgtgaccaacaattctatttaatctatttatagacctagttgactggaatacgaaacaacttacccttatgacatccgacttgaaaccacgaaattgacgacacctttcagctcagcatttcaccgaaaatagggtaagtgctgcgtcgaatcgcgcttcttctttgtccacatcgagaattctccggccgcgtactgatttatttccttcagcgcctaatcttcttggatcttggcgtagacgaggatgacaatcgacgacttgttcgagcttttgtcgagcacttggtgaatatcacccggctagcttcgtcttcacctgattcttgggattccttgggatgcacgaacgacgatgagatcgagtttggagcgagctggcgaggtgggggtcgagcagaggatgatgggttcgacgactcgacggtaaacgcgagcacgccaaaacctgatggatgaggagcgagcgcacatggggcaagcagcacggaattgaaacgtggagaaattgcccactgcgaaacaaactgagcaaggagcgctcgtgaactttatagcggaatcggcggcagccgatgccagagcgcacggcgaggaagcttcacagtttgacgagaccgtggccgagcgaactctatggcgcggactgcctcacggccacgacagctgtcgcgacacgcacgacgtcgccacaccacaatatcaccacgaccataaaccgatgtgcgcacaggtagctagagaccgagcgtggcgagatggacaggaccgagctcggcatggggatagagggaggcgagctagaagctgaaattggggctgggcgtcggccgttgctgaatcacgaaagcagcgcgccgtccgccagcgccgccaccacgaggttccactggatcttgacgtccagccggactgcagcatcgtctgccgcggcgtcgagcagagaaagagtagacaaccggacttgggcaggatgagctcgaggggagcagggaggcgggcgcgcgccgggcaggaagaagctccaaccgggtgccatggattgcggggcagagaagaagacgcggcgccacggagatccgaactgcgaccgggacatgcgccagtgagctcggccgagcgccatcggggcgagccgagggggaaagaaaggcagggccgagctgaggacttggccgggacgcgacgatgggagctgccatggacgagctcgcgaccggcgagcagaaggagcgtgcgcgagaacacggccggactcgaggatgagcgagcgagctggaccggacgccggaatggctgggtgcacggggaagaagaagaggagggaggagcagcgaactgcgctagtgagcagaggggaagagataaggccgagcgtcaggggagaacggcggcggaatcttcaccggcggtgagcggcggccaaaaaaatatcacgcagtcaggtacggtcgctggagagaggatgagaacgactgagacacaggaaaatcttgcgccggctgaacggatagggaggagcggttgggagatttttttgaagcagagcgcgcgctgggaattgcagcttgccggggagcagaacacagaggaagataccgtgaggagataaggcctccaggcttccatcggcggcgtaaaaaaatttcagatggagagataaaaacgtaagagcgcacggcggataggaagaagaaatggatatttgcagatttctctcttttttttaattatttctttagccgaaaaatcatagatacttttgaaccggaatttctagtgatagaaaaaagagtcgacagtaactgcgacagttgattcgattcaaaatctgataaatttacctgcggtctgaacatctggttcaacggccacagatgatttaccactgagtcgagactcaattacagatcctcgtacgcgatttcgcggcggacgagtgggaaccgaattaattaataattggttacacccgaagatttggatccgggcgagaacaacagaccgaaataaaatgatttcggcactgataatttgttttgcgcgattcgactgaaattagccgaaacgagatccgcaatgtatacgcgttttcgtcgccaaaacagcgtgcggaagaataaattgaattatatcctcgcacacgatttcactcagacgacgcacgattcggattattttgcaccgagtattttagtcgtcgagtttaaactaatttgctcggaataaaaatcgtccaagtgggtcggacttccgaattttgtattcgcgcgagcgatggatttaaataatcaccggacgcaccgattttcggaatgacgatgttccgaatatcacgaaaatttcagaagagcttggacagataaaaacaaagtcgaactcgcgacaaacgaaacagatgcgatataaaaatcgcgatagatgaagataaaataaatttagcctctatttcatccactgatattccgtgtttaattccatactcgttgtcgagcggaatataaacaccgggggtgttaca

SEQ ID NO: 404 - DNA, 2585 bp, Zea mays
tgcggaccaggcaatttgacacacacacttcttcaacattttcttgtagtgattgtggtcgtggcatgacgcgtgcataaggccagcatggtcggcgtcgggtggcgcgaaggcacggcagcactgctaggtcggcgagcgggctatgtcgcggtgtggctgcgccgtagggcgggcacacaacgaagccgcgtgagcacgacacgctatgaggtggcggtgtgtgtgccgaggggaggggatgcagacttcgcggcgacggtttttttggggggagacctcgcaccacagggactgcttggtgaggaaggagataggaagggcggcgatatgggaggggcacctatggaggttgtcggtgaccctgtgcttaaagcccggggcgggttgacctgccaccccgctacctccttctgcaggacgtggcgtggagctgtgccggcacgcggacgagagcaccggaaaccagagcgctggagccggaagcaggaaggacacgacggcgcggcatgaagatttgcagtcgcggagacgaccgaacgggagcgcgcaacgacatgcctactttgctatttgctaggcaggaggggacacggagcgccaaccatctccaccggcgtgggggcagggaggcggtggagttgctggcaccgtggttcgtggtgggagctaatgggagctctgggggccttctctgatccgaaagctttgcgggcgtcgcagaacggagaagggtaggatgcttcgccgtacgtcgatgcgcgatctgacggctgcaattttaggcggtgacgtggatagactagggagcgctgttttggaccggctttgttatataggaaatatatatatactagtgtattgtcacaagccctgcgcgtggtgtcatgtgagatcttaatttgtacataaataaaaataaagaacatactctccacccattgcttcttctggcgcgtcatcatcgtcaaaccatcgataaaggtcgtcatgtgccttcagagtgatgctagatatcagcaaatatcaaatgccggtgccaaatccatttcacagttactatgacaacgtaccttgttacaaagtgggcagctttgtacagaaaagtttcatgtgcatgatgagtacgaatgtgataatggcgaactaagaagaaagtcatgggacatttaaactaatggaaacctattactgttgcatatgttcttgaaacaggaacacatgatagtaattaatagttttggtatgcacatgttgtgaccaagcacccagctcagcatcgtagacattccatacttaatgaagtatctgccaccaactcttctagggtgtggtatccacaacttggtcgaaaactacaggtaaataattttagtatgcagctcaagtagtttcagtatggagttcttcagtaatgtgctgagggaaaaggaaaatggtaaaacgctctgaaattatgttcatacttgttatcggaacacgttatcaggatgtatgtagagatgatgttcacaattattttttggaagatatactcaccaaaaacaataactttgttgtgtattgcatctgcaacactattctccattaaggcacgtgtgcacaagcgcgtgcatatgggtacccctaaagagaactaaataatccggcaagctatgcaaaaagcaagtaaaaacatagtaaattaaaatgtgtgtattattgtccatgagcatgaggggaaaatagcataaatattaggtttacggtaacttttatatgatctgaaagagttattattcttactctccagtctccaccttggaatttacagatataaaagacataaagtaaaaatcatagcatgcatgtattatcgtccaggaagtcagataatttgtaaacaaactctttttatgtgccaccatatgaatcattgtattcatatgaattagtgtatttagcactagttgaacatcataagaaacgatcataggagaagcatttgaaataaaccatggggggcttctttctttggttccgcaagtggatacacaacaacatatgtggttcttgtctatgatttttttttcaaaaatgtatgtataaaagtaaagggtattgcatgtaggactatttttgacagggacaaacactaatatgaataatgtcgataacattttccagttagttagtatgaaccaaaagggaaaaaagattaccacatatggttttgtcagcaaatcaacagattaaaaatcgaaatttatataagaagcacaacagggaactcatgttagtattatcggtattgaactttaattattgtagaaatttgtaaactaaaaggttgagaaaatgggacgcagaaagaaacacatcaagcgactcatattatttttactactagaaaactatagtcattatacaaactttacagagttatgtaagaagatttgcacagagttatgtatttttagctttgggtagatgaaaagagaagaataatttggtatccttgtaaagaacaaatggaagtgtgaagatgagagatctataaaaaaagagaagcactttgaatggagtcgtcttctatagtgatatat

SEQ ID NO: 405 - DNA, 2584 bp, Zea mays
cttcgggaagcgtggcgctttctcatagctcacgctgtaggtatctcagttcggtgtaggtcgttcgctccaagctgggctgtgtgcacgaaccccccgttcagcccgaccgctgcgccttatccagtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctaccagcacagacgtcggattcacctttatgttgataagaaataaaagaaaatgccaataggatatcggcattttcttttgcgtttttatttgttaactgttaattgtccttgttcaaggatgctgtctttgacaacagatgttttcttgcctttgatgttcagcaggaaacttggcgcaaacgttgattgtttgtctgcgtagaatcctctgtttgtcatatagcttgtaatcacgacattgtttcctttcgcttgaggtacagcgaagtgtgagtaagtaaaggttacatcgttaggatcaagatccatttttaacacaaggccagttttgttcagcggcttgtatgggccagttaaagaattagaaacataaccaagcatgtaaatatcgttagacgtaatgccgtcaatcgtcatttttgatccgcgggagtcagtgaacaggtaccatttgccgttcattttaaagacgttcgcgcgttcaatttcatctgttactgtgttagatgcaatcagcggtttcatcacttttttcagtgtgtaatcatcgtttagctcaatcataccgagagcgccgtttgctaactcagccgtgcgttttttatcgctttgcagaagtttttgactttcttgacggaagaatgatgtgcttttgccatagtatgctttgttaaataaagattcttcgccttggtagccatcttcagttccagtgtttgcttcaaatactaagtatttgtggcctttatcttctacgtagtgaggatctctcagcgtatggttgtcgcctgagctgtagttgccttcatcgatgaactgctgtacattttgatacgtttttccgtcaccgtcaaagattgatttataatcctctacaccgttgatgttcaaagagctgtctgatgctgatacgttaacttgtgcagttgtcagtgtttgtttgccgtaatgtttaccggagaaatcagtgtagaataaacggatttttccgtcagatgtaaatgtggctgaacctgaccattcttgtgtttggtcttttaggatagaatcatttgcatcgaatttgtcgctgtctttaaagacgcggccagcgtttttccagctgtcaatagaagtttcgccgactttttgatagaacatgtaaatcgatgtgtcatccgcatttttaggatctccggctaatgcaaagacgatgtggtagccgtgatagtttgcgacagtgccgtcagcgttttgtaatggccagctgtcccaaacgtccaggccttttgcagaagagatatttttaattgtggacgaatcgaactcaggaacttgatatttttcatttttttgctgttcagggatttgcagcatatcatggcgtgtaatatgggaaatgccgtatgtttccttatatggcttttggttcgtttctttcgcaaacgcttgagttgcgcctcctgccagcagtgcggtagtaaaggttaatactgttgcttgttttgcaaactttttgatgttcatcgttcatgtctccttttttatgtactgtgttagcggtctgcttcttccagccctcctgtttgaagatggcaagttagttacgcacaataaaaaaagacctaaaatatgtaaggggtgacgccaaagtatacactttgccctttacacattttaggtcttgcctgctttatcagtaacaaacccgcgcgatttacttttcgacctcattctattagactctcgtttggattgcaactggtctattttcctcttttgtttgatagaaaatcataaaaggatttgcagactacgggcctaaagaactaaaaaatctatctgtttcttttcattctctgtattttttatagtttctgttgcatgggcataaagttgcctttttaatcacaattcagaaaatatcataatatctcatttcactaaataatagtgaacggcaggtatatgtgatgggttaaaatgcatccaccacagtgggatccgaagcttggaattcacccaaacaacaagcaatagatttattcaggttctatactcttctaagattaagcgttcatcgaaggactaataactttaggttcttcattacgagacacttagagccaacataagggtagaagcaatatgcttactttttaaa

SEQ ID NO: 406 - DNA, 2574 bp, Zea mays
gttaggtgcagtttagtttaactgatccaaatgaggcccaactatatgaactttgtgacatatggttagcaggttactcgggtcttattgggtgagaaacatcttaggctggtcaattttttacgtgtgtaaaacctcaatcatgtcacatccactcgtaagaagactcagttgtattcctgttaatagaaatggttgtttcctctctaaaaatatgttgactaacttggtctctatagacaagtttagtgacctcgtgggcaatttactatagcaggccccaaaagtcaaacaacaagttacctacttctccataagaatgtagcaatcaataacatgcatgtatgtcaaactgacaactaagacccaattgcagcaagagcgcatgacagttcctaacccatgagacccaatttgcagtagaaaagcatgcataagattttgttgacacttagaggagatggttcctaaattgttcgactccagtgcacctaattgggcctataaataaaccaacaatacaccttaagggagaaaattaagttgggtatatgatcgcatgtaaatgcgacattaattttcaggcctgctccgacagtgtaaacaagcgaaactatatttttcagacctgctaaccacctgacacaaagttgatatagttaggcctcatttggatcagctaaactcgactacagctaactcttgcgttttagtcttttgttgatcttcatttttattagtttcaagatcttcatgcttaacaaaagagaacaaatttcccagcgcatcctcaagaaatagcatactatctttggcatttatcgccactacatgtcatctaacaatttaaacacctttatttgtgctcccacttgcagctcctcaacattatgcaaaagcttttgagctgcttcagtagctcgctttacctgtaagttcttcctcttaatggtcccatcgtaacattcttccattttcttaagctgtttccacacataattctttttcgtttgttatgctgaaatttcattgtgcttttctcatcttaggatctagtaagctttctttagtttttaatctcttccctaatctcttctccaattttttgggatccgaattgtcagtactaatatatgaagtaaagtttagtcccaacaattcggatcaccaaaaaagtgaggaagataataggtaagagataagaaaactaaagtaagcttccaagatcatgagattagaggacagtgaaaattcagcacaacaggcaaaaaagaattttgtgtggaaccagcttaagacaatggaagaagattacactgggaccattaagaggaagaaaatagaggtaaagcaggctactaaagccgctaaaaagtttttgcataatgttgatgtgttgcaattgggtgcccaaaagaaggatgatgaaatttttagactacaaatagtggcgacaaatgccaaaaacaggatgttgtttcttgaggatgagctgcaaaaattgttgtctttggtcaaggataaagatcttgaaactttataaaaataaaatcaaccagagactaaaatgcaagatttagttgctgtccagattaactaatacaaacgaggcctaaccatatgaataggtggttagcaggttactaggttcttattgggtgagaaacttttgatgccggtggatttggctatgtgggtaaactctgaatcatgtcacatccactcttctcaagaccaaacacaagagttaggtgtcgattagtttaactgtggcctatataaaataatgtggactaacttgttctctatagacaattttttagtgatctcgtgggccaaaagttagacgaaaagttacctacttctccacgaggaaattgcaattaataacatgcatgttggtcaaactgaccactcagacccaattgcagcaagatttggcacacggacgaactgcaaacataaatgaacagtcaggactcacaaaatcaataggcttgtgctattgctctctctctcactcactgagaagacatgtacacaactctctatcttgtgagtatcaggagcatcgtcttgctagctttctcctaccagagcaccacactttctcatagcactagatggtacatctttgatggatccctacataaagcgctagcacccattaaataaaagaagtagacgacgacatgcctagaaactacacctctcgtctcgtctgggccacatgatgcacacgtcttaccatgagaagcgatcactactgcaggccaaccgtacgtgtctctccaaacataggccgcactagagcgcgttcttcaactagtggacacaagactcgcactaaatgcaggcatggtctgcatgaacaagacgctagcccgcacgcctcctccgttgctccatgcatatggggcgcgtcctttggctctgcgatccacctgaaccgctccactttttcatgtactcattgttagactccagcatgtttcatataaactcatgcatagtactagtatatggcatggcactccgttcgaaatccaggattgatggtctgatgtgctgcac

SEQ ID NO: 407 - DNA, 2573 bp, Zea mays
tgtaacaccccaggtgtttatattccgctcgacaacgagtatggatttaagtacgtaatatcagtggataaaacagatgctaaaatttaatcatcttcatatatcgcgattttagtattgcatctgtttcgtctgtcgcgagttcgacatcatttttatctatccgggctcttccgaaattttcgtgttgttcggaacatagtcgttccgaaaatctgtgtgtttggtgattatttaaaattcatcgctcgcgcgaatacgaattcggaggctcgatccactcggataattttacccggaacaaattaatttgaactcgacgacagaagtgttaatgcaaaattaaatcggaccacactcggaatccaagaaaaaccaggcgcgggattattgcttgagttgttctccgattgaatattcagataacggcgaaattcgtttaggttcaactaaatcaaatgtcgactaaaatattgaatctgatctcgtccggtttgaacccgtctacagctcgctcccgtgacgatgctgacatcgtctccggggaattccgattgcgatgtcgcattcggcttgcacggtttaaaatttatttctttctaaagtgtcgagtctagtgctagtttaaaattaattggtcaagatgaactaagattttcgcttaagtatttcgcttggtttgggcaatctctataaattcggtaaatgcgctgtctggggcaggctgttcaaataaactgaatccggaactgttgttggccaattcggtttcctgtttcaaaatccgagaaaaataatatatatagtcgtatagcatattgacactttatttatcgctataaatcgtgacctaaaatatctgcaaatctcttaaaaaaataagaaagggaaaatagaaaaaaaatcaagaaaaatcatctgacagtgctctctctccttatctcctcacgtacgctaagcaaatttttctccagtcttcgttctcatccgcgcacgggaggaaaatcttctctgcgttcctatccaccgccgctcaatcgcttgattttttccacgcgcaagctttttatctcctgcgcgcagactgcttcttctaggtgttgtacgcaggttccctgatcggcgcccatctcccccagcgccggccgctccttccctgccctctccccttcagctcgccgcaccctgctgaagctctcccatggcgtccgctcggcactgcctttctccaaccgcgcccggccaagttcccagctgcccccttgcttctctccctcctgtttctctgctcgccatggctgagcgcccagcagagctctctgcgcgcgcggatctctcctctccctggtcatttccccgcgcgcgcctgacacccgctcgtccctgcgcgcctgcgttctgctcggacctcgccatggagcttcctcgtcagaacgcccatctctccttctcgcggttccctgtgctcgtcccttcccctgccggcgtccagccccagctcagatctctgtcggccgcacatcccccggtcgagcagctcctccacggcgcccctcttccagccgtgtgcctagaccctcttcttctccctccctggtccgcccatgccgcgccgtggagctccctgctcggaccgcgcttagctcctctgcgcgctctgctttttgtgcgctcgaagctctctgctcgccgtcgaatcgcctgctcgctgatgtcgccaagtccgaatatcacagctcgcgagctcctctgcttggcccgtcgtcattctccagctgcttaccgcactcggctgttcgtcgtcatcgctcggtcgcacgacacgctgactcgcacatcctaggtcactaggtcctcatcgtcgcgtcgttcgccttcgcactgtgtgcgacagcatcgtcgttttccctgtccagtgctcgcgcggtttcccgctcgccagcgcgtcctctcggctcgcttggccttaatccccatcgcgtcattgacctcaccggttatcgtcgttcatcgtcaagcccgtcgaacctcgttcttccctgctcgatctcgtcgaaccccgaatcccggacattaggcaaacataaacgaggtccgtgtgcatcgcttatcaagtgctcggttgaagacttcaatcgaaggtcgtcgtcgttccgcgcgtcatcaagaaatcccaagagtcgggtgaagacggagccagcagcgtggtgttcaccaagtgcgcgacaaaaagctcgaacatcctgcgtgactcaagttcgattcgtcaaaattattcagtcaaggagaagatcttcagcaattgattaccgaagaaaagaaggcccctagatgacgtcaaccggaaaccgtcatcgtgcttccgactatcacgtcgaagtagtcagggtaagcaaatttgttattcgtgttagtggatggatggatggtctgactaggtataatatttattagattgcccgaatcattttggtaatttggtcgatgccgtaggatgaaagaggtctcaataggtctcagtgtttgcgggactatagttgttaaaaatgggaagttttattaatatatatgat

SEQ ID NO: 408 - DNA, 2569 bp, Zea mays
  misc_feature (1178)..(1181): n is a, c, g, or t
cactccaagaacaatttagtttatctaggtatcttttttttagtcaaaaaatttatattaatattgggagtagtaactttgaaattatgaatattctcaaggaaaggtgttttgatttaaaaacccctggagaattttcctcattttcacaggattgaactttagggtgttacatatagttgaagatagcatgcctaaactattattgtttatagtgtgatatggagcaaattgtaattaaaattggaatgcaaatttttctatatttaattcttttgttataaatgtcattgatataactgtaatagaataatcacaaagaattttaaaacatggatcaaaataaaagaagaattgcataaatatagctctcaactctagaaaattaccgatctaaaaaatatacatgttgcactttaaacatttctaaatttacctcattcttcatatctacaaactataatgccagcattcgaacatccaataatttgggttgatgatgaagcatgtgaaacaacatgttgcatagctcacgcctatagtaaattgatgataaaaaaaatctacatgtgcttcaaacgcttttagagtcacctcatccttcatatgaccaaatcttctgctagcatgcgacaatctagggtctcatactcatgttatggttgtcttgaacatgggttaatgatggtgcatgcgaaacaacacgttgggtccatccgtataaactgtctgtctaaacaatacaacatttagggcttcaaaatgcatcaaagttggcgcacatcagaaatcgatatatcatgcaacaaacttgtacgaatataatacccattagtccgatactcatgttttgattggccttaaattgggttgatgtgttcacaactgaggaacgttgcaagtagcacaatatatgttttaaggaaacatgcttaaacaagtatgtcttacagtacgacatttagaaaagaataatgaaagtggaaatataaattttcttccattaactatttttccattaatagaggtcgtaactctacaaaatagtttatcttgaaaaatctgcatattgcaattctaatacttttaaagttatctcattcttgaaaacactgaactttaatcgtcatgcgaccatctaattatgtgggtcccatactcaagttattgattgtgtnnnngaattttagttgatggtggagctgtgaaacaacatgttggatcattctgtaaatctatcacataatttaaggcttcgaaaagcttcaaagttttcgtatggttcatgccacaatcttttcgagaaaacatgcacgaaatcatgactcttttactcacaaatcagtgtattgcgaaaactttgatgacaaaccttgttgggtcctttttgtaaaaactaccattctaaacattacatcatttagggctttgaaccgattcagacttacattaatgtccataaccatgaaacatttgaaaattttccacttatcttacgagataacatgccaaagaagtgatgtttacattctggcaatgagcaaattgtaatgtaattttccttggttaaattgttttgtgataactatcatgagtcccatacttttttagtggcctcaaaacatgcattgttaaccataacaaagaatcatgaaaatagcactacataaagttaaaaaaatagcatgcctaaaccattattgtttatagtctggcatagagcaaattgaaattaaaattggaatgaatttttttctatatttaattcttttgttataaatatcattgatctaactgtaaagaataataacaaagaatcttaaaacatggatcaaaataaaagcagaattgcaaaaatatagctctcaactctggaaattaccgatctaaaaaatatacatgttgcactttaaacatttctaaagttacctcattcttcatatctacaaactatagtgccagcattcgaacatccaatatcttgggccctaaactcatgctataggttgtcttgcacttgggttgatgatgaagcaattgaaacaacatgttgcatagctcacgcttatagtaaattgatgatctgaaaaaatctacatgttgtgcttcaatcgcttttagagtcacctcatccttcatatgaccaaaactagtgctaacatgcgacaatctagggtcgcatactcatgttatggttgtcttgaacatgggttaatgatggtgtatgtgaaacaacacgttgggtccacccgtaaaaactatctgtctaataaacaatacaacatttagggcttcaaaatgcatcaaagttgacgcacattagaaatcgatatatcatgcagataacttgtacaaatataatacccattagtcccatactcatgatcggccttagacttgtgttgaagtcttcacaactgaggaacgttgcaaatagcacaatatatgttacaaggtaacatgcctaaacaagtatgtcttttaaaaaagagtaatgaaagcggaaatataaattttcttccattaactattttccattaatagagatcgtaactctgcaaaatagttt

SEQ ID NO: 409 - DNA, 2564 bp, Zea mays
gcacgagtataacgagtataatatagataatctacactaaaaaggatgaaacactttaaaaccaagcattaagcaccatggatatcatagcagggcatcgactacatccattaaccaaattgacatattacactagaaaatctatttttattcctagctttttattatctctttaaactatgtatcttaattacttgatttattgatttatccaaatcgatcatcacagtatacacatgctaaaataataacatttattgagaccaatgattctatttactctatttatagaccttgttgacgggaattcgaatcaacttacccatactaattcgacgcaatagtcacaagcacgacgacagtttccggttaacgtcatccaggggccttctcttcttcggtaattaattgctgaagatcttctccttgactgaataattttggcgaatcgaacttgagtcgcgcaggatgttcgaggagggaacaacgaggttcgacggttcaacgacaatacggaagagtgacgtatatagagctgcacagacccagggctgctgcacacacgacgcgacgacgaacgatgataaccagcgaggttgatgacacattgggaattaaggccgagcgagccgagaggacatgctggcgaacaggaaaccgcacgagcacaggacagggaaaacgacgggctcgacaacacgcgaagctatcactagcgacgacactacgatggaaggtggtggacgcgagctgagcgacggcaggacggacagatcgacgccatgggcgagatccgaactagaacagcagcacatcggcgagctcgcgcgcacagggactgagctaaaggctgggcgcagggacgcgacagccacggcaagggagctcggcagctgtggcaagcagagggaggacgcaaggagtcttacggcgcagacgccaggacgcgcgtgggagcttgctcgcgccatgaactgggagagcgagcagaggagagaagctgggagccgcgacagtagggagctagagtcgggcgctgggaaaaaaacaggggctggggcgccatggggaagaacctcggctgacagaaaacagcgcgccgagggagatcagggataagctcggcgcagagctccacggcgagctggagcaagagcatcgaggcaagccaggtgcggcaggggaggaggaagaaagagcgcacaggcagccgggcttgggcaggggcgagctccacggagaagaagccgagcgccattagacagggaaacttcggcaggggacgacgctgaacacagcgcgcgcgcagacagagaccaaatcgagctggggcttgctaggggagatgaccagcaagaccagggcgctggagctgggcgcggcaggggcacaagggcgtgcgcagggactaagcgccggccatgggcggggtcgcaggggagctccgagctagagcggaagaggaaggaagccgcggcagagaactccggcgagctggaggagctccgcgagcagagcacggcgctggagctcacgtggccgtggcgagcagaggacgccgggccagggcgcgacacgcccagggagcgaagggctagagcagcgtgcaccagggagaagaagctgggcggctggagatgcccgcgcgcaaggaaatatccacggagagagaacggcgatggaaaacaaatgtgtgcacagatgaagattggagcgctcggctggaggagataagcactggtgaagaaagatccagggagaggatagcgacgggaggatgagaaaaattctcacgccacgataggatcggctggtagtttttttaatctctttcttatcttttttttaaccgaaaatcacagatatttcgatcacgatttttaggaatatacactaggttgacatgctgtacagctacacatttcattctgatgatttagcgaactaaatcatctactaattacttgctgtcagtagtaattacggtggtttggtttgcttcggacaggatgcaaatagatcgaattagtcggatttcggcttcggtatttagtcggtgcctaactcgtctaacctgatagtctcattccttaatcaagcacccgatttctctgccgaagacaacatactggaaaaagaggcctaattattactcttgcgctcgccaaaacagcgtgttggaggataaattgggtcatagcctcgcgcaagatttcgcgcgatttgaattattttaccccaaacattttagtcgtcgagttcaaactaatttgcccgggacaaaaatcatccgagtgagtcgggcttctgaatttcgtatttgcgcgagcgatgaattttaaataatcaccggacacaccaattttcggaacaactacgttccgaacatcacgaaaatttaggaatagcccggacagataaaaataaaaatgatgtcgcactcgtgacagacgaaaccgatgcgatataaaaatcgcaatagacgaagatgtttaaaatttaacattcgttttatccactgatattacgtgcttaaattcatactcgttgtcgagcggaatata

SEQ ID NO: 410 - DNA, 2560 bp, Zea mays
ctactatccattccaattataactagtaactattaccatcgataagatatctcattgccattcccttaacaacgtttgaaccaaacaacaccatagtgtaaacgacaagttttcttcccacaataataaaaaccaagcattgcccaaatagatcaaaatcaaggcaaagcagaagaacaaagacttaattaaagaattgcaagaccaacttaaagtcaaacaagcagaacttgaagactcctagagaagagcaagaaaaaaatcattaaaaagaatccaggaaggcaaagccactcgtcgacgcctaaacgacgaaatcacaatatcagccaagatgacatatatgacgtcaatctaggatttacaacgaaagcttcacaagaaaaaaaactcacaatgttctttcatctcaattgatccaactttccggctatcaacaaacctacagatggtgcaatggcctttaggctataaattcgacatgcttccaatttatgaccgtcagtatgatccaagacaattcctgatgagctttcaaacagcaacaatctcaggggaggtgacaaagccacaccgacaaaatcactcaacatagtagtcaaaggatattctttgttgcacccaaagtcaatccaattttgggaccaaataaaagccaactaacgtggtttcggaaatcgggggacaataagatttgtgttcggtaggggtgctagcgcggacccactctaaatggtgagccacgggaggcttgaaggtggatctgagacatgggttgtactagtttaggccacaactctggtctccagtgtagtgctgatagtagtattgcttggagggtgttacagttgagtgtttgtgtaaaggtgtggatggtgtctctgaagatgggggttgacttgctcttttatagctcaagggtagactttacaaatgagaatttatatcctgtcggggtggagttcgacctcctgctccctggaggcgtagcccctacgatgtcatttgctgggtcgtgcgtcgttgtaccctgatatggcgtcgcgtcttgttcgttcgccatacgagtttctataactattctgatatagacatagcggtgcttggtaggtcttgctgagtctgctcgtggtaaagtttagggacgtcttgagtacaacttcatcttccatcatcccctcgacgtcacctttcatcatgcgtaggcgtatgcctgatacggcgtattgccccataccttctagcgtatgggtcactgtagagaccccgatgctgaggactccacgactggggttgactggtgccaccagtcagcggggatactctccagaacatgtccaatgttgtgcttgacagagacccttcgacactgttcccatggttcagttgcggcttggtgatgatctgtcttatcgtgctgttgtggcttgatagtactaggttggctcttccctcttgtagatgtgttcgctagagagtcggttgttgtcttgctgggttgctcggtaggcaggttgatcggcagcgctgcctcgccggagttgctcgccagtgttgttcggcgagccggttggtcgagcgggttggtcgtcagtctcgccttgtcgggtctgtcggttagtggaccgtctttggaaagtcttttgggtcttctccaggcacccggttcccaggtatccgacaccaacctactcattgatttcaaggattttagccaacgcgactataacaaatcttttcaagtgtaaacgacaacctaaggaacctctaactcaatatttcagaagattcatttgaatcaaagcaaaaatgcccaatatatcagacaatgtggttttcataacgtcaattacgaggcttccaatggggcacagaaatctatctaaaaactttatgaagtcatgcattttttgttttgcaaatcgacataaatcataaaaatgagctgaagaagaaatgagcactcaagccgtaataaaaaataaccataatcaacccaaatgaactggtttggagcgaagacctttctcttccttccctcaaataaaccatatcaacatcaataacacaacaacttttaaaagcaattttgaaaaagagaagtcaccatagagacataacatttggttaagatgaaacaagttacagaggacacacagatggactggtcgcaaaccactaaaacttgagaacatgttctctatagtacacgaaaaaggggcaggttacatatcagaaatatgtccaaaaattaagaaaagcattagagaggtacaagaggaaacaaaattaacatcttagtcaaatataatcaatcatgtctttgaggaccaagcttcgcctcacccattaattgtactaatcgcacaactcattcaaatccatcgttctcattcaattatgatcacattcaatcagtacaaaatgaatgaagacaacaaaactctcaacaatctaattttcaattgccccaacaagatgtttcagcaacaaacaactactcccttggaaagctgctagtgaacgatagacgccacataaggacttgttcggttagctc

SEQ ID NO: 411 - DNA, 2556 bp, Zea mays
accgtctcgtgggctcggagatgtgtataagagacaggagctacgaagagcctctggcctctagcacatacaacgggcttgaaagctctcgtgatctgctgtagctaggtgcaagaacaccagaaagggaaaggctagcaagctagctccacgaacaagcaagcacgactgatgtgtgaagcctacctaacatgcgtgcagcacatcagaccatcagtcctggatttcgaccggagtgccatgccatatactagtactatgcatgagtttatatgaaacctgctggagtttaacgatgagtacatgaaaaagtggagcggttcaggtggattgcagagccaaaggacgcgccccatatcatggagcaatggaggaggcgtgcgggctagcgccttgtgcatgcagaccatgcctccatttagtgcgagtcttgcgtccactagttgaagaacgcgctctagtgcagcctatgtttggagagacatgtacggttggcctgcagtagtgaccacttctcatggtaagacgcgtgcatcatgtggcccagacgagacgagaggtgtagtttctaggcatgtcgtcgtctacttctatttatttaatgggtgctagcgttgtatgtagggatccatcaatgatgtgccatctagtgctatgagaaagtgtggtgctctggtaggagaaagctagcaagacgatgctcctaatactcacaagatagagagttgtgtacatgtcttctcggtgagtgagagagagagagcaatagcacaagcctattgattttgtgagtcctgactgttcatttatgtttgcagttcgtccgtgtgccaaatcttgctgcaattgggtctgagtggtcagtttgaccaacatgcatgttattaattgcaactttcttgtggagaagtaggtaacttttcgtctaacttttggtccacgagatcactaaaaaattttctatagagaacaagttagtacacattattttatataggccacagttaaactaatctgcacctaactcttgtgtttagtcttgagaagagtggatgtgacatgattcagggtttactcacatagcaaaatccaccggcatcaaaagtttctcacccaataagaacctagtaacctgctaaccacctattcatatagttaggcctcgtttggattagttaatctagacagcaactaaatcttgcattttagtctctggttgattttatttttataaagtttcaagatctttatccttgaccaaagacaacaatttttgcagctcatcctcaagaaacaacatcctctttttggcatttgtcgccactatttgtagtctaacaatttcatcatccttcatttggcacccaattgcaactcatcaacattatgcaaaaactttttagcggcttcagtagcctgctttacctctattttcttccccttaatggtcccagtgtaatcatcttccattgccttaagctggttccacacaaaattcttttttcactgtcctctaatctcatgatcttggaagcttactttagttttcttatctcttacctaatatcttcctcacttttttggtgatccgaattgttgggactaaactttacttcatatattagtattgacaattcggatcccaaaaaattggagaagagattagggaagagattaaaaactaaagaaagcttactagatcctaagatgagagaagcataatgaaatttcagcataacaaacgaaaaagaattatgtgtggaaacagcttaagacaatggaagaatgttacggttggaccattaagaggaagaacttacaggtaaagtgggctactgaagcagctcagaagcttttgcataatgttgaggagctgcaagtgggagcacaaataaaggtgttgaaattgttagatgatatgtagtggcgataaatgccaaagataatatgctatttcttgaggatgcgctgggaaatttgttctcttttgttaagcatgaagatcttgaaactaataaaaatgaagatcaacaaaagactaaaacgcaagagttagctgtagtcgagtttagctgatccaaatgaggcctaactatatcaactttgtgtcaacaaaatcttatgcatgcttttctactggaaatttggtctcgtgggttaggaactgtcacgcggtcttgctgcaattgggtattagttgtcagtttgacaaacatgcatcttattgattgctacattcttatggataagtaggtaacttgttgtttgacttttggggcctgctagagtaaattgcccacgaggtcactaaacttatctatggagaccaagttagtcaacatatttttagagaggaaacaaccatttctattaacaggaatacaaccgagtcttcttactagtggatgtgacatgattgaggttttacacacgtaaaaaattgaccagcctaagatgtttctcacccaataagaccccagtaacctgctaactatatgtcacaaagttcatatagttgggcctcatttggatcagttaagctaaactgcacctaac

SEQ ID NO: 412 - DNA, 2556 bp, Zea mays
gtttccaacaaattatcctcgacagagaaatcaaacaggttcaaatggcagataaatatttgtccgatttcagttccatcaaatatcatatgaagtagtgaagccggtattattttagatctggttgtttacgtattgctcgagaaaaataatacgctagctcattaatcgaatcgttctgtagtcaaatgaccgaaagcacgtgagactcgtaaaaatttgactggattaaatatagtctaaaatatcgaagccaaaatcagtttggttcagtctgtgtgtttcttgtctcgatctaaagcttcaaatagaaataatgggtacgaattaatctgacttcggagtagtcatcaaatcaaatcgtgtccaaatatttgttctcatacatataacggtgttgaaaaaaaagaaaatatctcttatcctcatctcccatagttgatatgcattgatatttttttcttcatacgtggataccagatctttgttcctatctggtggttgatatttctgcaacgcacaagtgtgccagtcgtatcttctttacctctcggttcttcttgtacactctatctctcacctcgtcattctctctcgcgggacgttgctcccagctagcgcctggactctcgcctcactcagctctcattctcctcgcccccatgctccatccatggcgtgtgcttgccagacgccgatgtgagcttcctatgttcttctggccatgctccgccctctgcaccgctggccgctccggtgcgagctcttctcaggtgcacgctcggttcgtcggccgccccgagctcgcccctttgcttggaccttgcatccctgctcgctaatgtcggcaccctcctccagcctcaggctcgccatggccaccgtgtccctagaccctgctccagttcgccatggtcgcgcgtcgttttccccagcttggatttcgccagccgccgttctctggtccgtgtgccggtcgacgtcatggagttttgtttggtcggctcggcgttgacctcgctggtgtcgtcgaatcgtcgaaccccttcctcaatcgcgtcgggtctccatgccggttgtcgtcgttcatcgtcgcgtcgtgtgtgcaacaacgtcgctgattcctccatggtgcttatcaacgaacttcgcttcattggttcctcgcttttggttcggctcacgtatgcacgccgaacgcattcgccgcttgaccctgtgtcgctagagctcgtgaccttaccaacatcggagacctcactggattcgtgtcctcgctagagctcgcacaaacctgctcgaccacacctcaccagcttgctccaaactcgatctcgtcgtcgttccgtgcgtcatcaataaatcccaagagttgagtgaagacgaagctagcaatgtgaaattcaccaattactcgacgaaaagcctgaactataaatcatcttggttcttgtagagttcgcgtcgaatttaatcatgggtgagctgattcgctactatattattttgttttaattaatggattgatagatatgtaggttgcgacaatcctttttatttagcataggtgcgcttagtgattatgttgagatccgttgttgtgtcggtgtgctgttccgtggtgatataattatttttagaattataaagtagtcaggtcaggggttatggtctagaattttgataaaaaaattatgcgacggatatcttgtctgtagcataggcacgttgtggttttattatatgtttgataaaatgccttgttacatgtattgttgcaactgtgttcgtgattaacaaataattgtgtcgcgtaaagcttaggtttaaaatgcatattttaggagtgtattactgaatgtataaatcaagtgtgattggattaataataggaaaggcaggttaagtattttaaatggctggcgggcaggatttaccagtgtttctaggtttttaggtgttaacgctataatcttatggaattctactaagttgataatgagttgtccgctagatctaaaactaatatgatattcatgtaattagcgtgttatccaaattagttagaataagtgatttagaaagtcagttaatgtgcttctatccttcctctaaatttgttgttctataatattcagactaattttagatgttatgctctaatttgtggttgtgttcaattattgttgattggatgtttgaattaagtacaaatatctcaaagattataattaccatagagtcatagttatctagtgtgcgttcataggagttgtgatgcatcgtcactaagtgtttagttcgttttcttgaagcaatatttaatcctgctattccttcttatgttcatacatgcacattatgcattccatttaggtacgttaattaatcacgtgatgtggaggaccaaagctgagtcgaccacaagatgctgttaagcacgggtttcttcgtaaggtgatactggtgaatgaacttgaagattgggtgatcggatcaagcgccaggatgagagatgctagccaagtggacgtcatctaacaaacactaacctag

SEQ ID NO: 413 - DNA, 2554 bp, Zea mays
gtaacaccccaggtgttactatacgtttaacagcgagtacggacttaagcatggtatgtcagtgagaataacaatatccatatcctaattatcttcgcctatcacaattttgatattctatctatcttcgtctctttgaactgtccaaaattctcgtaaaattcggagttaaataatcatctagaatgtcgagtcttatgtctgctaaaaataatttattatacaagcacgaattagtaaaccctcgacgtttataaactagaccacgctcgctaccccagaaatcgtgcgtagagtaaaaattgagattttatttttccagcgtgttattcaaggcaaagaaatcaaagtttttcggatagcagataaattattgtctgatttcaactaaattaaactttatctaaaatatatttgacccatagcgttttgatctgatccatgtagatcctgccctaaaccatagttctaaaatcaaggaatataattatgtcattatttttctaaaaaagagaagtaaaaaaaaatctcttcccatccctatcccatgtcgccgccctcttctgatcttttcttcaccacgcgtgtgcggcctgatatttctagccgtcgttatctctctctccatcagctcacggcactccctcggtccctcccctacttcccatggcggcagtgctccctctgccggcgccaccccttgctcctccaagccggcgtcctctactacatcttcttccccagccgcgtgccttggcgtctgcgcgccgtcgagctcctgcgcgcgcgttctcccgcgcccagccccattgccgcggtcgcccagctcgccatggccgccgagcttcgccctacccagctccctctgcccggccggagctccgctctctcatggcgcccaggatcttcctgctcggaccgcgccttactccagctcgccgaatccatctctcctccatggcgctcgtccagccgccggtgacgagccgctcgtcccatctccctatgtgccgagctcctccctcgcctccatggccgcgcttcctccctcctcggctctctggtgtttggcctccagctccagctcaccgaggtccctcctatggtcgtctccctcaagccgcagtgtgcccagccccagcctggaccacgcccctgcgttcaaccactccctgctcctctcggccagctgcttgcgcgtgctgcgcgacatcgggtccttgacgcgtgcgcgatggacgcgctgcgtgtgcttgtgtccgagcggccgcaacctcgctttgctcctcgcgtcgccgctcgccgagcccttccccagtccgagctcactccctgcccgctgtcgcgtcgttcgccgtcaagcctcgttgcccatcctggagttccctagtgtcagcctccacgcccgtcctaggccgtcgttgccagttcgcctccgtctcgtggtggtgttgcgctgccgtcgagtcccgatgtcgatctggtggccgttgatttgaagctctgcacggattcggccacgtccagcactatctaggtcattgttgttcgccttgcgctgtgtgcgacagcatcgtcgtttcctttcatgtgctcatcctcaatctccgcctcgccatcaccctctgtcgcagcaccgtgttgacgacttgctatcctcgccctcgcgctgacgcttcgtcgaatgccactccagtactcgccaagagaagatcttcagcaattgattactgaagaaaagaaggcccctgggtgacgtctacctagtactcaacgaaaggtctgaagtagaatttgtcaccgtgtccgtggaagtggagcgacttgatattggtaagcgaactcgttacttcggatagttggtatgataattggattggctagatttattaatcgtaataatcctcgtgtttagcgcaggcgcgttggggtcgtgtttgttaaatatatgtgaagtacgattgagttagtaatgcgaaaggtagattattttttgtgatatttgggcgagccgaccacgtaaaagatagatttagtatttcgtacaattatccgataaattttgtcattgtcgattatgctaaatatatttgtttagtgaagtcgaaatataagaaccccgtgcagaagaaacgttataggtctttagatttaaaaaattatggtctggtggtagtctttgatgtctgataaggttctgcttgctaaagcgaatgatgtgatgccatgttaattattgtgctaaacaagttaacctagagaattagtttaaaaagttaattaaacaatttctatgcttatcccaagtttgaatatcgagaggtaggttttaggagagtaaaatgcttatacataatttactgttgagtgctgttagaattaaatctgattaagttagaatgccatagctatagttttaatgtgatatcgatatctagtattttcgtactagatttccgatgtcttactataggtgtttaattcgctatcgtgtagcactatttaggtttgtgatattcctgtctatatgtatggcagaacctcccaagttatt

SEQ ID NO: 414 - DNA, 2553 bp, Zea mays
cactccactccggctagggtggcgatgtcgaactccgggcacgtgtcgttggtgccgaagagcgccgtctggctcaggctgacgtctggtgagtggatgttcaccgcgaagaagacgccgctcagcatgccgagacatgtcacgacatccgtgaggctgagaagcacacacacacacaccaagaacccgacggcgataagtcccgaggtgacgagcgatagcgtcatcgtatcgtcgtgctattggacgcgaatcccgttcgaatcgtgtctatatagggaggcagcactggcattgtgactttctttctcgaagaattattctctcccgtgtccacaaaaaaaaccaaattactctaccacggaggcagcacgtgcatagagtaactgaggagctcgctaacaagagacggtggcaaccgcatacaagagagctgcggctacggctgttgggctcgtgcatggtgctggtgggggtggtgcgacatgcgcggaggcgacggaggaggatcgcatggcggatggcgcggatagagtagatgcatccgtatccaagcaggcgtgcggggggtctgttgaggagtgggcacctcacgcgcgcggagagcagatcgtgggttagattttggagaaattaagggtttttttttgaaaaaaaccatcgaaactgatgctttaatatattattattaaagagtaaagatataaagatatctgaggcacacaaaccaaaaacaacgacatatgagcttggatttcgaacactaactgcgaaaaggattagctacgagccatacaacattcaacaacacgtactaatgtctagcctccaaaaccagaatggatattatatcacgcccaacgccttcctccgatacgccttgcaagttgtatgtccttgtgcactgcagcagcaggaaggaaaacatttagggtaacacatttcctatagatccttgaatttatcaatcaatgtttgcgtttgtataaagctgaactaaattcagcaccagtagagattttttatcccactctctaagtcgtaattgttataataatagttactatttgttgatgtctttgttgataatcaaaccatgtaactggttcctttgttgataattgatgtctttgttggtaatcaaaccatataaatggcctactaaaagttaacaattgcactatgcgctatttgaacgttaccattatatttccactcataacaaggcaattcgccacttgaaataatatctagattccatctgaagcagaatcactaaagaatcgtgtaataaccaaaatgcatcacacatatcattatattaggagtaataaatagtacagagtaaaaggaggagttcagtctgtgacaacttactgactgtgacacgcttggcatggatggcacacagattcgcaatttcaaacagttctatcaagtggaattctgctgcctgtagacaaggaggaaaaacaataaaagaatctaaatgaaatcaaacattaactgagacgtaagacatgtttcataactgacctcttgcagagcaaggagggcttctggggtatagcgctctaccttcccgtttgttaagaaattggttaactccctcacctgcatatatatatatttttttcagaagaataactttccatcagacagaatgcggaacaaacccatgcataccatgaagaggacaacgcacgctgcacccaccacacggacgaagggcgcaaagggtatgagcggttcagtggacttctggtacttcctgatctcccgcagcgctaccgtccctggccgccagcggtggcgtggtttcgtcttcttaactgtttttttaagaactccgaaaccatgacacccatatggaactggcacactcgccctgctatcctcatcttgcaacaaaattagattgcaagcgaaaggggggagcgtgggttacctgagcgttcgaactgcagcttcttcttcggcttctccgctggcttcctcacggcctggtgcttggttcgagccatcgcgctgggcgcctcgcactgctctcgtggccgacggtttggattcaaaactctcggggcgagtcgtacccctcccctcacggcctcaccccccacgtacgggtgtgccgtttgtcgctcgattcgtggaactgttttgtgttaccagttttaatgagagctcgtgtgctgctgtgggctgtggcctgtggcagtgggcctggtatcgctcgaccccacgcgtctcggcatggccatcggttacagcgtcttcggctcgcgacgacgcattcgcgaaggccgagcagatctggggggtcggcgcgtcgcgtggagctgcagccgggcaccgtgcgggcccaagggtcaactgacggcaccctcagctccgacttctgcggcatgggcgtccgcgacggccggcgacagcgcgttcgagggccgggtcggcgttgacctccggccgctgctgtgcctgtgatggccccatccttcgtgtggcctgctgtgcctgtgatggccccatcctgtttgtttcggcttttcgcag

SEQ ID NO: 415 - DNA, 2553 bp, Zea mays
  misc_feature (43)..(46): n is a, c, g, or t
gggcttgcctgaataacactaggttagtgttgttaggtggcgnnnncttgacgaccatcctttgtcttcgcattgttctgattatccatcttcaggttaatccatcagcatcatcctgcgaattagcccgcgcttggggtcgacttggcttatcttccgcatcacgcgattaattatcgtacctcatgagatgcacgatgcacatgtatgagcacgagtataacgagtataacatagatactctatactaaaaaggatgaaactcttaaaatcaagcattaagcaccatggatattatagtagggcatcaattacatctattaaccaaattaacataataacactagaacatctatttttattcctagctttttattaactctttaaactgtgtaccttatatattaataaaacttttcatttttaacacctatagtcccgcaaccactgagacctattgagatctttttcatcttacgacatcgaccaaattactaaaacgactcaggaaaacaataaatattaaacctagtcaaaccatccaccaatccactaacacgagtaacaaatttacttaccctaaataattcgacgcgatagtcgcaaacacgactacgggttccggttgacgttatccagaggccttcttttcttcggtaatcatttgctgaagatcttttcctcgactgaataattttgacgaaccgaacttgagtcgcgcaggatgtctgagctttttgtcgcgcacttggtgaacaccacgctgctggtcttcgtcttcacccgacgcttgggatttcttggagatgcacgaacgacgacgagatcgtgtttggagcgagctggtggggtggggtcaagcaggggatgacgggttcgatgacttgatggcaaacgcgagcacgcgcgaaacccgatagaggagagtgagtgcccgcagtgacaacgagcagacgtgcgagcgttaacgcgagccagcggcaagcacgagtgttgaggtacaaccaacaacactcgacgagcacgcagcgaggcacacaaccgcgacgacagtcgaattggcaacagcgtgttggcgaacctggcgaacacgaccacagtcacgtgctgatgcggtcaagataactgtggctaacgagcttgcgacagaagcgatgatggtgcgggagctcgacacgctgtggcgagcagataaaattcgtgcgcacggcaaacaaagaaaatggagagcagaggggttgggcaactccatgggcgagcagagcacgccaccatggcgagcagagaagcacgacgcgcgacatggaagcttcgtgcagcggacggcagcgcgcatggggaatttggtgcggccgtggaagctccaagccagcacagggaagaggccaagctgggagggaggctgcgcgccgaggaagctgcagcaggggaaatcaccatggatgcgtaggggtagagaagacgctggcgagcagcaaggcgacgacatcgctggagattcgacgagcaggagccaggcgcagaggcgagttccacggagaagaagctgaggggggtcgcgaccagggagatgggcaggggttgagctcggccggacagctgccatggcaacggcaaagggattccggcgagcagagaagtacacaggggcggcggctgggcgcagcgcgagccatggagatgggcgccgagctggaggagcaaggggtgcacggggatgggggcagagcgcgccagggagaggcaaacgcggccaccatggggaacgagccggagctgcacgcgctggaaaataaccaaacagaggacggctggagaagataaaggcaggggatggagagaagacgagctcacgttgggataaccggataaggtcattagctgtacacggtggggaatatcaaagaaggcagtgccagccagcagataagaatggccagggatgaggccgacggccaacacagtgaaagaaaatctgagaacgtgagcggtggagaagatagagtagaagatggctgggagatatttttatttttttctcttttctctttttttataaagaaaatcgctgatattttgagtcacgatttgtagcgataatcaaagggtcgatagtatttgtgacacggtttgattcgattcgaagcacgagatatttgatctacggtcagaatacatgattccatggtcacggtaatttacccgagaatcgaagctcaattataattctcggatgcgtagtcacggttttgatttagcgaatactggaattagatgaatttgcacccgtcatttatatccaaagttttggatcgggcaagaaacgacagaccgaaataaactgatttcggcactgataatttgttcggcgtggttcgaccgaaattagccgaaacaatatctgcaaacgattacgcgattttgtcttcgaaacagcgtgctgaagaataaattggattataacctcgcacacgatttttctcagacaacgcgcgattcggattattttacactgagtattttaatcgtcaagttcaaactaatttgctcggg

SEQ ID NO: 416 - DNA, 2552 bp, Zea mays
gaataacggagtccccactatcgagtgattacaaagagaataactgaataattcagttatgactgcgaaataactgagtaatgagcagagaataactgagtcatcacaccagaataactatatgcgcccattagaataactgagttccgacaaaagaataactgagtgacgaacatggaataactgagtcggcacatcgcaataactgaggtattataacataataactgagggatcagaaccgaacaactgagtgccgacaccagaataactgagtctgcacacaataataactgagtgggcacattccaataactgaggtatgatgataactgagggatcggaggagaataactgagttagcccacaagaataactaaggtattggaacggaataactgagttctgtcaccataataactgagtgcgtgcattagaagaactgagttgttggaacggaataactgagtaatgaacagataataactgagtagtgaacaatagaataactgagtgtgcacaacagaataactgagtaatgaacaatagcataactgagttacttgaacgcaataactgactgtgaatagagaataactgagtaataaacaccgcataactgagtgggcacattacaataactgaggtatgatacaggataactgagggattggagtagaataactgagggatcagaaccgaacaactgagtgccgacaccagaataactgagtctgcacaccataatcactgagttagcccacaagaataactgaggtattggaacggaattactgagttctggcaccagaataactgagtgcgtccattagaagaactgagttgttggaacggaataactgagtcatgaacatataataactgagtaggcacattacaataactgaggtatgacacgggataactgagggattggagtagaataactgtgttctgtcactcgaataactgagtgatgaacatggaataactcaaggcgcgcattagaataactgagtaccgacattagaataaccgagttaggaacatggaataactgcggtgttataacataataactgagggtttagaataactgaggtattataacggaataactgagggattggagtagaataactgagttggcccacaagaactgaggcacgagcagagaatagctgagtttcgtcaccagaataactgagtgatgaacacagaataaccgagtactgaaccgagaataactgagaaatgaacatggaataactaagtgcgcccactagaataactgaggtattagaacggaataactgagtaattagtagaataactgagttatttgaacagaataactgagtgtgcacattagaataactgaggtagtagaacgtaataactgagttccgtcaccagaataactgagttattagaatggaataaccgagtaatgagtagagaataactgagtgtgcacattagaataactgaggtcgtagaacgtaataattgagttccgtcaccagaataactgagtactgacacaagaataactgagtcgccacactagaataactgagttactggaacggaataactgacttgtgaacagagaataaccgagtgggtacgttacaataactgagttattataacggaataactgagggattggagtagaataactgagtcacgagaagaaaataaatgagtcggcccacaagaataactgaggtattagaatggaataactgagttccgacaccagactaactgagtgcgtccattagaataactgagtggcacataaataacttgcgcatattacaataactgagttgcacatattagaataactattcagaataaaataactgagtggcacataaaacaactgagcgttcatcatagaataactgagtttggaacataaataagtgagcatccagtacaatataatcgagtggtggatctcgtcgaggtccaaatgacatcaccctacaaactctaagtagcctgacttggtagcagctgaggcagcctgtcatctgagccgactagtcctccttgcagcaatgaccaaccttttggccaggagagcgtcacggcggatggtggaggtgtgcccaatatgctgatggttacttcctccgtgctactacttgtgcgtagttgccacaatggaggtaaccaccagcacattggtcactagcaccccaagcccttctcaacataaaaagaacaaagtataaataactgacatggctacaaaagagaaataggcagaaaacggcttaccgctaaggctgcatgaacacgactacacctttactccaaattcaatagctgcatcataccttccaaagagtccttaagttcttgttccttattttgtaatgcatcaatctccttcgtcagttcatccactatgtctcgcaagtcccccaacaaattcgtgatatattgaggaaaaaccggatgatgccattgaaagaaatcgcatctctctgggtcagactaattgcatctctctaggtcccgaccctgggttc

SEQ ID NO: 417 - DNA, 1744 bp, Zea mays
gagtaacctcggtgtgcggttgatattgccaaaacagagctgtgggggagagttgtcgagaaagagtgcggaagatgcaaaggcgtcggctattcaaggatgccagcaagcgcagcatatcgcgctgtgacgatgctaatcccaaaccttacccaacccacctggtcacgcactgttaagccgctgtatgacgctctggtggtgcaatgccacaaagaagagtcaatcgcagacaacattttgaatgcggtcacacgttagcagcatgattgccacggatggcaacatattaacggcatgatattgacttattgaataaaattgggtaaatttgactcaacgatgggttaattcgctcgttgtggtagtgagatgaaaagaggcggcgcttactaccgattccgcctagttggtcacttcgacgtatcgtctggaactccaaccatcgcaggcagagaggtctgcaaaatgcaatcccgaaacagttcgcaggtaatagttagagcctgcataacggtttcgggattttttatatctgcacaacaggtaagagcattgagtcgataatcgtgaagagtcggcgagcctggttagccagtgctctttccgttgtgctgaattaagcgaataccggaagcagaaccggatcaccaaatgcgtacaggcgtcatcgccgcccagcaacagcacaacccaaactgagccgtagccactgtctgtcctgaattcattagtaatagttacgctgcggccttttacacatgaccttcgtgaaagcgggtggcaggaggtcgcgctaacaacctcctgccgttttgcccgtgcatatcggtcacgaacaaatctgattactaaacacagtagcctggatttgttctatcagtaatcgaccttattcctaattaaatagagcaaatccccttattgggggtaagacatgaagatgccagaaaaacatgacctgttggccgccattctcgcggcaaaggaacaaggcatcggggcaatccttgcgtttgcaatggcgtaccttcgcggcagatataatggcggtgcgtttacaaaaacagtaatcgacgcaacgatgtgcgccattatcgcctagttcattcgtgaccttctcgacttcgccggactaagtagcaatctcgcttatataacgagcgtgtttatcggctacatcggtactgactcgattggttagcttatcaaacgcttcgctgctaaaaaagccggagtagaagatggtagaaatcaataatcaacgtaaggcgttcctcgatatgctggcgtggtcggagggaactgataacggacgtcagaaaaccagaaatcatggttatgacgtcattgtaggcggagagctattcactgattactccgatcaccctcgcaaacttgtcacgctaaacccaaaactcaaatcaacaggcgccggacgctaccagcttctttcccgttggtgggatgcctaccgcaagcagcttggcctgaaagacttctctccgaaaagtcaggacgctgtggcattgcagcagattaaggagcgtggcgctttacctatgattgatcgtggtgatatccgtcaggcaatcgaccgttgcagcaatatctgggcttcactgccgggcgctggttatggtcagttcgagcataaggctgacagcctgattgcaaaattcaaagaagcgggcggaacggtcagagagattgatgtactgtctcttatacacatctgacgctg

SEQ ID NO: 418 - DNA, 2546 bp, Zea mays
cggtaatgtcatacacgtatgccctggtattatactgtcagtgggccaggctaccacacatgttcttttatattagattgacatgtgggaccaacttttggggaaagaggaaagctacaaaaggagatcatgcagtagagtaaggaagggggagagaaaatcagaaaagagtcttgttctcgttgtcttcctcacgaagacacggtccaggtgagcttctcgatcgcctcacgtctcggtcttcaccgccggcggccacggggcatgacaagtggtatcaaagcctcggtgatcctcgccaagggtgcatcagcggtggttgggtgctacgatcggaagcggaggagcggctgcgacttcgtcgattcggagccttcaaacttcggcggcgacgcgacgctactcgggaggcgagacggtggcgctggtggcggtgatttgcatttggtgatgagtggcggcggtggaagtgtgaccagtttcctgcggtgatgtttgaggtggctgcccatgaggtgttcgatggcatgcctcgttgggataatgatacaatacgagttcagcaagttgcattcgaggcttcaatggtgtcgacaacacccgcacatgagctgttcgacgaaaatcctctcgtgaaggtgatatgggatgaggaatcgcatcatggttttgatccatatcgtctagagcagcagtgcaagctgacagtgttcaaggcaccaatgatgtcttagagtgatatgcacaaagtgtttgatccactttctagccagattgtgtggggtgatgagttgctgcaaagttatgagccccacgacagtttacttaagctggtggctcacggagactttatggttggtgaggccacaatgcatgctgagccatatgacatagtggtgcgggatgagaggaggcctcagaactttgtctcgcatcaaggtataatgcagcagctagcaaatggtgaagagtatatgactgatgaaaagacacataatattgttgagcttgctaccaatgatggatctactcatgccagggactctccattatttttagacctagctatggatattacaaaccaggtacttgttgtagatcctaattcagacaccaaggaaggcacaacatatgagcctgagcagttgtaccatgaatcacaagtaagaaattcggaatagaaggccatccatatgtgtcttccgtcatggacaggtggcttgagaccatggagaacagtcactcaccaggtgcttgaggacatgtcagtagggaggcaaattaattttagttgtggaagcaatgaacacctatataagctatactgtgactttccagactgcagctttactaggttgctcagtgatagaagtctgaactctgttttatatctctattatgcctcttattggttggatgtatatgagttgcgctctcttacatttgttggtgcatggtccactatcaactacagctctaatacaaagaagatgtgtgatgcagcaaagttggagtctttgctttattttgatgtcaacatgtttacacttctcttagatttctccacaagtccatcagatcctcgtattaccatggaggattccacaactgaaatgtatgaggcagtgcggctgtttgaggctactgtaatgttgacattctgttcaggaggtaaagcacttggaataatgggcatacagtatttggatgcatatagagaaaagcaggttgccaagttgaacactgataacttggttgccaatgtcaaaaaaccatatctcctacttgagctcggaatggttcatacagaccaggtgatcgataacctacacaacaagggtcaggaagcaaaaattttagaagccttagtagcatacatatacaggtccaattttcatgtcaccaatgggcaaaaacagcaacaacaaggaggcaatccgatggagattacgtctttaagtgatgaagttcttggatctctttgtcttgccaacaaagactatggccgataggtcgaccgagatcatatggtcatgtttcttacttaccatggtccttctgatagtcacgagctaaatcaagatggtgagatattaatcgttgttggcaaacttccaccgtggagtgctgcatgtcaaatgttagatggactactatcctggaggcaccatcccttatgtctagggatatttggaaaatatgtgggcaagcttaattattccagcataggaagaagtgaggtatcaaaaattcaaatccagaattacccaaagctttatctcgcattatttggacatgagattctgcatattcagatttctgtaaattcagtgatggtgcaactgaggttcggttttccttggacctgccaacttttgatattgcaaatcttcactacacagtgtctgtttggaaattttgttgctagtcagtgcttcagctcatttgatcttggagtacaaacgtacagtcatctgacactcccatactattcacgtgttggtcacactatagtgagtgtcaaagcctgtctcttatactcatct

SEQ ID NO: 419 - DNA, 2546 bp, Zea mays
  misc_feature (1278)..(1279): n is a, c, g, or t
cattaattttcaggcctgctccgacagtgtaaacaagcaaaactatatttttcagacctgctaaccacctgacacaaagttaatatagttaggcctcatttcgatcagctaaactcgactacaactaactcttgcgttttagtcttttgttgatcttcatttttattagtttcaagatcttcatgcttaacaaaagagaacgaatttcctagctcatcctcaagaaatagcatactatctttggcatttatcgccactacatgtcatctaacaatttcaacacctttatttgtgctcccacttgcagctcctcaacaatatgcaaaagcttttgagctgcttcagtagcccgctttacctgtaagttcttcctcttaatggtcccaccgtaacattcttccattgtcttaagttgtttccacacataattctttttcgtttgttatgctgaaatttcattgtgcttctctcatcttaggatctagtaagctttctttagtttttaatctcttccctaatctcttctccaattttttgggatccgaattgtcaatactaatatatgaaataaagtttagtcccaacaattcggatcaccaaaaaagtgaggaagatattaggtaagagataagaaaactaaagtatgcttccaagatcatgagattagaggatagtgaaaattcagcacaacaagaaaaaaagaattttgtgtggaaccagcttaagacaatggaagaagattacactaggaccatttaagaggaagaaaatagaggtaaagcaggctactgaagccgctaaaaagtttttgcataatgttgatgagttgcaattgggtgcccaaaagaaggatgatgaaattgttagactacaaataatggcgacaaatgccaaaaagaggatgttgtttcttgaggatgagctgcaaaaattgttgtctttggtcaatgataaagatcttgaaactttataaaaataaaatcaaccagagactaaaatgcaagatttagttgctgttcaaattaactaatccaaacgaggcctaactatatgaataggtggttagcaggttactaggttcttattaggtgagaaacttttgatgtcggtggattttgctatgtgggtaaaccctgaatcatgtcacatccactcttctcaagactaaacacaagagttaagtgcagattagtttaactgtggcctatataaaataatgtggactaacttgttctctatagacaattttttagtgatctcgtgggccaaaagttaganngacccaattgcagcaagatttggcacacggacgaactgcaaacataaatgaacagtcaggactcacaaaatcaataggcttgtgctattgctctctctctctctcactcaccgagaagacatgtacacaactctctatcttgtgagtatcaggagcatcgttttgctagctttctcctaccagagcaccacactttctcatagcactagatggcacatcattgatggacccctacatataacgctagcacccattaaataaatagaagtagacgacgacatgcctagaaactacacctctcatctcgtctgggccacatgatgcacgcgtcttaccatgagaagcggtcactactgcaggccaaccgtacgtgtctctccaaacataggccgcactacagcgcattcttcaactagtggacgcaagactcgcactaaatgcaggcatggtctgcatgcataaggcgctagcccgcacgcctcctccattgctccatgcatatggggcgcatcctttggctctgcgatccacctgaaccgttccactttttcatgtactcatcgttaaactccagtaggtttcatataaaatcatgcatagtacttgtatatggcatggcactccgatcgaaatctaggacggatggtctgatgtgatgcacgcatgttaggtaggcttcacacatcagtcgtgcttacttgttcgtggagctagcttgctagcctttctctttctggtgttcttgcacctagctacatcagatcacgagagctttcaagcccgttgtacgtgctagaggccagaggctctccctagctccatctgaaaaaggctgtagcaggaaatcacttttgctcgagccgctactgctggtgcttcatctcttaggctctctattgatccatatccatgtttggtgctagtacggcgcggtcgtcagcactacacacaacgctgttcggtcctagtgcaatgatggcaccttgatcgtctttctacgtctccgtcaaaaatgaactaataataatattcaagaaaaacaaactttatataaggccggtcgtacttacttaaagctaatagttaatgtaataaataaagcaacaaattcaaaaaagggattacattattttagtatttagttcgtgaacaagttggtccccatcaagtcagccttgatcttgttatcaatgacgactgtctaaacgataatggactccaacatggtcgagtatgtcattatatttcacggaatttattaggggac

SEQ ID NO: 420 - DNA, 2545 bp, Zea mays
gaacccagggtcgggacctagagagatgcaattagtctgacccagagagatgcgatttctttcaatggcatcatccggtttttcctcaatatatcacgaatttgttgggggacttgcgagacatagtggatgaactgacgaaggagattgatgcattacaaaataaggaacaagaacttaaggactctttggaaggtatgatgcagctattgaatttggagtaaaggtgtagtcgtgttcatgcagccttagcggtaagccgttttctgcctatttctcttttgtagccatgtcagttatttatactttgttctttttatgttgagaagggcttggggtgctagtgaccaatgtgctggtggttacctccattgtggcaactacgcacaagtagtagcacggaggaagtaaccatcagcatattgggcacacctccaccatccgccgtgacgctctcctggccaaaaggttggtcattgctgcaaggaggactagtcggctcagatgacaggctgcctcagctgctaccaagtcaggctacttagagtttgtagggtgatgtcatttggacctcgacgagatccaccactcgattatattgtactggatgctcacttatttatgttccaaactcagttattctatgatgaacgctcagttgttttatgtgccactcagttattttattctgaatagttattctaatatgtgcaactcagttattgtaatatgcgcaagttatttatgtgccactcagttattctaatggacgcactcagttagtctggtgtcggaactcagttattccattctaatacctcagttattcttgtgggccgactcatttattttcttctcgtgactcagttattctactccaatccctcagttattccgttataataactcagttattgtaacgtacccactcggttattctctgttcacaagtcagttattccgttccagtaactcagttattctagtgtggcgactcagttattcttgtgtcagtactcagttattctggtgacggaactcaattattacgttctacgacctcagttattctaatgtgcacactcagttattctctactcattactcggttattccattctaataactcagttattctggtgacggaactcagttattacgttctactacctcagttattctaatgtgcacactcagttattctgttcaaataactcagttattctactaattactcagttattccgttctaatacctcagttattctagtgggcgcacttagttattccatgttcatttctcagttattctcggttcagtactcggttattctgtgttcatcactcagttattctggtgacgaaactcagctattctctgctcgtgcctcagttcttgtgggccaactcagttattctactccaatccctcagttattccgttataatacctcagttattctaaaccctcagttattatgttataacaccgcagttattccatgttcctaactcggttattctaatgtcggtactcagttattctaatgcgcgccttgagttattccatgttcatcactcagttattcgagtgacagaactcagttattctactccaatccctcagttatcccgtgtcatacctcagttattgtaatgtgcctactcagttattatatgttcatgactcagttattccgttccaacaactcagttcttctaatggacgcactcagttattctggtgccagaactcagtaattccgttccaatacctcacttattcttgtgggctaactcagttattatggtgtgcagactcagttattctggtgtcggcactcagttgttcggttctgatccctcagttattctctgttccttacttagttattgtgcgttcattactcagttattctaatcgacgcactcagttattcgggtgacagaactcagttattctactccaatccctcagttatcctgtatcatacctcagttattgtaatgtgcccactcagttatgcggtgtttattactcagttattctctattcacagtcagttattgcgttcaagtaactcagttatgctattgttcattactcagttattttgttgtgcacactccgttattccatgttcactactcagttattatctgttcattacttagttattccgttccaacaactcagttcttctaatggacgcactcagttattatggtgacagaactcagttattccatgttcgtcactcagttattcttttgtcggaactcagttattctaatgggcgcacatagttattctggtgtgatgactcagttattctcatgtgcctactcacttatttcacaggtgcataagttcatctacaactattctaagttgactgttcggaataccgtagattattccaaacaggagaagctttttttaaaaaaacatctacgcgcggaccgtccgggccttgtggcggaccatccatgacaccagggtgtgcctcggacaggaacactgcaaaatcacacgttaacacta

SEQ ID NO: 421 - DNA, 2538 bp, Zea mays
attatattaacaatgaaaagttcaaatacatacaccatcaagacatatttcataaagactaatgacactaatttgatgttttagatgttggctcgttattccataagacttggtcaaagttggagacatttgatttatgagttaggacaaaagctaaattggcctataattcaaaatggaggtactacacagcaattcaaccttgtttttatctaagaaacagcacaaagatgcaaggttaacatacctgggataatgtctggtacttggcaaagaaggacctgtgagatttttctgaataaccactacttgagaaaccatgaacatccaagaaccttttgtatagcttcctctgcagctgtgagagctttacagtaataacaaaaaccttctttggtggtagatcattcttcacaacgttcatgctctttcgctggacaaaacctttcagttgttcaaacaagatgtgtgatcgttggttcatgatcttcacatcatctgatgttgaattcgtgtgttgcccattttcaatggggttctggaacctgataaagcagaactcattatttcaactttaaacaaaactatgatgcacaaatggcagcgttcacctacctgtttcggaattcatgagtactcccaagaaaaccttccctgacaaaatcaaccatctgctcacaagattgaaaaaatatatatgttggcaaactactagtaataaacatcaaggtaatttcattaactgggtgattaagcaatcaaaacagtagggatccacagctccttacacaataatattccatcagattattctgcaatggagatccagttaacgcaattcttctttgtgttcttacttgtttcagagcctgtgtaatgtcagcccttctattttttatcatatgcgcttcatcacatacaagaatatctggcccacactgacagtacaatgaactatgtcaaaaacccacagctaacatgtaccaaagttaggagaaagcatatgccatgtccacatgcccacattaccatgaaaagataatactattgaaacatcagtacatataatactattgaaacctcagtacatagtcacaagaaattatctaatgagattactataagagattgaaacaatatcaatagcagggacatagaacgtcacctgcaaagcataagtaatttcgtttgcagaatttttgtccttcacatgctttccaagggataaatttctaaatgatgaataaccaatgagaagcactccacccttcactcgccatttagttagtaaatctggccttttcaccctgcaaagaaaagatcagatggagcatttcatcctagtcctagtaggtacagatttactatagggaaacaatactccatgtaattaaaggaaaaaataccaagacaccataagtaaataattcaaccatgcaatgcaatgaaaaaaacatccctaaacaatgcaacatagagaaggccaataaaccaatgaggtgaaagtaaggcttgccccataatcaagcagatatttgttgaaacatttgatctagtgagattgttagaggggatcacactaaaaaataagaaactgtaacaaaaaggacaatagagtaaaaggacaattaagcgaactttggaagctttcatctttgagtagtgctgaccccagattcgagaaaaacaatcagaatgacctagattctgggaatgccactattgaattcatgcatcaaaggaaccaaatgtgtgcattatgtatataatttataatatatatgtagctccaacattaagtttccaatgtaccaataagtgttaaaacacatgggcctaatcaaggaatttgaaataactagaatataagccattttgtcaggtaaaactacagcaggatgcctgcgaccattacagcattgaagcgtctttcatagaatgtttgtagttgagttgcaacctcccatcccgacccacctgtagctgttttgacaatgtgttgtttaggacttgcagtgttttatcttctttcctaactctgtaaacctttcataaacatatgtaccacatatgcacatatgttgtcttggggaaggtgcaggaaattctttaaaatttggcttcttaaggaaaatacatggaaaaaggaaaattaataggctagtagttaaagtttcatctagcagaccgcaccatctccaattcaagtattcaacatacacttataaagatggattttgaatatatgtgcatatattcacaaggaatctgttatggtcgctagatcggtgagggattggagagaggtatcgatgggtaggaacgtcggccgggggcctctgcccacggccgagcaagaggagtgtttctcccttctaattcttgcctactttatttctcatccattgattacataaataggccagttggccgcccctatctagctaaagatccttatctccttaaaactctcctaaaaactctcgacaactactaactgataaccttcctagataacctcaactaatctcctagata

SEQ ID NO: 422 - DNA, 2534 bp, Zea mays
tactggtctggtaatgcgtgcatcacaaatacaacaaatcaagcgctctctataggcaggtttatatttcgatgtttggactagagtttcaaaaagtcgtgaccgaattgactagagttccaaaaattaggttgatgttccataataaaagaacattacaaatgccactacataccatctaagataattgtccaaacaagtaaaatttacaaacaagaaataaaaatgtgtaataaaaattgaaatcataattttccttccatttagtgtttaccaagaaatgttattggtaaaattgtgacaaaaaactaatgaaaaatcattaataacgggtaacaatcaaagatagataataaaaatataacttattcataaaaaattaatgatatgaaaattgacgattaaagccaccttatttttcatatgaaatttttttaatatttacaaagaaatgttatttgaataactgtgacaaaaaacaaatgaaaaactattaatttttgctaatgatcaaagtcagatactagaaatataacttgtgccttcagaaattaataatcaaagtcacctcattattcatatgaaatattctagtgatagtacatgacaatccaattctacgggtcacatactcattttattattgttttgaacttgtgttaatgatgaagcatgcaaaacaacaagttagatcgatttgtaaaaactatcggtgtaaacaatacatcatttagtgcttcaaaatgatttaaagttaggatatgtctaaaatctttatattctgcaacaaacttgaaaacaattaatattcattagtcccataattttttatgctttgtataaaacgtacattaaataaacaatatttaatcttatgattatgtttgtttaaagtggattaaaagcttacttttttataataaataaacatttcaaatactagtatatacattccgacataacagaactaaacaagcatgatttacaatctgataataaacaaaatttaatgaaaattgggatcaaattttactttatgttaatatttttcgataaatattattggtatagttttgacaaaacattaaaaaaactattaatgttaaataaagatcttattaataaagtcgaaatataaatcgcaccgttagaaaattactgatctagtaaaatccaaaagttggctttaaaaaattttaaattaactcgttcttcatgatcattcagttataaaatatgggattctatttgtttatattattgactttgtcttcaacatttatattacttatgttagccttagtatacatccatttcaattttagatcttccttcaacatttttgttgcttatgctagacttaatataaatcaatttcatttttattttttgtttagcactatttcaacattttttgcccaatatgtgtgtggtggaagtttgttatgttgtatatcatggcaactggtcgggtgacacctcttatatagttacacgtgagcatgggtgaaagacacatgtccccattctagagatgtctccacaaatatctatagagttccacattgcaacaaatattaggctttatagtttgtcaagattgttgtagaagattatagaaggttgcatttaccatggttagccatggttgtttatagaaggttcaagaatgttgcatgtaattgctcgaatcaactatttaataaattaattggcataacaatcattataagaaaataattaaatcttatggactctatgaatgataatgtttaatcctcatcttgatcattttgctcatcaaaatgtttctttcgattaccttggcatttgtaggaaaccttggttccacatccatcacttttgcaatttatattccaatattaatggtacaactcaaaccttcatatatatacttcttaaaatacgagatgacccctttaatctattcaagtgaagcatttatggacataatctgatatagcaatttttactaactatatttatcgaaaataaattttttggtccacctgatggtttgggccctaggtagtcgcccctctcgtctaggtctagagtcggtcctatgttaaaaagttctttatggcaataaaaaggcatcatggttcatcacgattgttggtctccacaatatctaggtgacttcttcatggcaaaaatatctaggcttcatggtttgtcatgattgctatagaaaattatagaagggtacatagatcatggttagccacagttgtttgtagaaggttctagaaagtttcatgtatcatggttagccatgattgtttgtagaaggttctagaaggttgcatattggtcacctatcaaagctcctatgagaaaccataacacgacaacacaattaaattaaaaacactttctccccttgtccactcatgaaaaaagtgggaaacatgggaagaaggttacagaagtacgaatgtcgagagaggcaaaatgtgtaagtggaagagtcatgaaccatgttcaccatctgttatactaccttgatg

SEQ ID NO: 423 - DNA, 2533 bp, Zea mays
tgctccatttcttttcattcgaacgaaggagcacctgcagcatgcagcccgaccttcttctacctctagccttcccctgtagagctccttggaacatggaattttccacctctgctgcacctcccctgggctacgcacttggcctcacctccccgccatctccctcaaccagcagccaccatcttcctgtatttccaagccgtggagcccaggatgccgaccagggacaccagcaaccggcgtccccagctcgagcaggtgctctccccatggtgacccctctcctccccacatagtcggcgcaggcaccttctcccatggcgctcagccccgtgctccctgcgtgggtctccagccggctcccccctgcgagctccctgccccacgcgccctcagccatggcgcgggaccttctctggtccgagctcaagcagtgcctggactgcgctcgccgatgtcctcctcacgtgctcctccactggtctgtgcccccgcacttgcagcagcggccatggatcccctctgcgtcgcgccctcggcgtgctcgacgtaatgccgcagcaagcagcagcagcgacgccctccgctgcgtcgctctcgccaggtcggtcctcacgccgtcgatctacgcagcgcttgcgcgttgtcgtcgagatccttggtgagcccctcgctagtatcccattgttttttggatctcaagtgcttgataaaaatgtttgaaccactaggtgttattaatcgcagcaagatgttgccgctgcgcctcgcgcaacacatgattcggtgaagcacctaaaccgtggacgcatgcgtaactccactcgggttttggccaagttgtttgctttagagaaaattgtgattttgttttatttacgattcagtcgatggcgtgaatatgtgtgtgaaaatatatttagggccaattccctgtatgccactggaaaatatactcgttccttgtatgccactggccccacatgtcatagacacaaaaaaatatacctatatgccactcagtggcacacaaggaatgagtataaaatcggatggcataccaggaatttttccatatatttatatgaatgaaagcgtgtagagaagaaaatgaagtagaaaagaactcgtatgtttttatgttttcggtaggaatgtattggatgtgtggtttgatgtgaggattaatcttaaaatgcaggttatgttgtggggaatgcatcgataggtgtttacatgaaaagtgtatttgttttatacatgtgatcggtgattgtggtagtcgatgcgattgaggagtatgttggtcctgttggagtcacttgtgctgttgatgtcatgtgcataatgtggggacacgtatgtgtgtgcgtgccgaagtatcataatagtggttgcgtagagttgtctgaagtatttttcggatgcatgctgaaatgcggttgcattcgaaatagggaaggaggtgtgttgtgtgatgagaaggctagattgattttataggttgtatgaaaaacagtctcttaagtgtatacgtcgagtgtgttaattggatcctacatatgcagagtgtagtgtattggttagacgaagagttttggaatagacgagtatgaggcgtgcagttaagccgagattgaagtgcaaatcctatgcaatatgatgggattcgtgattatataggggttatatttgttgatgtgacgagtagtttagaaaatgctagtttgcgtgggggatgtattgttaaggcatgagtgtcggagttcatatattagtggttacgctacgatgatcgaagtgtctcgagtgcacgccacaacatggttgtatgcgagacagggtaaaataaggtgtgctcgacatgaatgttcggtcgttgtaggtagaaattgtcttggcttaattagagaggtggtgacatgccaaagtagtcatcgcttgctctatgtttataagtcgatacaatgcgtattatgcgttcgtaaaattatgcttcacatatagtgtatgattgtgctcacgatttcgagtagacacttcaagtaaatcaagtaggttcgtgatacaagtagtgtaatggagttagtttgctttagaataattattgaaatgttttgatcatatgataaacatgtacgtgttcatgatttgggaagtaagcgcatggtggttgcgagttggagattagtggtttacgattcgtatgatttggtcggtgtgcaaaaatacttgtgaatatgtgtgtttataaaaatgttttagtgtatgttgtgtctcggattgcgataataataggcaagccgacgtgtatgttatttagcgggctatgtcattactctagttagccgaattgttagatggatgtggttaagctcgtggtcacgatgattttcttgttgtagcctaaatacatatggttatggtcgcgaaagaaaagtattagtgcttatgtgaggtctaagttaaaatgcaaattattgtgtgaacaacacttcgatatcaattattggggagaatgcgttgttaatta

SEQ ID NO: 424 - DNA, 2529 bp, Zea mays
tcccccataccaatatctgtattacatctaatatctttggattgacaatgcgtcttttgatcttcagaataagcatccttatttgaaaaaccaccaatgttcttctcacccacactgctattcacactggcagatgatgggctcgcaactgatgtaccagaaagcgagacccactttgaccaatcataacgccttctaatcttgtcatcctgtcagtagaccagcagaggataaggtaaaaccaaatacctaaacagaacatggaatttgaacaatgactattgaaataacattgcaacctgaacttctagaagacttgagcttgtcagtgcatccaatatcaggtgtatatctgcggtcattttcttaagctgcaaataaaaaaatgagttgtttcctagcacaagggcaaaataatagaaatttaatattaagcaatctggaaagaaaacatactctattgaaatctgcaagttttgaaactggaacccaaccatgctcatccattaaagatttcaggaaatcatcacgctccagatttgcatcactgaaaaacatgattgcatgaacaaaggattgcatgccacacttgctaaaagaacatttaatcgctcctgatgttatcgaaacatatgagattttatcagattgtaggctgtattggtatttgtgtgcatgttgcaccatgacattacaaccttgaagtgtgatacaacatcaaactgaactttttaacatcatgtttctgacaatagacaaaaatccaattaaaataaactatttggcaccactacccagcacccaataaaaataaatgagaatctatcaacatattgttacaaatccacgcatctatgtttataggtatcatcacgctttgttatgactccaaaggaagataataagaatttacctgaagtagtactccacttgagttagtatattagatcttaactcagcagcttctggggataaaacaggattaggagctggttgattttgaatgtagtgtgatggacttctcatcgaatccataggcacagtgggcatgtaataatacatgggagggataggccctgagtttaaagcatttatcaatatttgaaaactaaaaagaaatctgaactgcaaacatgtcataaatggtgagcatagcattaccaggatatggtggtccattgatgtatccaagaggcaccattggtcttacaaaagctcttggcccaagaccttgtggtagatttgtgttttctctagtaccaaacatctgaggattttgccaagcctgtccataatggccatggccttcaggagaaggatggggcctagtgccatgagtgccaacaggaggccgccaaagatgaggacctcctcttggatgtggaggcgttggcctgttactttcatgggcaccaacttgatctactggaacaaaaggaggcacggaattctcaaaaccagactttccaacatgccggtcatgattcgggactgggataggaaatggctggtaagaatattcttgtagtatcattggactgggaaccacggggtaaaaaatgggttgccctggatgttggggataatgcattggtggagggtaaggtggtgcaccattagcagcaggaaaacgtcgcctgggcccatttctatgatgggcttggtgatttctgttgggatttccatttccatggccatcaaacttgtgcatacgactagccacctgacaatgtttgcccatttttatcaaactgaagcaaataatgtagtaaatggaaaatgcacataggatctaacctaggaagagtgactctaatcgtatatgcatcagttgatcagtaacggaatgctataatgtctttccaaaaaaccaaagaagcaccacattttttattgagatacaaaagatgcaatgaagcaaaacaaaaccaaaatagattgaaatgtttacatagtagagaaagggggatgggaatggcaagacctgccacaatgcctatcagacttcagaatggtgttgtgtcaaaagtgttatacagaatacagggtaaaagtccagcacattcagagcgagatttggactggccatcctcgaaatgaagcatgccacgcaaaagaatactacctaactgcaaagatgatgcttcagcagttcagctaggcgacaaatttgagttaccatcatgacaagtgtaacatgcttcaaacgtagcgcaacctggtcagctggaacccaacatctaccatgaaagcactggacaaaaagctggagctactataaaatagctatctgttactactcgccaacgaatcgacacacacctacattcaaccaggcagcacaaaaaaagtactgtaataactacccatatccacggaagtgatcaacagctagcatttgcatcaaaagtaccttacaaatgagctacacgaaaatagacacagtcacacagacccagtgaacaataaaacttacatatgtgagcagattagaaccaggcacagatcatacctgcgatggagccgacg

SEQ ID NO: 425 - DNA, 2529 bp, Zea mays
cgacaacttgtccacaagccggcgctggagcaaaatgacttctataaccaagctaagcagggtttctaataaaaccaccagcaacaagcttcacgttaccgaaaccactagcagggtttgattatttttttctctcaaaaccaagcagggtttggaatggtctgtgtaagcatgataagttgataggaaatgctgcgacggagattcagacacaaggtactgctcgtaacgaaattcttacctttctgaagaatgaatactccagacggatccaacccatccatatctccttcttggtcagtccagcacttgaaccttttcaagctcccaaaaaagtctatcagatgctcgaaaaaatttacagcgaccaatagggtataaacaaccataatgagtgggtagattttgttgaaggttctcccgaagaaaggcacgacgtcatcaatgtttcccattctctacatattagtataagaggtgatcagtcaagcagtcaacaactgggacatatcttgtaattgttaagattaaaaatgaaagaaaataacattctgcacttgcaatgaaaaaacgtgtcctctaaacattctttttagagaacttctatcttctgttggtatctttacggttgacctactgacttggagtaagggctgtattttaagtatttccttatacacaattaaggagatgaacttaattattttagagcactgattatatgaaagagcataaattttaataggggcctgtatttggcatgaaaactgtaaacttgcaatcaattagtgttttcctacttctctttcctggtgtgcacaaagatcatggtatttttttcctaaatatcaaaaaaaaatcatcattttccccctgagcaacccaacatcgattatgaaagtttgagatcaagaatgactactcaaatatcacatattgattttattcattgccaataatgtagtgaaaaaagtacaagcaaggaacatgcaaagaataccttttcaaaagtagttttagcattaccaccaaggtgaatgagattcaggaagttgtaagaaataggtggtgcatatcttgcaaccattctgcagtgaaacgtttgatgtaaaaattggattagaatgcaggaaggtgcctttaacgattaatgccattcaaagtatcaaaagatggaattctggatcgcttacgagcagatcataagcaagctgactgaactagtttgtcctggggtcaacgaatataacagcatcatccctatcctaatcagtgaatagtatgtgcagatgcacatatacatcaagggaacaaacgcagcaacctgttaataggcaagtctaatcagcaaaaggaataaggttaaacttattgttttggaaaaaattctttaatgaaattataccaagcagaaagaacaacagtatttataaaataaaaagaatggcaaggaaccacaatgtttgatcctctaccaaaaaaaacagattttgatgacccaccaggattttttttcacatgtgaaagcacaacagttgtgtatatcacgattgacgaataaaattgagaaacaaaggattaacaaaatctcatgcaaaagttatgtttatagaaacgtgtgtgggtgaaagtgagttccatgtgtatattttactccaaactaaaagccaatgataacaaggaaagctgcagcaactgagtggcaaatttcttacctggactaaaacttcttgctttcctgcatttataagattggagaaaagtgacagatcaacatcacttggcagcaaagtggcctcagccaacagtatggaagccgagacacatccaaggataacagcaagtactctcataaattgctttctcagtaaacagcgccaaatgaactctgaaaatgtcaatgtgcctttgaatcagtaccatgaattattgaaaattcagggtggtttgctcagaaccctatatgcattggatatgatacatgagtgttgtgtataacgtatcttcagcataaggtttactgtaaaattaggagtcatgaactaatctgaaattattgactatcagtacaacttgtagattcttgcaagacaccttcagctgttacgttatattgatagacacataagtttttattggagaaaattacctatagagtcaagaaaagaacccagtgtgcctgatcgactttccctgaaacttgacagatatttcctgtaaaagttaataatgaaatatccatgagatgcttgaaacagacctctcagaatatttcttctgacgataataagttgttaaccagcttgcaagacttggtgactgagacagttcggacaaaacataatgcacatatgctctcaccacaacagcagacatgccctttatcttttttcgaaagaatgtttaagaaacataaaaattggttatgctactaatgctagtttatactttgtattcatcaattatctgtcgattaaattaaacctaaaatcattatttcttctaacaacaaaaatgacaaataacccc

SEQ ID NO: 426 - DNA, 2528 bp, Zea mays
agttaataatggttgtagagaaataattgacatctcataccaagataaatcaaccacactttgagagaaaaaatgcctagcaacaaatagtggacgggcactcgctgtcgtccaaacagtaatagttctatcttgacttccaatagcaataacattatatggttgctgctcttttgttggtgtctttgatgctccattggcccatccaactggtgcagcctttgggtcttggtcatttgagaaattcttacggaacgttgagttattaaacttaactaccacaataggcgcattatgccctagaaagtcaaaagttgcagcccactcgcctctttcaagcacaggtgctgaatgcctaggtttctggaaaccatgagtggtagttatgaagtggccacaaggtgaccaagcaagtcgtctaaaaaatgttgaaccaagctgcaggaacaaacaaaatgagaaaggcattcagtaagacaggttgatcacagctagatctaacagagaaataaaaaaatacgacatacagattttgtccaatggccttctgtcttgtgagcaagactccagtcacttgtacgccatatcataacagtcttatcatctgattggcttgcaataaaggaaccaatagggtcccaggtaacccctttcactaagctggtgtgccctcgcaagacagcagtgcaaatgccgttgttcatgttccatatgtgaatggtattatccaagctaccgctggccaacgttgaatcatcaggggaccaactaagatctacctaccttatgcacaagaaatggaaaaggtgttctatagttacaaaataattatcacaaacataaacacagcacagtggaattttagaagataattaccacatcggcagtatgccctctcaaggtcataatgaccttccagttctctgcatctggtggttctccactaccaaactcagatgtacctgagccagcttttctctcgtgaattaggataacctgatcatctgatcctgaagcaaggtagcggccatgcttggcccatctcacacagttcactgatccaaaatgatcacgcagtgtagcaagcaacctttgcttcgaatcattgttggtattgtccttatgcacagattccatactccatattcgaacctatttcaacaacgaagcaaataaatggaacttagtaaggagaaagtcacctatgaaagaacaaaatggaaaatatcaaacagtggtaatacatcagtattacataaacaacagtttgccaacacatatgactcaaggggataagaaattgcaacaaacttaatgttaaattttcaattatcgctaacaacacagttaccatcttcctcggtatagatataatgcaacatgctagctaaaacagaatgaaaacaaaacaaataactctaaggtatcttattgtgctattcaaatttgagaccagaaacaatgattgcacaacaagtccctgttaaaagacaggttatctcactgatgcagaggttatctcagatattcccaatagccaatttcacgtaaatttatattacccggaaccaaacaagctggacccaagaacatagacaaatcctcactaaagcacaaaaagttaccaacaccgcagttagcgcaatgaacacacaacaaatgtcatgttattagcactgaaaaaaaatgtaagggcatgtttggatgttgtagttttgagggatcttggtatgaagaaattgttgttctagaaccaagagaagtgcaacaccacaatttaaataaatgtgctctagagtgcagtttcgaaaactcccaaatgactaaaattttagtaacacaatggttttaggatctaccaggtttgttacacccgaacacattatttccaaaaccaaattatcacacaagatccaaaaagggctaaagcatgaaaccataagccaaatatatagttttttgagtaaagtgcatttccggtcccttaacttgcgccggtgtgtcagcccggtccataaagttttaaaatgtgtctcttaaagtcttaatcgctgttcgggtctctgttaggtccaaaacggttcgaaacaaatccggtagcaggtttttcagtcttcttccttggcctacctgtcatttccttcttcctccgtccggtagtgtgcgctcggggccactcgtatattcattcagcacatattaaggtcgtcctcaattctagtcttggtctgcaggcccatttcctcttggttccttagcttctcttctatcgtggccagagacacaacagctcgctggtactgcagactaaccgtccggctgcaggcgcaggcatagcggagcatctgctgctccacctggggcaagtgagcctatggagctggtcacgttctggtggctgctgggtggcccgccggaccatcccatctgactgcgaatccagcgccttcttctgcaaccgtttcggcgcctgcaggagcgacggcacaggtggacgggtggttgctgtcatggaccttcggtccatg

SEQ ID NO: 427 - DNA, 2524 bp, Zea mays
  misc_feature (2458)..(2461): n is a, c, g, or t
gtcatcgacaagattgaacgctacaaagtgagtctggttgatgggagttgtaacagaaccatcagtgaccagtggaggctgaggtgtgccactacgggtaccagtagcctattattcgtggtaactctacggttcaaggggaaaggtgaggggaggggtcgacgacgacaacgcgaaggagccggtgaccacggcggcacaagtgatggggagacatggtgttactatttgtgtgactggtgagggtgaaatgatggtctaaataacattggctattggatttgagtaagtaagagagaggaagattatctaacgatctgaaccgttggtcttgagagtatcgctcgatggatttagagagggttatggatgtaggagtgatttggtcatatggattttataagaatttgagagtgttgtttgatggatttaggaaatgttatgggtgtaggagtgatttgacaggatgggttttattataaagttaaagctggtgggttatacaaggagtatagtcgtatagacttggtgagactctgtctcctgcttgcttttctgtttgagttctgatgggcctcggcctcttttaatattcagagacctggtttgaagcaagatactactgattttgcctggtgggccggacgggcggtggacggtctccatttgccaagctgcttgtacagttgtactcgcagaacttgcttcatgaccatgagcacaagctagcaacatgcaacattgcagttgcagatatatagtacatatttttttttggaaagggcggttgcaggttgtagctactgagataaaggatttttttataatgaccgctattagcaaaaacagttgaccgaacgaagtggtcgacgtccccttccggtcgacaacatttctgaagcatgcatgaatctgcttgttaaattattgggtgcgaccaagtagctcgtgtgtacatgcgcgtttacgggtatatgtaaggtgcatgcgtttctttgtccttttgacacagtccttagttctgcgccgaaacttttacgctatcatcactgtcatggtctctataagaagtcataaaaatagataaagctactatacaatcaagttttccgtatagtatagtcacgccgtatataattaaactatcagaaattataaaaaagaactcaaaaaacccatagatatgcagtattattcactctatttttctttaatatatgttttgatttacgatgaattagaatctaaaaaagacatggttattttacgaagcatgattggatccggacccccatgcattcacattcacttacgcgccgatgtggcatcatccgatcatcggtggcggcggcgatcaggtctggagctcggagtcggacgcggtcctggtcgtcccaactccaactccatgcagcgcttacgtgaaaggcgaagccgacaagaaagagacgagagctcgaatcaccgggctccacctccatgacacgtgagcagctgaaccggtccggtcccgcccggtcccggccccagcagcttcgccacccacccaccacgacaccacacctcagtcctcctcacacaaaaacgccaaacattttaaagcccccgcctccttccccgcggaaccaattcatcccccctcttctgtccagtccattcccccattctcttctcttcacgattccgcgggcgcggaagcccgaagcggcggagagatgtgggtgttctacatgatatcgctgccgctgacggtggggatggtggcggcgacgctgcgctacttcgcgggccccgccgtgccggcccacgtcctcgccgtcgtcggctacgcatggctctcctccctctccttcgttgtcctcgtccctactgacatctggacggtgcgcctccctcccgccgtgctgctagagtgcagagtgtgctaatgctgtgcctgtgcgtcgccgcgacctctccgccgctccgcttagtgcgcgcgctatcactattcactaattaacagagatcatttgcgcgtacagccgggttaccagtaaactgtgctggttgcgttgcgcggtcgtgcgactgcgggagatgggagccgttttggttaggacactggtaatgtagcgtcagaatcggagtttggatgaaccatatccatttctgaacctgttgctagtttactaagaaatgatttaaactggattaacttatgaataatggtggttcgatagcgtacccagtagtctggtaggtaatagtctcgatgccaaggtactgaaggtaggaattcgtggaaactgtcacaatcaagaaagtgattggggttagatggcgatctgaaatcgtcaaattggcattgggctggttctatgactcgtcaacggagtttgttgttgaaatttaagcacaccatcaacatcgataaagcaagtaggtttgtgacttgaagtcgcggccgcactgaccnnnnagtgagtcgtattaatttaaatcataccaacatggtcaaataaaacgaaaggctcagtcgaaa

SEQ ID NO: 428 - DNA, 2519 bp, Zea mays
agcattcgaacatccaatatcttgggccccaaactcatgctataggttgtcctgcacttgggttgatgatgaagcatgtgaaataacttgttggatagctgacctctatagtaaattgttgatctaaaaaaatctacatgttgggcttcaagcgcttctaaagtcacctaattcttcatatgaccaaatctagtgctagcatgtgatagtctaattctatggatcacatactcatgttatggttgttttgaacataggttaatgatggagcatgcaaaacatcaagttgggtccatccgtaaaaactgtttgtctaaacaatacatcatttagggcttcaaaatgcatcaaagttgacgcacattacaaatcgatatatcatgcagcaaacttgtacgaaattaatacccattagtcccatactcatgttttgattggccttaaacttggattgatgttttcacaactgagaaatattgcaaatatcactattaacatgcctaaacaactatgtcttacactatgacatttagaaaagagtaatgaaagtggaaatagaaattttcttccattaactattctttaaaacactgaactttaatcggcatgtgaccatctaattatttggtttccatactcaagttattgattgtgttgaattttagttgatggtggagcgtgtgaaacaacatgttggatcattctgtaaatctaccacataatttagggctttgaaaagcttcaaagttttcgcatggttcatgccacaatcttttcgagaaaacatgcacgaaatcatgaccctttactcccaaatcagtgcattgcgaaaactttgatgacaaatcttgttgggacatttttgtaaaaactaccgttctaaacattacatcatttagggctttgaacggcttcaaacttacattaatgtccataaccatgaaacatttgaaatctttcaacatatcttatgagataacatgcccaaacaattaatgtttacagtttggaaatgaaaaaattgtaatgtaattttccttggttaaatagttttgtgataaatatcatgagtcccatacttgttttttgagtggcctcaaaatatgcgttgttgtccataaccaagaaccattaaaaatagtgctacatatggtttaagatagcatgcctaaactattattgtttatagtctagcatagagcaaattgtaattaaatttggaatgaaattttttctatacttaattcttttgttataaatatcattgatataactgtaatagaataataacaaagaatcttaaaacatggatcgaaataaaagcagaattgcataaatatagctctcaactccggaaaattaccgatctaaaaaatatacatgttgcactttaaacatttctaaagttacctcattcttcatatctacaaactatagtggcagcattcgaacatccaatatcttgggccccaaactcatgctataggttgtcttgcacttaggttgatgatgaagcatgtgaaacaacatgttgcatagctcatgcctgtagtaaattgatgatttgaaaaaaaaatctacatgttacggttagcatgcgacaatctactgctcaagcgcttttagagtcacctcatcctttatatgaccaaatctactgctagcatgcgacaatctagggtcgcatactcatgttacggttgtcttgaacatgggttaatgatggtgcatgcgaaacaacacgttgggtcaatctgtaaaaactgtctgtctaaacaatacaacatttagggcttcaaaatgcttcgaagttgacacacatcagaaatcgatatatcatgcagcaaacttgtacgaatataatacccatttgtcccatacacatgttttgatcggccttaaacttgggttgatgtgttcacaactgaggaacattgcaaatagcactatatatgtttttaaggtaacatgcttaaacaagtatgtcttatagtacgacatttagaaaagagtaatgaaagtataaatataaattttcttccattaactatttttccattaatagacaccgtaactctacaaaatagtttatcttgaaaaatctgcatattgcaattcaaatacttctaaagttacctcatcctttaaaacactaaaccttaatcggcatgcgaccatctaattatgtgggtcccatactgaagttattgagtgtgttgaattttagttgttggtggagcgtgtaagacaacatgttggatcattctgtaaatctaccaaataatttagggcttcaaaaagctacaaagttttcgtagggttcatgccacaatcttttcgaaaaaacatgcacaaaatcatgacactttactcccaatcagtgtattgcgaaaacattgatgacaaatcttgttgggtcatttttgtaaatactaccgttccaaacattacgtcattaagggctttgaactgctacgaacttacattaatgtccataacaatgaaacatttaaatcttt

SEQ ID NO: 429 - DNA, 2516 bp, Zea mays
ctgaaaacaacaattaataaatttcagctcctatataattcaagaattgccgcgttctagagacttgaattattttaacattttaccatctattagagttaaaacaatcaaattaggaccaacatgtagacttactaattttatacaagttattttgtgcgctagaattaacatacacaatcaacaacgtatttgccacaataatcaaacctggtacatatatgtttatcgatgcgcccttcatacactaatttgcattttaacttagacatcacatgagcactaatacttttcatccacgaccataaccatacgcatttagactacaataagaaaatcattgtgactacgagcttaatcaaagccatctaacaagttggttaactagagtaacgacatagcccgctatacaacatacacgtcggcttgtctattattatcgcaaactgagacacaacatacactacaacatttacaaacatacatattcacaagtattttcgcacaccgaccaatttatacgaatcttaaaccaccagtctacaattcgcaaacaccatgcatttacttccccaatcatgaacgcatacatgtttatcacacgagccaagtatttcaataattattctaaaacaactaactccattacacacttgtatcacaaacctacttgacttacttgaagtgtctactcaaattcgtgagcacaattatacgctatatgcgaagcataatttaacgaacgcataatacacatcattacgactcaacttataaatatagagaaagtgatgactactttggcatgtcaccacctatctatataagccaaaacaatttctactatcgactaagagttctaggtattaaacatattattactttccatgcacaaataaacttcaacttagcaccagtgacaccgatggattttcactaaacccatcatgcgcctaatcccgtctcgcatacaaccatattgtggcgtgcactcgagacactaccgattaacttaacgcaatcactactacaatgcacttcgatatacacattcggcattacagtgctccgacaaacccacacttccaatctacttgtcacataatttatttttttgacccactctaacctacaccacgatgaatacataaaatatatttaacatagactaactcattagccgttgtggaaattaccaagcatgctttacgctttattaaatttaccacaactaacacactactttacgacgaagtgttttaacaaacaattaatacttccgcgaaccaccctcgcgacacgtaaatgaaccatcgcagtcacacatattcaacgccaatatacaccatatctatatgcatgccatcaaccgaatcacattaatagtaaattataaatccatcaacctgtccactcggatttgagtcgcgcatgcgtccacggtttaggtgcttcaccgaatcatgcatcgcgcgaggcgtgacatcgacaagggctgcgagcaatgtcatagtttattacatgctttattggtgcggtcatttaatccaacacgaaaagcgcaggacagtggggtctcaccacgggtttcgatgatggcacgtagggactgcgtagatcgggtggatgcaagcgacatggaggggatccggggctgctgcaggcttgccggcgcaatggtggaggagctcgtgtgtgtctggcgtggctgagcgcgcgtgaggggggcggtgccccagcctgactcgcagggaatggagctcggcgccgcggctatgcagaccaagccgacgcagggcacgagggagctgcgacggccatggagacggaggtgcggccctgagctccgacgtgagctgggcatctccagcgcccatgggagtttctgcaagacaaaacaaggaaacaccaggagagctcggatttgaggggaacatggggaggggtcagattccaaccattggggtgtcaagcacccaagcaaggccaccaaacaccatggcttcaaggaaggagaggaggtcagacgctggacgagcagggcacgccatggagaagatgaaggcatgctggcgagctggagaattgcgagggcgtctaggcttgtgctcgcacggtcctggcattggagacgggaaagctcatcggcgtcctgcagaagacatcggccggcacagaggaagggagcttggtgaccggcctgaatctgagggagcttgtaggggaagccgacgggttcgaagcaccaggcgtcgagcacaccaggggaaaggagcaagacgattggcggccatgggaggagcttggttggggaggggtgccggacctggggcagaggaggttggcgttgagggagttgagggcagcggcggctagggggcttctgcgcgctgggggagaatggcagcgctccacggctggttttggggaaggagaggagcatctgctagttgatttaacagggcactgttgggaccccattagccaccgtgggcgacagccatctactggccggc

SEQ ID NO: 430 - DNA, 2514 bp, Zea mays
gtttagaataactgagttaggaacatggaataactgaggtattataacggaataactgagggattggagtagaactgagttggcccacaagaactgaggcatgagcagagaataactgagtgatgaacacagaataaccgagtactgaaccgagaataactgagaaatgaacgtggaataactaagtgcgtccactagaataactgagtcatgagcagagaataactgaggtattagaatggagtgctgacaccagaataactgagtccacacaatagaataactgagctactgaaagaaataactgagtacgtccattagaataactgagttgttggaatgaaataactgagtaatgaaaacacaacaactgagtaaataactgagtggcgaacatggaataactgagttaatagaacgcaataactgattgtgaatagagaataacggagtccccactactaagtgattacaaagagaataactgagtaatgagcagagaataagtgagtaggcacacgagaataactgattcatcacaccagaataactatgtgcgcccattagaataactgagttctgacaaaagaataactgagtcggcacatctcaataactgaggtattataacataataactgagggatcagaaccgaacaactgagtgccgacaccagaataactgagtctgtacacaataataactgagtgggcacattccaataactgaggcatcggaggagaataactgagttagcccacaagaataactaaggtattggaacggaataactgagttctgtcaccataataactgagtgcgtgcattagaagaactgagttgttggaacggaataactgagtaatgaacagataataactgagtagtgaacaatagaataactgagtgtgcacaacagaattactgagtaatgaacaatagcataactgagttacttgaacgcaataactgaatgtgaatagagaataactgagtaataaacaccgcataactaagtgggcacattacaataactgaggtatgatacacgataactgagggattggagtagaataactgagggatcagaaccgaacaactgagtgccgacaccagaataactgagtctgcacaccataatcactgagttagcccacaagaataactgaggtattggaacggaattactgagttctggcaccagaataactgagtgcgtccattagaagaactgagttgttggaacggaataactgagtcatgaacatataataactgagtaggcacattacaataactgaggtatgacacaggataactgagggattggagtagaataactgagttctgttactcaaataactgagtgtgtcgtctagaataactgagtaatgaacgcacaataattgagtaacgtacagagaataactgagtgttgaacatggaataactgagggcgcgcattagaataactaagtaccgacattagaataactgaggtaggaacatggaataactgcgatattataacataataactgagggtttagaataactgagttaggaacatggaataactgaggtattataacggaataactgagggattggagtagaactgagttggcccacaagaactgaggcatgagcagagaataactgagttccgtcactagaataactgagtgatgaacacagaataaccgagtactgaaccaagaataactgagaaatgaacatggaataactgagtgccgactccagaataactgagtgtcgactccagaataactgagacatgaacatggaataactgagtgcgcccactagaataactgagtcatgagtagagaataactgaggtattagaacggagtgctgacaccagaataactgagtccgcacaatagaataactgagctactgaaagaaataactgagtactgaacatgtaataactgagtgcgcacattacaataactgaggtattagtccagaataactgagtacgtccattagaataactgagttgttggaatgaaataactgagtaatgaaaacacaataactgagtggcgaacatggaataactgagttaatagaacgcaataactaactatgaatagagaataactgagtaatgagcagagaataagtgagtaggcacacgagaataactgagtcatcacaccagaataactatgtgcgcccattagaataactgagttccgacaaaagaataactgagtgacgaacatggaataactgagtcggcacatcgcaataactgaggtattataacataataactgagggatcggaactgaacaactgagtgctgacaccagaataactgagtctgcagacaataataactgagtgggcacattccaataactgaggtatgatgataactgagggatcggaggagaataattgagttagcccacaagaataactaaggtattggaacagaataactgagttctgtcgccataataactgagtgcatc

SEQ ID NO: 431 - DNA, 2513 bp, Zea mays
caccatgcttcttcattcacttctgggcagtgtacaatataaaaaagtgcatgttttgatggcacaaagaaggcatataaaaagttcaaacatttcatagttgaaatcggcagtcaaggatgtaggacgacaaccaccaacaactgttgtttcgcgggaccactccctccaaattcttctaagttcaactctgaatgcgagtagaacaaggggaacactgacaataaggaaaccaccatgaacttagatcacgaggttaaaaagcttgcatgtatgcatttgttaattgcttaatttagcagtaataatatggattaaattagtaatttctatgtggaattatatgcaacaggaatgcacaactacttttgttttttcaaaactcactatgatgcagttgctacatcaaatatagtccacacacctaaccctatgaaatgggttactagtctggctccagaaccaaaagacgtattgttccaatctttggctatccaacaagtggcgtaaatcaacactagtttcaggctgcattatttttgcattctcacttttgacctggatggtgtgtatacaagcactatatgacccatatcagctgcaacagttggttcctccttcctgaaaagaaaggttggtgaagtaagtactgatacttcagttgggctatctcgatagatgtctgatcttatgtcgctacatgtatataattctttaggtaaattaattttagaaattcataatggttcctaggctcctattgcgggatggctccgccacttcttacaagatggagtccagcgggcttgtgacctctgtgggcatcaacattggtatatgtgtcctcttcttgatgctctactctgttttgagaaatcaacacgccaatgtcaagatttacttcggacgcagaattgttgagcaatacagtcgactccgagggggttgtaactttgaaaggtttgttccatcgactagctgggtagtgaaagccctgcagtgtactgaggaagagctcttatttgctgctaggttggatgcagttgtttttgatcgaattatagtacttaggtacagtacacaaaacttccttttcacctccttgtcccctttttcatcaagcattcatactagttcatatgtccaaccccagcaaccaaattggcagagactgaaacacatatattaatttatatattcaaccgcatacacatcttctccattgctacacttctggctctcttgggaagtattccagtcaattattattttggaaagaatactcaacatgtttcaattccttcggaacgaatggatgcatttacagtatcgaatgtgaaacaggaatcaaaaaggtaagccgagcaaagtttctctctctcttttaatttattatcaaatgttgaaatcttgtgttttgaattatatatatatatatgtgtgttttgatagttatcaacatcttacaagtgttttctaccttgattaattcatccaccatgcttcttcattcacttcttgataagttgaagaagaatgagcactgtagaatataacaaagtgtatgttttgatgattccttgcatgcaacctcttgatccattgtgcggtgcaatacataatttctggaataacatgcttaattctgtacattgtaaatttgtttcgcatttgaattgctgaaaggctccatctccttgtagttggaatgttttttgctgatctgtttttccctacaatgcaggaggtgaagcacattgccacgttgacgtcccttcatctcaaaagggcaacgcaaaatccaagcctatttgcactccttgttcatgaaataccaaagacaacttaagaatcatatagtgatgttgttggaaattttttcacaaagtatcacttgtctagttatctcttccatcaaattgtctacaaagttgggcttgtccacaagataatggtatctagctagtactcaatgcatgcatttctcttttactaacgaagaacatttactattatatattctaagggtaagggaagtataaataaaacttcttcatcttataattagctaggtttctcataattttttttgtctttttgacatgaacaagtgaacaaatgaccagttccttcagtgttgaatggtttttctttccttattcgtgtttgtaattcacctcttggtttttgtgtctttaacttaactcatagactagcacatagaagacacataagaacttcaaatatttcgtagctgaaatcagtagtcagggatataggacgacaaccaccaacagttgttgtttcgcgggaccaccctctccaaattcttccaagttcaactctgaatgcaagcaaaacaaggggaaccctgacaatgaagaatccaccctgaacttagatcgcgaggttaaaattcttgcgtgcatgcttttgttaattgcttaatttagcagtaataatatggattaaattagtaatttcctgtctcttatacacatctgacgctgccg

SEQ ID NO: 432 - DNA, 2513 bp, Zea mays
agcacggaatatcgacaataataaccgtctctatgttttaatattcacctatcaaaattttgatatcactttcgtctctgtctatccggcctgttctaacagctttgcaaggttagaacatatttgttccggagattcgcaagtcttgtgattatttaaaattcattaattgtgcaaacacgaatttagaaacttagttcagtcctccgattttgtcccaaacaagatttattagaagttgacgactaaagcttttgggtttaaaattaatcgattaaggcgaattggaaacgtcacctaattatttcgctcttattcgagcgatctctacgaactctgtagcgataatattaagcttgtactgtttagaataaatcaaacttgaactaaatgaaactagaacaacggttagccgattcgcttttctatttaaaaatccaataaaataatctattaatcgatagcgctttaaattggcccgtttactcctcgttttaaatctaaatcccaatattcagaaccgatgacgtttatctgttttaaactagatttgatatagtttgaaatatccaagccgatctcgtttagtttggtccatatgtttctcgtcgagatttagatcttcagaataaataactagtcaaggtcatcgaactctgagagtattcatcgaaccaaatcttgtctacatattatgtcagatattattttcggtcaatttcttgttgtcccttttaaacctttatcccagataagatgtcagctccttgaaaaaaacaaaacaaacgttcatgagagctcgcaattggtgagaacatttgtgaaatatctccttccagagaatgcctcacgtcacgtattctgaaaccagccgttcctatctccaacgctagtgacttctataccgtacgcctgggagcaatttgtgatgtcttcttcaagctttggtcgccggtcagcacatgctctcagctgttcctcaccctctgtttgctgtctccagcgccccagtccgagctctctctctgttggccgtcgctgctccctggtgctcggatctcgcccttgcgtcaacgccggtgagctcgccttcgagctccacccatggccaccttctccagctcgctctggacgtgcagctcccttcgtcgcgccctagctgcatccagcccttggccctggttgccatcgccgagtccgaccccaagccgtcggagctgcagccatggttttcaatgctcggttttggccgcctcctctacctccgacccgcggcgccgtggtggctcgccccagccctatagccatcaatcgtcgtcttcagccccagctccaccaagccgcgccgttcctcccttgttcgtgccggcagctaccgtctcggaccaccgtcaatccggccgtcgcagcttctccgtcgtggctgctcttgacttcgtccatgccgtccgttgtcatcgacatgggggcactacccacagcaagccaccccgctggtgctatgctgtcttgcgtctcctcgtcggactatgtcatcgccctccccaacattggcaccacgtgtccctcgtcttggtgttcgtcgccatcgactcagctcagtccgtcgatcgcgctcggcatcctcgacctcaagtcttgctaagtcatcaggttcatcgctagtgacttgctgttatcgctttactcgatttcttactcggtgtcaatatcctgtgattaattatgtgcatatatgtattttatggacgggagaaatcctggatgtttgggagaagtcgaaggtgcaggcgtgcctgcggggtgtctgatattatgcgcggaccgggtagcgtcgtcactttcgcagcttcaagtaggattttagtatgtcgagctgatttgttattcctgttagtcgaagaattgttagatagagtgaataaatatgtgtggtgcgaaataaaattaaaatagttctttgtgagtgagctggtataattaataatgcgagggttaagtttagcatttaattagccaataatttctgtttaggctaattgtgttaagtgtgttattttgcctatccatatgttacttttaggagtcgataatggtgaatttagtttgctattcctgttaattaacttaattcgtggatttaatataatattgatgagacataaaataagtttagtgtttttatcagcttgccgatagattatatcagtgatgttgtgccgaattttggttatgggatggagtcgatacctttctctactagtcattatcatcgatatcttgtgaccggttaaatgccttgagtaggtattatcttctgccccaataattaaaggagaatagcatcagaaaatcgatttcagtcaaaatccgaggaacattgtttggtccgccttaaaaactagttagtggacattgtactttagtgttttaaatctttaggacttaaatggtttacaaagttgattaacatgttcctatccttattctgaattattggtatttaaaaatag

SEQ ID NO: 433 - DNA, 2509 bp, Zea mays
tcggcagcgtcagatgtgtataagagacaggttattgtaatgtgcctactcagttattatatgttcatgactcagttattccgttccaacaactccgttcttctaatggacgcactcagttattctggtgccagaactcagtaattccgttccaatacctcagttattcttgtgggcggtgtgcagactcagttattctggtgtcggcactcagttgttcggttctgatccctcagttattctactccaatccctcagttatcctgtatcatacctcagttattgtaatgtacgcactcagttatgcggtgtttattactcagttattctctattcacagtcagttattgcgttcaagtaactcagttatgctattgttcattactcagttattctgttgtgcacactcagttattccatgttcactactcagttattatctgttcattacttagttattccgttccaacaactcagttcttctaatggacgcactcagttattatggtgacagaactcagttattccatgttcgtcactcagttattcttttgtcggaactcagttattctaatgggcgcacatagttattctggtgtgataactcagttattctcgtgtgcctactcacttattctctgctcattactcagttattctctttgtaatcactcggtagtggggactccgtattctctattcacagtcagttattgcgttctattaactcagttattccatgttcgccactcagttatttactcagttattgtgttttcattactcagttatttcattccaacaactcagttattctaatggacgtactcagttattctggactaatacctcagttattcttatgggccaactcagtcattctactacgatctcttagttattccgttataatacctcagttattgtaatgtgcgcactcagttattacatgttcagtactcagttatttctttcagtagctcagttattctattgtgcggactcggttattctggtgtcagcactccgtcctaatacctcagttattctctgctcatgactcagttattctagtgggcgcactcagttattccatgttcatgtctcagttattctggagtcagcacgcagttattctagtgggtgcacttagttattccatgttcatttctcagttattctcggttcagtactcggttattctgtgttcatcactcagttattctggtgacgaaactcagctattctctgctcgtgcctcagttcttgtgggccaactcagttattctactccaatccctcagttattctgttataatacctcagttattctaaaccctcagttattatgttataataccgcagttattccatgttcctaactcagttattctatgtcggtactcagttattctaatgcgcgccttgagttattccatgttcatcactcagttattcgagtgacagaactcagttattctactttgatccctcagttatcccgtgtcatacctcagttattgtaatgtgcctactcagttattatatgttcatgactcagttattccattccaacaactcagttcttctaatggacgcacttagttattctggtgccagaactcagtaattccgttccaatacctcacttattcttgtgggctaactcagttattatggtgtgcagactcagttattctggtgtcggcactcagttgttcggttctgatccctcagttattctctgttccttacttagttattgtgcgttcattactcagttattctaatcgacgcactcagttattcgggtgacagaactcagttattctactccaatccctcagttatcctgtatcatacctcagttattgtaatgtgcccactcagttatgcggtgtttattactccgttattctctattcacattcagttattacgttcaagtaactcagttatgttattgctcattactcagttattctgttgtgcacactcagttattctattgttcactactcagttattatctgttcattagtcagttattccgttccaacaactcagttcttctaatgcacgcactcagttattatggtgacagaactcagttattccgttccaataccttagttgttcttgtgggctaactcagttattctcctccgatccctcagttatcatcatacctcagttattggaatgtgcccactcagttattattgtgtgcagactcagttattctggtgtcggcactcagttgttcggttctgatcccttagttattatgttataataccttagttattgcgatgtgccgactcagttattccatgttcgtcacttagttattcttttgtcggaactcagttattctaatgggcgcacataattattctggtgtgatgactcagttattctctactcattactcagttattccgtagtcataactgaattattcagttattctctttgtaatcactcggtagtggggactccgttattc

SEQ ID NO: 434 - DNA, 2508 bp, Zea mays
aaaaaataaactattttttagaaaaatataaatcctttaaaaaatagagttatcaaactagctctaaatgaattgttcatcttattttattagcttaaacttttgagttagattaattgatgatgcataccacttaatataatataaaagctagagattacgagttcgaatcctagctagcgcaattaaataaaatgattattgttggctcctatttcacgtctgtgacccaatagaagctcgatgtgaaagtgagtgttggaatataatataattgaattgtccacattttcctatcaacttaaccttttgagttgaattggttagtgcatgcaacttaataaacaaaaaaatgatataccacactgtttcgttattaacaaaagttttaattagttacaacgggatgtgctcccgtcagttccgtggtccacgtctagaaaacttcaccaagtacttcaatgccattgctaccagctcgggaacttgtgtgtgtgctcttctgctctctcgagtgtgactgttttgtccctataccgtcccaactttaacatttgcgtcttatcccgttacaataccaacgaacttcgtacttgctgctgcatacacattagggcgtgtttgatccaaaaataccatggtacaaaaccatgatattcgaaacaaagttttatactatgtaaccaaacacatttttggcaaaaatacaatggcattctcagtaccatgattttaatttaaaaattcaaaaatactttgttttccaaacatccccttagggcttgtcaccaaatcaagccttaatggcaaactggaccactggggtgctgtcaaagcaaacatgtacgtacgtgtaggtgtatgtcctttttttttgttattcattcacacaaagagcatgtttgattgtacgcctaagatgtcacatctaaggttagcaccttgccacatggtctaaggttagtcccattttttatctccacacttaaggttaggcatgcctataaatatgtggtagttgtttggattgctaccacaaggttaggcacacctatgaacatatagtagttgttaagtttatcgactaacataattgatgccacacttttcaatgataattttgcaaactttgttctaagatttagtcgtgtttttttattttcctattagtaagccatgtgatttgaaaatatatgaatgtgatattttttatttaactgtctcataagaaataattatttagaacaaaaccgatattatgagttggtaaccaactcatataacaatacatatctcataattctataattccatgatttgcaacgagatgtttgatcaaggtgatcaatcaatcacattaaaatggacaactgcagtcaaacaactaaattcaaccaataactatattgtcaacatgaacccttaacaaaacaaacatgttgtaggtaccagaaagaaataatagaactagtagcaacagagacaacatcacataacataatgaatatgagggtaccaaaataacatatttatatataaagcgcataacatgttcaatcatccataacaaccccatcataactccacaattcttataaacacctttaaaaattcacattatccaaaaaagtatctaaatataaataaaaagagtgatgtaatagctaacagaatcatcatccatctccataaactgtcatgcatcaatatataaaaatgcaaaataaccaacatcacatcattcatctcctgcttgtatcaacctattacaattgtaggatatcttaaaatattgtgaacataaacaacataattctattgacattaagtataacaaaaatatatagtcaattcacaggtccaaatcaatcaaatgcttcaatacacaagactcaaatgttatgtcagatgcaacagataaaaaatctcgcatacccttttaatatttttatggtagatatgtttatactatcaaattttgataagtaataattgtaatattctcaagcctttgccacaccatagcatcggagttaacaaaaggtataaacattgtaggtggtagattctgaatatcattccaaagttctaccaaagtagcactaagttcatctactatatttattgtacgactctttggtttcacttttctcttgactggtacaccatctcctcgtctacgctttaatacagaactcgatgaactgtgatcaacaccttgaggtgggtgatgatttggggatggtaacgtgtcagattcattacctaaatcattcacaggctatgaatacttaagaaatcattgcaaaaattatcattgatgtaactctcatcttcaatctgagtttcattcatgcagagtgtaccattcatggctagagagccatcagcaccgtcgtcaatgaacaactcctacataacatttaaaaactagatagacttataaaattgttccacaattgttaattcagtggtctgattggcctactgtaaagcccaaaatctatg

SEQ ID NO: 435 - DNA, 2507 bp, Zea mays
cagaatcatgtactcctatatattcttcttagaggctcaatgcaatacatcccacacattatatgcattctctccttcctttcatggtatcacgagtttaggttttagatccaacaggtgtcttctgctgccaccgccgcgccacccttggggagatcgtcctctgtcaggggcaacgccctcgtaggatgcgcgaccggtcccgctgatctgttgtgcccatcgtcgtcatcgcgtcaagtcgaagtaacggcagatcgaaaaactcaccgtcagtgctccttggatcgcccctcgtcgacctgcactggctagatccggcacctccacacgccgtcatggtgacggttgtggccgggtcgaatccacccgccggctgggtcgtgcgccgccatggtggcagctccgactctcactgccagctgcgccggagccgcacgccaggcttgcacgctgacacgggagccgcgtgcctgcgccggggacgttgtgcccacgccgtggctgcaacctcacttggccgcgccatgctgtggccacgcccgcttgctgccggggctagggctgtcgcgcccgagctgagccgccagggttgcgccaacgagccgggtccgtgtggttgcgccgttgggccgcgcgcccgcaggggacgcgcttaggtaccgccagtgaattcccagatctgttgttgttgtgtctttttttgttttcctagtcattgatcgggtttgcgtctccatcgcccactgccagtcgactcgcgcaccctcgacatcggcttcaacaacaccgacttcttcatcttcttcgatggtgcaactgacatggcatgcagcgtaatcggaacgcctgcctgtgtcgcgcctctttgtctgcacgtccatctatgccggttcatcgtcgccaccaccgatcgggaggctccaccatcgacatcaccatcatcgtttccgactcgcacgccatcggcctgatcaaccgatcgcgggcgaaccatcctcccgagatgtttgtcgtccatcgcgcgatgcttcgccaagcaagaaggtcgtcgatgcgtcgcctcctcgaaaacaccatcgccgtctgtcgtcaaccaacaccattgcatctacatcgctgtcgacttcgtcggcgcgtctcacgcgaatgaacaagctgttcgacacatttgagttgcgccgacacaaccgttgtatgcgttgagggtcctcctacatgctatgtcaacaccttgcgctggtgttgcgcctatcctaggcgtgccagccaccgtcgccgatctgcaccgcatttttcatcgagtttttccccgacaaacactgccatcgtgctccactggcaccattgaggctcgtttcctatgcgtcgtggctctcgctgctgtgactctaggaacctcgatgtgtcgccacgcctatctcttctactttgtgtcaccacgcctatctcttcgcttcgtccagcacaacctcgttgccagcatcatcatcttgtcctcaactaattcgtgtactccgctttgacaaccatgcgttgggccggcactcccgtcgtgctgcatcacaaccatcgcgaaggccttctctgctggtcccttgagatgcaggcacatatggttggggccctctacctagtacattcagtactggcaccaccggcacgtgcattcatccacgacacgtttctaggcttggcaaacctggaacatgcatcgtccatggttgcttgacgcgtcgcccccagcatcgacaacctcatctacctcgacgcattgtgccttcgtctacggctgcttcacagcaccaccgtcaccacgacgtcctctggcgcgatttggaccttcccgcgtgccgcaccaacgcccgcgacttatgcggcatgtcttctatgacgtcctcgacagcttcctcgaccacagctaccctacgcacggcacttcgacaacggctccgcgtcctcttcttggctatctcaacattatcggcacacagggctatcatctgcatgggctactctagtcacagcattcgcaccgcattccgactgtggggggtaatctccattattcttcagtttgtccgttcgtgttgctaacgctatgactatgggggtatatccccattattcttcagtctgtctgttcatgttgctaacactacgactgcggggatgttagtatattaggcatgttagagtatattaggcaactcctgatatggttggtttaggattgatagtaatctcgggataccttatatctaggataacattccttatccctaggataggcttcttaccctccaagtcatgtactcctatatattctccctagaggctcaatgcaatacatcccacacattatacacattctctccttccttcaaaatattcagtaaggaaacacatattataccttgcatataacaaggcagaatcgtcatgcccagttgcagtgcgtcaaggaaaaaaaactactaaactgcacagtgttattaaaactacgt

SEQ ID NO: 436 - DNA, 2506 bp, Zea mays
tctagaaaagtatacatgatggctttatacatttataaatttacctcattcctctagaccattcaattgtactagtcacatactatggattttgaacatacgttgataatggagcgcgtgaaacaacatgttggatacttgtgtaaaaacaacaattcaaaacattatgtcaattagggcttcaaaccgcttcaaacttcaattgatgtccataaccatgaaacatttgaaaaaacaatacatatcttatgttataactagcacaaacaagtaatgtttacaatttggcaacgagagcaaattgtaatgtaatttttctttgttttattgttttatgataaatattattagtcccatactcgtttttgagtggcctcaagcttgcattgatgtccataaacaaggaacatttgaagcaacactacataccttctaagatgaggtgcccaaactagtgtttttatagtctatcaacgtgcaaattgtaatgaaagttggaatgaagtttttctatatttaattctttgtgataaatattattggtatatctatagtagaatagtaatgattgtcttgaagttgggttaatgagggagcatgcgaaataacaagttggttctatatgtaaaaactttctatctaaacaatacaacatttacgccttcaaaatgcttcaaagttgacgcacatgagaaattgatatattatgtagcaaacatatacgaagttaatacccattagtcccatactcatgtttttgagtggcctcaaacttgggttaatgtgttcataagtgaggaacatggaaaatattattacgtacatttcaaataataagcctaaacaagtatggtttacagaacgacaatcagaaaagagtcttgaaagatggaatataaatttcctttaattaattatttttccttaaatatagcccgtaactctacaaaatagtttaccccaaaaaaatctgagtattgtgattcaaatggtttttcaatttacctaattctttatatcactgaacattaatgacagcatgcatctaattctgtgggtctcatactaaagtattgattgtgttgaactttggttgatgtcggaacatgtgaaataacatgttggatcattatataaaaactgccgattaaaaatatatatatttggggcttcgaaacaatttaaagttgtcgtgcttcatgcctcaatgttttggagaaagcatgcaagaaatcaagaccctttactcccatacaattttttgagtggcttcaaacataggttgatgtttccattatcaagaaacattacaaaatctactacgtaccttctgaattaatgggtctaaactagcatggtttaaacatccaatatgttgggccccaaactcatgctataggttgtcttgaacttgggttgacgatgaagtatatgaaacaaaagttggatagagttgggtctatctataaaaactgtctatctaaacaatacaacatttgtggcattaaaatgtttcaaagttgatgcacatcagaaatcgatatattgtgctgcaaaattgcacaaaattaatacccaatagtctcgtactcatgttttgagcggcctcaaacttggattgttgtgtacatatacaaggaacattacaaatagcactatatatgtcttgtacttacgtggataaccgagcgtgtgaaaaaacatgttcgatcccttttgtaaaaactaccgttataaacattacatcacttagggcttcgaacctcttcaaacttacattgatgttcataaccaagaaacatttgaaaaaaaacactacatatctaatgatataacaatcccaaacatgtattgtttacagtttagcaatgagcaaattgtaatgtaattttcctttgcttaaatattttgtgataaatatcatgagtcccatactcgtttttgaagtgacctcaaaacatgcattgttgtccataaccaacaaataacaaaaaaaacactatatatttttctagatagcatgcctaaatcggtattgtttatattcttgcaatgagcaaattgtaattaaaattggaatgatttttttctttatttaattcttttgttataaatatcattgatataaccataatagaatagtaaaaaataaacttaaaacatggatggaaataaaagtcgaatatcataaatatatatatgttgccctttaaacatttctatgtatgttgcccactaaacatttctaaacatctcaacttctgaaaaattatgaatctaaataatatatatgttgccctctaaacatttctaaagttagattgttctgcatgtccaaactcaagtgcgagcattcatacatctaatatgttgggcgccgaactcatgctatagattgtcttcgacttgggttgatgatgaagcatatgaaacaaatgttagatacagttgggtctatctgtaaaaactgtgtatctaaacaatacaacatttagggcttcaaaat

SEQ ID NO: 437 - DNA, 2400 bp, Zea mays
aagccaatcccaaagtttggtgaggacgaaaagataaaagcaagaagcgaccttaaaaacaaatgcgacgacaagggaatgcgacgtatgtatgagatggctaggatggataattacgaccgtttacagacatacgttgttcctaggtggattcttgagaattttgcttccactagtgctgaagaatttgatgattgggctgtccagtgtttcttcatcatcgtttgtagcagctttctttttccaaccagcagctactatcctcttggttcagattacctcatttgcaaggacttgaacgctttaagtgaatttgattggtgtcaagctgtggttaatgacataaaggacaagtctgccatatggaggaagaatcatagaaagaacaagaccccagtcatccaaggctgcactgctctcttgatggtaagaaatgaattttatttactgttcacttcttttttatattttcttaattgttttgtcaatatatattttgattttcacatatattattatgctgttttcagctctactatcttgacaacttggattgcccaggcgttgaacattatactgttacacctcgatggtcacagtactctaatgatcgtattggaaaaataatggatgctgaccgattgacgtcgagagatggcagtgtgtcctatggaaagttgaatgtaagtaataaatttctttcttctgtggttattctgtttttatagtctgttttgttgctaagttattacgtttgttcactcggttattctgtcccttagttagtatgtttgttcactcagttattatataccatgcccactgtcattcccttatttggatcatccctcccccttgctcgcgcagccgccaccgatccctccccctcttctccccgcgttaacacgagctatatgcaagtggttaaatgtagtgcagtgtccattcagtcattgtgtctcttttggcatgatgagatcgattttttggtttttttttatcttggtcactaaattgtttccatgttttagttgttgagcagggatcgtactgtttattccaacatacgggctgacgacgagccacagactagaggacaaaatgtgcagcagcccgctccttctgatgttgtacgggccaggtcaaaaagtgctggatctgaaagtattcaatttggcctcgttcagttggagccgttgttggcgcagtctattgcttcttatgttgttgatagtacccagaaggatgctgtgaaggatgcactgagagaatatgattgcagcgtggaaagagcgtcttgcgagatttcagagggtcagcgtaggtttgctgatgctgagcgcgctattgagaatgcaaagagacaaatccagagagggcagctggatttgcaaaaggcgcagaagaaaatgttggatgaggtgaatgcaattatgaaatttaatgatgagacacaacctcctgcatcctctccatgcgaagaacatgcaaaacggtgttcttctgtgagtttgctggcctcattcattcccttaattttgttgtcatttatttatttattaatgcctttgtcattgttgcaccagataactgcctctaggctgcatgaaaacaacagaaagcgcaaaaaggtgattattgctgaagggcgagatactgctcaagtggaggatacccgccatacaccttcaccttctcctgctcggtcaccgggccgtgattctgacacagctcatgttgtgcgtgatatagaaactgtcagccattcaatctactttgttatgtcacagccacttaatactctggtgtgctgtcagttattgttgttctgccttttgatatataatttttcagaggcaagattcatctcctccagcacagtcgccggatcgtgatgctaacgccgctcgtggcaggggcgattcatcagaacaacctgtcagtcattctgctttactatgtctctgtcatttttatgctagtctttattcttctgccttctgttttatatttttcagatgcaaggtgatcaaaatgttcagcatgatgccggtatcactggagatacagttgctgatactgtaagcaattcttgtctgtgcccccacctcactagagatacctttcattctgttttcactagttcaatgacaatgatgatcagaatcctgagaaggaacctattcatttagttgctcatgcactttttttgaattcactttgttctgttcattcggtttattgcagaatcctgagaaggaacctatgcaaaaaaaacccgtcgaattgtgatgagacacactccccctggacgtcctgtcactcggttccactgtgacaagcagtgttaaaattctgcgtgatattgactcagcgggaagctgtggactgagaagagct

SEQ ID NO: 438 - DNA, 2501 bp, Zea mays
  misc_feature (2445)..(2445): n is a, c, g, or t
gtctattcattaaaacaaaataataatagtagcgaattagctcacccatgattaaattcgacgcgatctctgcaagaaccgcgatgatttatagttcaggcttttcgtcgagtacttgggggcatcgacttggggcttgtttctccacgttctcttgggatccttttgtcggcgcgaacacaagtcggagatgtcatgtagggactgacattgagacaagacgacggaaaaatgacgaactagcgagctgaaccacgatgatgtcttgacgcggatgagcaatggcaactggcgaacacggaacggcggagtgaggtgcacgaccggctagcaaagatgaatgtgtgcggcaaggaagcgaaagcagaacttgatggccggcttggagactcggtgagacgataacatcatggcgacgcgcagccaaggcgcgtggggctcgcagggccagatcttggcgaggacgagcacacacgacgtgacgacgaacgagatgagcaatggaaactggcggacacggacggcggagtgaggtgcaccgccggctagcaaagatgaatgtgtgcggcacggaagcgaaaggagaacttgatggccggcttggagactcggcgagacggtaacatcacggcgatgtgcagccaaggcgcatggggctcgcaggtccagatcttggcgaggacgagcacacacgacgcgacgacgaacgacggcaacgccacaacggcttcacggacatggcgaggacgcagggcacgacaactatgtcgatcgggatttatgagattggtgacgaagcttagcgtcagacagctcacaatcaacacacagtgagcaacaaggagattgagcagtggggcgagctcgacggccacgggcgagcgcagaggcgagcgagagagctcagcgcgcaggaagtcatgcgcgcagcaggggcgagctcggggagcaggagcgccgcgcaggagagcggccccgggcgctgcgagcagaggaagaagcacgggggagagacctcggcagggcgcggcgagcagcaggcgcgcgcagggagatgggcagggacggcgcggaaggatgcgcgcgcagaggaaaggacgagagcgctgggagaagggagttcgcgacgcgagcagggaagtcggcgcgcaggggagaacggcggccgagcaggagctggggcttcaccggcgagctcgcgagcacaaagaagcaaggcgcgcgacgggcgaagccgagcaggtagatgggaggacgccgagctggatgagatccgagcaggaagatggggccggtagagggagccaccatgggcgaactggactgcagggaagaagctagggcgggcgaccagtgaggcttgagtgcggaggcttcaggccgcgcgccaggaaagcagctggaggaagaagaaggagaggagggagagaagcagagaggagcgtgccatgggagccgctcggcgagcgcaggggcgcggcactggagaagggagcgagcagggaggaagacacggccgagtgagcggagaggataagcgcgcgtaggggaaaaaatcaggacgcgggcggctgaaaaaatctgtagagaggcggctgccggctggaaccaaaaaaatctacggagagagagatctgtgaggatattttccatttttttaatttcttttttttttacaaaaatcacagatatttttgaatcgagatttttagcgatataaaatgggtcgaagcgctacaaggctgcacattttattctacgaattatgaaacagaaactcagagcaataacaacttagacggttctgtccaaatctcggttggttaattttcgtgattattccggccacgatgtaaacagacaagattgaaacgagttcggcttcggtattttaatctgctctgtgtgattcgaccgaaattagccgaaaccagatccgttaatgtatacgcaatttcgtcgtcaaaatagcgtgctgaaggataaattggatcacatcctcgcacacgatttcacaaatacgacgcgcgatcctaattatgttgcactgagtattttaaatcgtcgaattataattaatttatttgggacacggatcgcaacggtggatcgagcttccaaattcgtattcgcgcgagcgatgaattttaaataatcaccggacgcactgattttcgaaacaactatgttctgaacatcacgaaaatttaggaagagcctagataaataaaaacgatgtcgaactcgtgacagacgaaacagattaagacagagagacttgttattaagtttcgtctattttttacgatcctcatcagtgattgatcatttgatctgacaccaacgatcacatgctgagaggaacgattcacttaatcagctggcacatcgttctgttcggacagtgcgggctccaaattgttcataaaatcagaagtcttctgnttttcgtattcacttacgcgcgtgattcgaacagttcaaaattcgccagcgacgaa

SEQ ID NO: 439 - DNA, 2520 bp, Zea mays
gaataacggagtccccactatcgagtgattacaaagagaataactgaataattcagttatgactgcgaaataactgagtaatgagcagagaataactgagtcatcacaccagaataactatatgcgcccattagaataactgagttccgacaaaagaataattgagtgacgaacatggaataactgagtcggcacatcgcaataactgaggtattataacataataactgagggatcagaaccgaacaactgagtgccgacaccagaataactgagtctgcacacaataataactgagtgggcacattccaataactgaggtatgatgataactgagggatcggaggagaataactgagttagcccacaagaataactaaggtattggaacggaataactgagttctgtcaccataataactgagtgcgtccattagaagaactgagttgttggaacggaataactgagtaatgaacagataataactgagtagtgaacatggaataactgagtgtgcacaacagaataactgagtaatgaacaatagcataactgagttacttgaacgcaataactgactgtgaatagagaataactgagtaataaacaccgcataactgagtgggcacattacaataactgaggtatgatacaggataactgagggattggagtagaataactgagggatcagaaccgaacaactgagtgccgacaccagaataactgagtctgcacaccataatcactgagttagcccacaagaataactgaggtattggaacggaattactgagttctggcaccagaataactgagtgcgtccattagaagaactgagttgttggaacggaataactgagtcatgaacatataataactgagtaggcacattacaataactgaggtatgacacgggataactgagggattggagtagaataactgagttctgtcacttgaataactgagtgatgaacatggaataactgcggtattataacataataactgagggtttagaataactgaggtattataacggaataactgagggattggagtagaataactgagttggcccacaagaactgaggcacgagcagagaatagctgagtttcgtcaccagaatagctgagtgatgaacacagaataaccgagtactgaaccgagaataactgagaaatgaacatggaataactaagtgcgcccactagaataaatgagtgctgactccagaataactgagtcggaacagtagaataactgaggtattagaacggaataactgagtaattagtagaataactgagttattagaacagaataactgagtgtgcacattagaataactgaggtagtagaacgtaataactgagttctgtcaccagaataacttagtactgacaccagaataactgagttattagaatggaataactgagtaatgagtagagaataactgagtgtgcacattagaataactgaggtagtagaacgtaataactgagttctgtcaccagaataactgagtactgacacaagaataactgagtcgccacactagaataactgagttactggaacagaataattgacttgtgaacagagaataaccgagtgggtacgttacaataactgagttattataacggaataattgagggattggagtagaataactgagtcacgagaagaaaataaatgagtcggcccacaagaataactgaggtattagaatggaataactgagttctgacaccagactaactgagtgcgtccattagaacgtagtagcacggaggaagtaaccatcagcatattggtcactagcaccccaagcccttctcagcataaaaagaacaaagtataaataactgacatggctacaaaagagaaataggcagaaaacaaaataagggcttactgctaaggctgcatgaacacgactacaccttcactccaaattcaatagctgcatcataccttccaaagagtccttaagttcttgttccttattttgtaatgcatcaatctccttcgtcagttcatccactctgtctcgcaagtcccccaacaaattcatgatatattgaggaaaaaccggatgatgccattgaaagaaatcgcatctctatgggtcagactaatcacatctctctaggtcccgaccctagttccatatagacaggaatatcacaaacctaaatagtgctacacgatagcgaattaaacacctatagtaagacatcggaaatctagtacgaaaatactagatatcgatatcacattaaaactatagctatggcattctaacttaatcagatttaattctaacagcactcaacagtaaattatgtataagcattttactctcctaaaacctacctctcgatattcaaacttgggataagcatagaaattgtttaattaactttttaaactaattctctaggttaacttgtttagcacaataattaacatggcatcacatcattcgctttagcaagcagaacct

SEQ ID NO: 440 - DNA, 2500 bp, Zea mays
tccccactagtgtatgtggtggctcttgaaatggcaccaattgaggaaaaaatcttcgtaagagtgtcgtagcaccgcgaagcaatagaggagttctcttgaagctgatttaaggttctcgatagctttggattttctatatacttatcagcattaccctttttctcagcatcgaggttggcctgaagctctttcataaactcgtcatgttttttaacatcaaaacatcagcatcatatatcttcctcgcttcgacaatttccttttcaacgttttctaccttctccttcaaaagtgccatctttgcgtctttctcctcaaaactcttacgaagtttgatagcttcatctttaagagaggagaattcttttacctcctttttttgcattctcaacaatttactcagcattagcccctacataaaaatgacgatgacgaatgatttaatcaaaacatggaagaattccgaagctgcatcaaaattaaaaaatcttcgtaccttgatactagtacaagtcaagctatgggataatatcttcttcttcacctggcacaacttctcctcgatgtccagaaagctgatgctttggattacatttcaaacaatcttcgactcatcgggatctagtatacacatcaacatttgttcttctccaccgagtagtaaagccttgggccgtaccccaaggcttcgcctttctctctaagttttgaaacttcttcttcactcagttcttcaccgctaatatgcctcgtgaagaagccaagttcctcatcttccccagtggtttgtgtagcttcggctacctcggcctcggccaaagtttcttgttgtttttgttccactttctcgcaccccaaagaatctccaccttcggcaccattgtttccaaatgatgaagagctaccgaaggcggcactgctgagtcccataatgcatggcttctccacctcttcatcagagtccttcgaagtcggtataaaccaaagtcaatgagggtcctaggggacttaaagaggaaaacagcagtggttgggtcattacctcaagaatccgagtgcagttcaatgatgaagttgtggttgtgctccccttcccctgttcttgaggagcaacaattttaatttgtagcacctcaaaatcttattctaggtgcttaataaaataaaacaaagagtttgaatcaaaataccttttaacaagagttttctcaccttttaagtcacatattcgaaaataaatatacttgtaataaaagattgaatgaaaagatcttctataagttaaattgctctctgaatcatatatttagatatattctctaattagggttaggttaaaccattttttagaaaatattatacaatagaaattatttcctcaaaacatatattttgagggtataaaatactcagaagaatttgtttaaatgaacaagataaggaataaataattcagataaaattttatgcttttgcaatcatgctgacattttgtttgtttgtgcatttaacttgtgtgtgaattccagaacaagatttaaaactaaaaattgaaaactgaaataagaaaaaagggagaaaggaaatttcctgcgcgttgggatggatttctggccgccaacccaacacaacccagcccccttccttggtcggatgggccaaagaatcccctactagcccatcagcttgccccttctctttttctctaggtcgttgatgtgtgggccctgctcgttggtcgggcagaccttgactccataggcccccgctccctatgacacttcttggtggggccttgtgggcagcctcatcaacccgcaggtgcgacctcttttcgtaactgcctagcaaccagattgtcgtggatcttgcaccgatcgactagatccctcatgggactttatataccgagccaatacacctcctctttcactcactatccccgagcgagggagccaagcatgccgccgagtccatgtgccaagatgaccgaacatgtagcatggagcaaggagagaagaagggaatcacaggcttgggcgtgcgctgtcagggagcacgacaaaggagtcgtgtgggatcggctcgctccaccccttgtgtgcctggccgggtgggtgctggggagtagtcggggcccagggattccacactagtctgtgggcatcgtcgtcggtactaccatgcattgtggaaccgctgtgtcacattgaccgagtcatctctgcccaaatctgaggtgagaaaccctccacaaggtcctccttgccatcctctgcacgacatcagttggggttgaatttgggtttcgggcgattgattttctaggccacggctatagcgccacagcaggatgtacctacaccgccggctagctatccccgaggaaggagaaaatatcatgaccgttggatcgttctcggatgctctagattagaagcggtaggtggccacccattctctagatctaggccgtcgatcaaatcacggggcatat

SEQ ID NO: 441 - DNA, 2499 bp, Zea mays
acatacatagaatatcattcctagttaaaccatccaccaattcactaacacgattaacaaatttacttaccctgactaatccgacgcgatagtcgcaagcatgacgacggttttcggttaacgtcatccaggggcctttttttcttcggtaatcaattgctgaagatctcctcgactgaataattttgacgaaccgaacttgagtcgcgcaggatgtccgagctttttgtcgcgcacttggtgaacaccacgctgctagcttcatcttcatccgacgcttgggatttcttgatgacgcgtggaacgacgacgagattgagtctgaagtgagctagcgaggacacgaatccagtgaggactctgaccacagcgagatcacgagctctaacgacacgaggttaaacggcgaacgcgttcggcggtctcacctgagccgaaccgaaggcgagaaactgatgaagcgaagttcgtcgataggcaccatggaggaatcagcgatgttgctgcacacacgacgacgaacgacgcggactgaggaaagactcgacgagcagtaacgcgaggagcaaagcgaggtcacggtcgggctcggacacaaacacacgtagcatttcatcgtgtccaacgcgcgcgtcacagactcaatgtcgactgcgagcagtttcgcgcgcatgacaacgctacggaggagaactaaacagggggcttcgcggcagcacgcgcaggaacaatggaacgctacgcgcgcgacgaggaagcagaaaaccacgacaagggagcgcggcgcgcagacagggcgatctagacgtgtggcaaggagactccagaagcaagcgccggcgagcgcaggggcgagctgaagcaggagcaccgattagaggaggaaaaagcacggcacgcagagacttcacgatgcggccaacagaggagcatcgagcgccatgggaggacgtcgagcacagcgcgcgcagacagagagcagaggagcacagcgcgcaggggagcaagcagcagagtcggctggggaaaatggaacttgggcgcagggaacagggaggtccgggcgccatggaggagagcgagcggcaggggagctcagcacggatcttggcaaggcacggccatggaagcagcgaccggcgcagagagcatgaggaacgcgcgacaggaagatggagcaggggaaacagtagctcggctgggcacaggcgcgcgcgtagggaagctccgagcagagaacggcagcacgcgtggggaaccgctcagctgtgcgcggtcagtgaggcgagtccgcagaaaatcccggcgccgagagcttggagacggactgggcagggaggaatcgccgagctgaagcgagcagagagagagagaagcagctgggcggctgtggcgcggccatggagatggggaaaatcacggcgcgcgcagagcagagatccggcagggagcgacggctgggaagcagggaagctcgcctgggagatacgcgcggctgggagcttctgccggcgagcagagggggcgcggccccaaggagctccgagcagggaggggcttcggctggagagaaatggaaggaggagaaaggaaaccgcgagccaggggagaggaaggcctggcgcggttggcctgggcactggggctggggcgcggtggagaagcagcagcatgcagagggaaagaagaagacgcgcgcgtgagggagataagaacgacgcgcaggatttattccggagcttgagcggcttcaggataggaacgtaggatatttttcctttttcagatttttaatttctttaccgaaaaatctcagatatttgtggatcgagatttttagcgacaacaaaaggatcaatgcactagatgacaattggctacacactttatttttcaaatcaagaaacggaaaatccgaggtatacgattctgactaaatctcgttcggatagctttcgtgactgtttcgggcaatacggaaacggactggatatcagatacattaatctgagacaatactggtttagtcgaattcggataaaaatttatccgatgcctaaacataattgattttattattttacagagtgtgccgaagaataaattggataataatttcgcgcacgatttttctcggacaacgtgcgatacacattatttcgctccgaacatttctgtcgtcgagtccaaattaatctgcccgggataaaaatctcaagagtcgatcgaggctccaaattcgtatttgcgcgagcgatgaattttaaataaccactgaacgcaccaattttcgaaatgactaagttccgaacaatacgaaaatttaggaggagcccggatagataaaaatgaaaacgatgtcgcactcgcgacaaatgaaacagatgcgatattaaaatcgcgataagcgaagatgtttaaaatttagcatccgttttatccactgatattacgtgcttaaatccgtactcattgtcgagcggaatataaacacctggg

SEQ ID NO: 442 - DNA, 2498 bp, Zea mays
ctgagcaaaacaagatgcctaatttgcagaaggaagaatctagtggtggaaagggtgcagcatctgccgcaggtggtgttcaggagagagtgaaagaccctaaggtgagagagccagtgtcagcgaaagaccctaaagtgatcttagaggttatacatatggtgttcaattagttatgtgtccatatatatatgtatatcttgcagacactgaggaggcttgcacagaatagagaggcagctaggaagagcaggcttaggaagaaggtgagccagtcaccatatgggactgtatattacatgcacaagcacagcatatataacagcatatatagagaaacgatacactgcacaattatgtacagtttttcaaagaaacaaacagtacatttatatggcatatatatatcctccccgccatataaatatatatatcccttattagctatattaatatattctttttatttattcagtacaccatttttaaacctactgctgttttcctaatcgattgaagtctcaagtagtgtcagcaggttggttaaatgaactttaatttgtgatgtaacagtcttttggttctgtccttttggccttacatacatgtgctttaggatacgcgtgtactttttcttcctttctcttgaatttgacaatgcacctaaagaataataatatcacttccaaaaggaactcatgcatgtatttttctgaccctcatgatttcatttctatatgtatagaccttaaagtttgagtgacatacgtaattatttgatatattcgttcgatcattaattgtttcatttctgaatctgggagatattatacaaaaaacagctttttacagctaatggcggagctaaatgaggctatatatagcgggctaccaaaactatgtagtctgagttagtagttcaaaagcttttctgtccttctaaaataatatcttcctttttggcactgaataagtatgctgaaaatgcctttagtctatacatatgtagccaacctttgaatgaatgttttgatcgagctgagtacacccacaaaacgtaccatatggattgatgcatccactcttgtcttactcttcaggcttatatccagcagttagagacaagtaggatcaggctcagccagcttgaacaacaagttcaagtggcaagagtacaggtaccaataattcttctaccagcagtatatatatcttggaagaggcagttatatatatggtttttgctacacacagtagactagtacttataattaaaatgtgactgctactatatataattaatgttcttcagggtgtcttcttgggcactggtgagcagccaggttttccttctgccccttcaccaggtagtagtaataataacgggacactccatttcatctctttgttttttccctaattaacatggatggctaattaacatggatcataataacgatgatcagctgcagtatttgacgtggagtatgggaggtgggttgaagagcacagcaagctgatgttccagctgagggccgcgttgagcgagcacctggcggacgaacagctgcagagcttggtgagcggtggcatggcgcagcacgaggagctgctgagcctgaaaggcgccatggccagggccgacgtcttccacatcttgtctgggctgtgggtatcccctgctgagcgttgcttcctttggttgggaggctttcgcccctcggaggttataaaggtatatacgaatagtttactaattaaatatataacaatacatctagctagctacctgtatattattaactaattggcatggtatagatatatagaaattattataatatgcatataaaggtatactattaattaattaccagtagtttactatgctatatgcatgcatgcctgtagaaattaaatatatataatacatctatatctagctagttggcgcctgcaaatgagaacgcccagaataatagagatcgtgcatgattgcatgtttgtttgattggttctcatgcatgtccgatccatttaatttgcacatccatatagtatcttcttgtacgctagtcattgtttatggaataagcagctaacccagtagtgtgcacaaccacacatacagagtattgtttagcactaaatcatccaatagagaccaactaatataataatgcgctagaatattagctatgtcttctctatacaaacctggtgataatattgaacactgtaccaattatacacacacacgtaggccgagaggccaagcacataccttgcatatatatgcatggtggtgggaaaagttaaaagttgaggagcaaagacaagacgggtttttggactcatgtattgctaagatgagcaatatcgatcatatcgggggagtaggttaccggatagggacaagagtgcaagatatgttactcactttgttttaaagtacatgatatttttatttacttttgaatctcgtttgactatttgtc

SEQ ID NO: 443 - DNA, 2497 bp, Zea mays
gacaacttgtccactgttcatgtcaattaaatattgcacaatcccaaggtagcagtcaatattataggacaagagagcaactcactctcaccacaaactatatccatcaattattttctatgttttagtaaacctagacacatatccacatgatttttttttggagaggaccatctcgatattatattaatgaattaatattatctgtgctggagaagtcttgaataatggaagaagtcgctttctgcagtaaaggtgaattaaaagagtaaaatgaaaagagacatggtgaagtctgtagctaaccatgattctttaaggccaaatacaccgacatagatgatttgggtgagcccgagagagaatataattgtgttgtgtgcaattggccaataaaaatcacctatgacatcccttatttgatacacgtacacatattacattagcatgtaaggtcaaatttagggcaagtaagaaaaaaaaaataaagtttctagcttctcatctgattatggtatacaacacgacccacttaaaagtacaccaggagaaaaggtaagatcatatgagtcaacacagagcatgtgaagcctagtagtccgaacaatagaacttttgacacttctttcgggtagagaaatgtgggaacagattatatattttctatccttaaaacatgtttccttataatgttacatatcatctgaaagggctgtaaaagtttagacaacaaactggcccacctcctcaaaacatgattctctatcttctctcctcaaaacatttttccttataaagttacgtatcatcaacaatgttctgaccttatgatgggctaacttgtcatctaaacttttgtatctttttagctgatttgtaactttataaagaaatatgtttcgagaacaagagaagacacaaaatcttttccctcgcttccctactagaaagaagtaccaaaatttatattgttcatactagtagggttcacatgctctgtgatggctcctctaatcttacctttttttcctagtgtaattttatgttggtcgtgttgtataccataatcagctgagaagctagaaattgtattttttcttactaaccccaaatttgtccatacatgctaatgtaatatatgttatttttagttgttcaatgtgtatcgaacaaggtatgacacatgtggtttgtattgacctattccacacaatacaatcatatttactctcgttgtcacctagatcctttatgctggtgtatttggctttatagaatcatgggtagctttagacttcaccatgcctcttatcatctttaatcttttatttcacctttactatagaaagcggtttcttccattattcaagacttttccataacatgtaatattagtttcttaatattgtggacatgttcctctaaaaaaaatcatgtggtgatgtgctttcgtttactagagcttagaaaaataattcatgggtagagtttgtcatgagcgtgagttgctctcttctcttgtggtattgagtgctacctagtgattgtgtatgatttagttgacattgatagggaagatgaacgattaggaagaatagataaaattcaccacaaacgctattctaattgccagttctctgatactaaagatgaccctttgaggaaattaaaactattggtgggtatgaggagaaatgttcttggtcgggtacgtccactagcaaagaaaaacacaacaatcccaaaatggacttgtctcacctgttaatcatctttatcatgttgtaaggtcgattatttgaaattcttctttattggaagatggccaaggcataaatgtggggaacagactcttcttcttggttgatttagagaggttaaattcttaagtatgatttggccacatggcaaacattagtcattcaccaacctcactttgttactacgctcatggaggacgtacgatacttatagcacctatatagaaacacataaatctacaagcaatcaacacaaatcaccttagccatcacaatagtcatagcatgcaaatcaccctatgcacttgaacaagaaagtgttgtctacttagtctaccaagcaataaaataatcattaaaaacacaataatcattagaggaatcaatagcccaagtagcatcacaatatgaataaagctgtgaagtgtagaatgatggaagaacaagcaacaagtgacatgacacagtcccataaagataatgcaagacatggagcatgtgttataatggagctgggaaggattccagcattaggcaaaaaagacaaagtggccgaagcagcaagagactcgtgattcgaaactgggcctaggagttcataatgacacaaagtataacaatttgatccgcaaagatgacctaggtgatgactaaataatatcgctatatattcagacaaaattagaaaaatacaaaatgaattcaatttgatccgcaaaatacaaaatatcgctata

SEQ ID NO: 444 - DNA, 2495 bp, Zea mays
catatgttaacttagatatttcaaggaagtgtttataaatatattactcatataaggatcttttatataccctcctataaaagaaaacatttatttaaaagaaatatgcctctttaataggatatgtaattaacataaattcctcatttttttttcttgactgactagggttttagaagctagattccaaggtttacaatacgcaaactaagcgtctcattttacgatcataaaatcaatagtaaaaatagtgatttggctcaccgttatcgacttgattcaatatttgcgagaacgacggcagtcttcgattgaagtcttcgatcaaacagctgatgagtatagaacggagctttactttctcttccatccgcaattcttggaatctctccatattaactagacctccgataaatggcgatgattcttgttctcgcctttcgccgagcacttggggcatcgaccaggggcttgtttctctacatcttcttgggatttttttgtcggcgcgaacacaagtcggagatgtcacgtagggactggcatcaagacgagacgacgaaacaacgacgagctagcaagctgagccacggcaagcaatgtcgacaacaagaccggggctgcacagatccggggctgctgcacgcacgacgcgacgacgaacgacgacaatcggcgaggtcgacgacgcgatggggattatggccgagtgagccgagagggcgcgctggcgagcagaaagccacgcaagcaccggacagggaggacgacgggctcgaccgcatccgcgaccgaagcgagcaccggagacgagcacgacggggcggctacctgagaacacggcgaagcgatgacaacagggatcgagctcgcgacagaaagatgaggacgcggcacggcaaactgaaacagggagccgagcgccaaggacgagccgagcaggaagtcgagatccgagctgggcgagtgggaggaacagggagctgggcgaccgaacgccattggggatggggcatgcgcgtccctgcgaccagagggagtgccgcggctacaggggcgcggtttggccagggaggagcggccgacgctggagctggaagaggctctggccatggggaaaacaaggggccggggaggaactcggctgggagcgccgctgcgtacaggagaacggcggcgcgcagagagcaatagctagagagggcgccgcgaggagcaggtgcctcggcagagcgcggcgagctgagggagctccggctgggcgcgagcgccaggaaggggatgggctggagcagcgagctgcagaggccgcgctcggcagagagagctgcggcgcgatggaggaagaagacgtgcgcagggttgcaaacttcgcgcgcgccggggaaacagcaggcgcggtggccagagagcttggcatgggcagcgggacgcgcagggggcttcagggtgcggcgcaggggactccagggagcaggcgctggcgagcgcagagaccaggggcgcggcgaactgagcgacggcagaaacgctgggctgaagggaactggccgccgggcagagagaactggaagggcgcaggaccaagcgcggccatgggagctggccgggcgtgcgtggcgagcagagggagagagagtggaggaaggagagaggagcgcgcgtaggagctggagcagaagcaccgcgcgtagagagatcggctgggaagggacgcgcggagaagaaagagcagaggagatggacgcccacgcgtgaagatataggagcagggggcggcaaaaaaatcagcccaggggcggcgagcggatgaggatccgtagacatttctctcttttgtcattaatttctttaaagaaattcgcagatatttttgaatccagatttttagcaatgtacactgagtcgacacgctattcaactacgcatttcattcccggaatctcaaaacggaaatccgaggactaacgatttgatttggcgtattctctgaactcggacaaaatcgtactattaattcacttttgaagatttagatcgaggcgaaaagcaacggactgaattaaacgggtttcggcttcgctatttcaatctgcatttgattcagttgattttagacgaattccgttcgctattcgaacactcgattagagaacaatttaattaaaaatccgtagacgcgatatcacggatgacaaaaaggggattaaattattttacactgaaagcttagtcgtcgagttctgattaatttgttcgggataaaaatcgtaagagtaggtcgagcttccgaattcgtattcgtgcgagcgatgaattttaaataatcaccggacgcaccgattttcgaaacagctatattccgaacatcacgaaaatttagtaagagcccggatagataaacatgatgtcgaactcacgacagacgaaacaaatgtgatactaaaatcgcgatagacgaagatgattaaattttagcatctgttttatccact

SEQ ID NO: 445 - DNA, 2494 bp, Zea mays
aaccatgcatttgtgctgctgttttttgttaggttgttagggttacatcactgtcagtttctgtaatgctttaatcagtgtcggttaaactactgctatttcaagtttagggttacagtagaggcgaaccaactatgtgatatatagatcggtgctatgtgattttggtgtatttttttacctaattgtcagtatctgggaggtaacagtgacatgtttggggcatattgctgctctatagctcttcatatttctctacacataaattctattgtaactgtatgttgctattgccatttcattttataggagatggtgccacattggaatcagttccggaccttgtgaagccaatgtacctaaacattgaaagcttccctatgtaaggctgttgaatctttctggtgaaattgggtgttctggtgcttacttagtgcttacataatgctcactcaggatgacaaatccacacgtttctaaatggttgaatgaaagttgcaggtgctgaatatagcttccaaggacgactctatgtcttggttacctgtattcctgaaatgccatgaatcatgtcctaatggtagtggagcttccaaagtagacccatttcacttgatcataagttcctcacttatatgtttggtccttgttacttgtcctaaattgttggatgactctatgtctctattacatgtattcctaaacaatgattgaaggtcgtccaactaatcacgataatcgagattagtcaggttggtcgcctgttaacagttgattagccagatgactcgattagggagcctggtcgtcccaatcatctaattagtcgacgataaggacgactcaacgataaatgcagttacctttctgacattagcttacacagctttctgcctttcttaaaaatgggaaaatgataaacatgccagtcaattgtactcaatcgtgcacctatattgttacattgacagaaacatgtttatcgttgcattgtcaaaacagcattattttcctttcatatttacaagttgcagtcctcagtacactgcattatttttgttataaaagctattatgtagaaccaacatgctaacaattatttgagaaacaagctttttacatattacctctgtttcatatctcctgaatccttattgtttctttatgtgaatttttgtgtctttaatcggtatagttttttacacgacgaaatatgatttacttcacggaaaacatgtgaatttcagttcgtggcataccacgattaaataatgtttacaataaaatttagcaaataaatttctaacaaaaatttaagcaaatggtatacaattgtttattttagtgttttccaataagtagtgtactaaagttgacatacaaaccttgatgtttagaaggacaaatatctagaataaataaggacaatatttagaataaataatgaatgtgcaactaggattacaattttctttttggagtataggctcttcttagttcattttactattgtcatgactcaacatgtggtcatatcgaggagactggagccttgattgtatggcaagcaccacctattatagagaagatggctgctcacaattagctagacttcaagcaggacccatacaattttttgctctctgttacattatgtctagcctccagggtgatttatttcttaccgcaaccgttggattatgccctgagggccaggattagatctaggtttcactggagcggtatgggacgcgggccagtggatcggtgatcaacggccgagatctgagtaacccagcaatcaaccccacgccatcgatgcagatcgggcgaaccacattcacccgcctgaaactggatccaagggtcgtgatccaaacgaaaggatacactatgtcttctaatctagatcgtttattaagagatcaacgcctagggttaacttcttcaatctagggccaagcacgacggcgtgagcgccatacggcggagcatcgccagcgcacccccaatcgttgtctcctggtactaacctcctacgaaatttagtgctatgtaacagacctagaatggtgaagctagtggtggcgtcttactggaggattaggtcgcgaggaacgccagcccacggagaaggcggatccacggcgaggtcacaactccagtgagcgattcacgagctccgaaggggcaatgtgcccacccctgcacacgcacaagttccacccggtcttgcgatgcttccagaccaccagtcagagccagaatcgccccacacctgggaggttcaaggacggcggcaagtttcacttcttcctaaacccctcttcgtcgatgaggttcacacacacggtgcagggtttaatgcggtggtcagcaacccgggtttaaatagacgggagggacgaagtccgcgtggttgtttccctccgcgagaattgcggcggccgttgccgtcgacgccgcgcagagaggaggacgaatctgaccattc

SEQ ID NO: 446 - DNA, 2493 bp, Zea mays
caatccgatttcaaaaatcaacatcggcaatgaattttagatgtcgcgatttatctctttcaatcgtaaatccgaaagccggtcatatctcaagacgatttatttttgaatcatgagtagggaattattgccgaacgaagtcagatcagactctcggccgagttaatcgctcaatcgtccgttcgtcggaactctaattcgctctgttctccatagagacaaattccacgggagcatttttattctgggaaatatttagcgcagcccgattacgtgttttgggccaacccaacccagctcatttggaaccttaaccctaggactcctctataaatacaagtgtctctctttgcaaattggaaaatttgcatctacccccctagccgccacaaccttcttcctcctctcccacacgcacgcaactctcttcttctctgttcatggcgcaagaaatttcctccccgcccatggcgtccttccctcctctcccttcttcttcctcaagcaagcaggccgacctctcctcctctgccatttcccagcgccaccttcttttttttccctgtctctttcttcctcacggctgcggcagggagctcagctccttctcccatggcgctcagcgcccctgcagcacggcacccttcttccccagcgatgcctctgctccagccggccttcttcctttcccccatccgagcgcccaagcctgcgcccttccctgctctatgggcgcgagctccacccgctgcaatggacgctgcgcgagctcaccccatgggtgcgttccctactccacggccagtaagaagccagcgcccctctactgctcagccatatctgcgcacagagaattcttccccatgccaccctctttctttcccacgaagcaagcagggaacacggccaatgttatcttcctcccatggcttcctccctgccgcgtctcacctctggtcgatgccctgcacagcgccctctctcccatggcgagcagctttcctccctatggtcatggtctgcgacaggaagtcgcgcgctacatgttcgatgttttgcgcagctgccccgatgtctccgcatgctgcctgctcgctgttttgtgaagccctgtggacaacacgccgtcgacgctcaccggttgtttgctgtttttacgcagccccaatatcgacgtcgttcacccctggtgagtcaccctactgcccttgctgctatcatatttttgtgctcggcaaaatgttgaactgttgtgtgtgtctaatcgcagctatccgtcaatgccatccgtcgcgcacgcgtgtttgatacaaggccggtcgggtggaccacatgcaagcacaactcgaatccgatctagtccatgttgattgatttatagtttagcatacatatgatttggttgatgtcatgcagtgcatgtatatgtgtggatgtgtgtaaaatgtttcggttatacacattagtggggtcgcatttgcggttggagaacaagaggttgtttgatgtttgcgatttgtagtttgtctaattatgttttggtcgatgtggtgtatattggtgtttgaatatatgtggctgcgatggttcatttatgtgtcacgaggatggttcgtggaggtattaattgtttgttaaaatactttgtcgtaaagcagtgtgttaattgtgttaaatctaataaagtgtaaagcaggcttggtggtttccgcagtcggctaatgagttagtctatgttaaatatattttatgtattcatcgtggtgtgggttagagtgggttgaaaatataaattatgtgacatgtgattagtgttttaaagacgagatgtgcgaataatcacttggtgtttcactcgtctagtcgataagtgttatcataactaattgtgctaaaatttggtcataagaatgcagtggacacgtggtgttggttggatgtgaaaagtagattggaagtgtgggtttgtctgagcactgtattgtcaaacgtgtatatcaaagtgcattgtagtaatgattgcgttaagtaaacagtaatgtctcgagtgcacgccagaatatggttgtatgcgagacggggttacgctcatggtgagtttagtaaaattccatcggtgtcacttgtgttaagttgaggtttatttgtgcgtggaaagtaactcttagtcgacggtagaaattggcttggcttaaatagagaggtggtgacatgtcaaggtagtcatcatttcctctatattaataagtcgactcaatacgcattatgcgttcattaaatttcacatcgcccatagtgtatggttgtgtttatgacttcgaatagatgtttcgagttgacaagtaggtttgtaatgcatgatgtgtgatgaagttagtttgttgtagaatatttgttgaaatgctccattcatgtgatagacatgtagggttaaatcaaatcgagtcgatgtgtgtgatgatgatattcatgaattaagtagatgtcctgtaa

SEQ ID NO: 447 - DNA, 2491 bp, Zea mays
ttagtcccaatggatctcaggatctacgtcctctaaatatgacggctcacatgcgccacaggaaagaagcccattaccgggtagcggcctggtgggtgcacgcatgcagctggaactagaaatgaagtatccgaagttattctttatcggtttaccctctcgagaccgtcttttttgtactcttactcgtgacgaactcgcgactgagactcttcagaatttacactgaggatgtcttttagtctttagcaatagtgagaatagccgtgcaaaacactgttttatctcatagatacatgatttatagagtaaagtttaaaatacaaaaatataataaaagatgtgataaaaaagttgtcgccgcccaagcaagtccccataaatttacaagttttttctattctttccttgcaaacccatctgttgtaaccagtggtggatccagaaattgatgtgctactatgctaactaattgtgacattgctggtctaatgatagacagctgataccttatagtatacataccgaaatgtctgtgtcggatgggtcgtctttacgaatgacactaaaagtcattaatatggtattatatgtgtcatccacttaataaagatggtaaaatattatgttgctatgttagataatagtgtggatgataagtggtgggttatcgagtgagacatttttctatataatagagcgcgacgcaaactgtcaaggataggatgtccacgtatgctctatttctaccagtcgtcagattttggatccacggtgagataagagcgcggcgtaaaacggtacggaccacagctagataagcctggattgtcctcttcagtgttgcctttcgtgttctctaccagacactagaatcttccaatgtaagatcaatatgtgtccagcgtccagaaatttcgtcacatcgcttttatttacagcgaaggcatggagccgacgcttatcttccgctcccttccttactcgccctcaacacgcaggccacagtggtgacgcctatgcttaacggcgccaacgactttccctcacacctcttgcacaggcgcaagcgcatagtaggtttctgcatcacccatcatcttcctcgcaacgacgatgctcatcttcgcccgcatcctttctcgcgctcggcacacatgcgacggcaatgacgctcatgcttgacggagctagcgacttcccctcccgcctctcacacaagcgcaggcccgtggtacattcctgcatctaaaatctatatcttcctcaacgtcggcactcatcttcccctccctcccttactcgcgctcgtcacacaagtggcgatgctcaggctcgacggcaccagcggcttctccaacctctcacacgggagcatgcacataccctctcacacctctcaaacggacgcatgcacagcgcctccgcatgtcgcagccacactcaacgactccatcgctccagcgcagtgcccctcctccacacggccgggccaggcctgtaggctaaccggccagccactcgccaccctccacctgctctcccttcccggccgaacgtcttggccaggccagacctacaggcaagctatcgtcggtcgtacaaggaattacttttattaccgtgcaccagtcgatttggattgtttattgtatgatgctccttcaaatttgtttactcctttggaaacggctcatggtccccctcccctttgaattttggtgtgattttcacctactatatgaaagagtcagacgacgtgccgatatgaaccaatcatttgacagttcagtgttgtcgttggtggatttcgattttgttttcgactcctagaatccgcattggttttgcggagttatcgcccttgcctttcgccaatgcattcaatttgccttctgcagtttgctgtcgcaataaatgtgaataatttgcttcctgcaactgaaatatggcagcaattcatttggacaacctacaacttctattcagaacaaatagtatggttttgcagtaaacaaatggttacctattcctttccatactcaccacaatacatgtcctcctagacctatagaccataaatctcatgtttattattctgccaattaaggtgtgcttgctctgccaattgaagtatagtatgtttattccatgttcctccgcacacctttatatttttcctatttgtgtttcatgttttactccatcacccatgtttcattgaaataactaactgtgcatacctatttaccacacataaagttgatcacttcttttgtgagaggtcaccattgctgctacaataggcatgaccaccatatttcctccatacatcaccatacttttccctctatgtacatgtagatacacacttcggataagtgttcaagtacacatgattgacgatatgctgttatccataaataaacatatgaacatacatcatatactatgaatgcacatatatacggcaacgactaatatgcaagca

SEQ ID NO: 448 - DNA, 2491 bp, Zea mays
  misc_feature (107)..(110): n is a, c, g, or t
actacactctgcaaaatagaactagttcgaatatactcggcaactaaactcctcgaagcacacctcacatcactggcatctttaacttaaactttatacgcaaactnnnngtcttatttcacgatcataaaatcaatagtaaaaatagtaaatcggctcaccgttcgaatagctgactcgaatccgcgagatcgagacgggtgaccgaaacaactccaactcggatgcatcacgtagggaccgacatcgagacgggtgaccgaacgacaacatcaagacaaaggttggagacgaccggatatcaacgacaagcactagagttttacgatgggctgttgcaatgggacgtcgatacacgatccatggcaattaggagatcgacgtaggcggaacagatagccgaacaggaactgcgcagatcgacgacgcgagacttgatctggcgagcacaacacaagggatcgcagctgctgcttcgacatgaattacttgctgccgagcacgacggaggccgggagcaggaacgctgcgcagcgaaaccacggttgcgcgcaggggtgaactcggctgggcccgacgattggagcagtcggccactggggcagcgcccaagtacgcacgacgagaatccgagcagggccagtgcgcagcgaccatggaaaagattcgagctgggctgaatccgagctagagctcgcggcaactgggagtagggcgagccagagactggaagacgccatggcgagcagcagggagcttcgacggagagaggcgcgacaggaaggtggagcagggagacggacgtgcaggggaggcgcgcgccatgggagatggctgtgcgagcgcgtcagggagaaacgcaagctgcgcgcagggcgaactcggcacgacagccatggacgaggtgggcgagcggaggaacgacgcgatggaggagcgtggcttgcgatggagagcagggctgaccggctcccatgggagattgacttggcgagcaccggcggctggagaaagtcgaggggaggtcgaggagctgagaggctgcgcagtggagcaagcagccatggaagagcagagagtcgactgggagagaggagatgggacagcgctgggatgtccgggactagggcgcggctgcaggaggaagatgtgagaatgagcgcctgctgccgtgtggagaggagatataatgatgagtaaaaaaaatctgcagaagaagataaggctgggagagtatgcgcacgtagaagaagatattctaccggttacccacttaagcgacgacgaagacaaggaaaaaatgcatcgaatacgattgctggcaaagaaaatatcgatgacggccaatgatattctaggaagtttacgtacatgagaagaaaacaacgagaaaacaacgatagagagatattttctatagtgaaaaatccaaatacgttgaaaatcatactaagaaacggtggaaatatttagagaaggattttccctatttttccttctttttttaaaacaataaaatacacatattttagggtatgaaattagagtctaaaaaatatacaaaaggctcaaacaaaaatgagaccgacaacaatatttagatttgatttgatttgatgaatactctcggaattagatgaattttcacctgttatttatatccgaagttttggatctgtccgagaaacacaaggaccaaaacactatccggatacggtacttgagactctattaatttagttgaactcagataaaaatttatccgttttccaaatcgatttgatttctctacctagaatagcacactattgaataatcccaattgttaatcttgtgcactgttgcttggtaatgcaagcgatccggagtattctttcggacccagtattatctgctataaaatcaaacgttaatctctttgtctcggataatatcgggttcggatagggagcaaatagaatgaacccaaatgagattgagactgatattttaaactatatttgatacgacatgaaatcagataacttcgtctgccactcgaacagctgatcactctgccatagatgatttattggagaattaaatctcaattataattccttgtttagcaatctcgcgcatgatttttctcatacaatgcgcgattcagattattttgccccgaacattttagtcgtcaagttcaaattaatttgttcgggataaaatcattcgagtgggtcgagattccaattcgtattcacgcgagcgatgagttttaaataatcactggatgcaccaattttcggaacaactatgttccgaacatcacgaaaatttagcaagagcccggatagataaaaacgatgtcgaactcgcgacagacgaaacagatgcgatattaaaatcacgataggtgaagatgattaaaatttagcatccgttttatccactgatattgcatgcttaattccatactcattgtcgagcggaatataaacaccaggggtgt

SEQ ID NO: 449 - DNA, 2490 bp, Zea mays
  misc_feature (392)..(395): n is a, c, g, or t
aggtgttttcccgaccccattaatcagtaatcagccattgaaggtacattaccaagagaaatcttaataccctaaacatgtgtggaagtgtaataaacatcaacactaatgaatactataagctcatgattgaatggatcatgcgtgcgatacacctgtagtgaaacaccaaaatcatcaagcaagcaacataacaagtctccttagccatcacaagagccatagcatgcaaatctacctatacacatgaatgagaaactgcttcttagtcttctcttggggcttcatttgtcagcacgactccaactcagcggcatcacgtagggaccgacatcgagacgggtgaccaaacgacgacgacaagacaaaggttggagacgaccggatatcannnncaagcactagagttttacgacgggctgttgtaatgggacgtcgatacacgatccatggcaattaggagatcgacgtaggcggaaccgatagccgaacaggaactgcgcagatcgacgacgcgagactcgatcttgcgagcacgacgcaagcgatcgcagctgctgctttgacatgaattacttgcaaccgagcacgacggaggccggggagcaggaacgctgcgcagcgaaacccacggttgcgcgtaggggaaaactcggctgggtgcggcgattggagcaggcggccactggggcagcgcccaggtgcgcacgacgagaatccaagcagggccagtgcgtagcggccttggaaaagatccgagctaggctaaatccaagctggagctcgcggcaacagggagcagggcgagccagagactggaagacgccagggcgagcagcagggagcttcgacggagagaggcacgacagcaagttggagcagggagacggacgcgcagtggaggcgcgcgccatgggagatggctgtgcgagcgcatcagggagaaacattggctgcgcgcagggcaaactcggcccgacagccatggacgaggtgggcgagcggaggaacgacgcgatggaggagtgcgacttgcgatggagagcagggttgactgactgccatgggagatcgacttggcgagcaccgacggctggagaaagttgaggggaggtcgaggagctaagcggctgcgcagtggagcaagcagccgtggaagagcagagagtcgactgggagggaggagatgggacggctctgggatgtccgggaccagggcgcggctttaggaggaagatgtgagaacgagcgcctgctgccgtgtcgagaggagagataatgctgaggaaaaaaatctgcagaagaagataaggctgggagaggatgcgcacgtagaaaagatatattaccggttacccacttaagcggcgacggagacaaggaaaaaaatgcatcgaatacaattgctggcaaagaaaatatcgatgacggccaatgatattctaggaagtttacgtacatgagaagaaaacaatgatagagagatattttctatagtgaaaaatccaaatacgttgaaaatcataccaaggaacggtggaaatatttagagaaggattttccctattttccttctttttttaaaacaacaaaatactcatattttagggtataaaattagagtataaaaaatatacaaaaggatcaaacaaaaatgatatcaacaacaatatttagataggatttgatttggtgaatactctcggaattagatgaattttcacccgttatttatatccgaagttttggatctggccaagaaacacaaggaccaaaacactatccggatacggtacttgagacactattaatttagttgaactcagataaaaatttatctgttttccgaatcgatttgatttctctacctacaacacactaatgaataatcccaattgttaatcttgtgcacggtttcttggtaacgcaagctatccggagtattctttcggacccagtattatctgctgtaaaatcaaacattaatctctttatctcggataatatcgggttcggataggatgcaaatagaatgaacccaaacgagattgagaatgatattttaaactatatttgatacgacttgaaatcagataacttcatctgccactcaaacacttgatcactttgccatagatgatttattggagaatcaaatctcaattataattccttagttagtaatctcgcgcatgatttttctcagacaatgcgcgattcagattattttgccccgaacattttagtcgtcgagttcaaattaatatgttcgggataaaatcatccgagtgggtcgagttttcaattcgtattcacgcgagcgatgtgttttaaataatcaccggacgcaccgattttcagaataactatgttccgaacatcacgaaatttaggaagagcccggatagataaaaatgatgtcgaactcgtgatagacgaaatagatgcgatattaaaatcgcgataggcaaagatgattaaaatttagca

SEQ ID NO: 450 - DNA, 2489 bp, Zea mays
tatattccgctcgacaacgagtatggatttaagcacgtaatatcagtggataaaactaatgctaaattttaaacatcttcgtctatcgcgattttaatatcgcatctgtttcatctgtcgcgagttcgacatcatttttgtctatctgggctcgtcctaaaatttttgtgatgttcagaacatcgttgttccgaaaatcgatgcgtccggtgattatctaaaattcatcgctcgcgcgaatccgaattcggaagcccgacccgctcggatgattttatcccgaaaagatgatgaactcgatgactaagctttcagtgtaaaataatttaattgtctttttgtcatccgtgacatcgcgtctacggatttttaattaaattgttctcttatcgagtgttcgagtagcgaacgaaattcgtctaaattcaactaaatcgaacgtcgactaaaatgtttggggtaaaataattcgaatcgcgcgaaatcttgtgcgaggttatgatccaatctatccttcagcacgctgttttggcgacaaaaacgagtgtacattagcggatcgggtttcggctagtttcggtcgaatcacacagaacaaattatcagtgccgaaatcagtttatttcggtctgtcgtttctcgccaggatccaaatcttcggatataagcaattgttaaataatttgattcactaaatccggagaatgaaatgtgtattcgtgtagcgtgtcgacccagtgtacagcgctaaaaatcgtgatccaaaaatatctgtgatttttgtaaaaaaagagagagaaagaaaaagaaattaaaattggaaaatatctcttttatctttatctcttgccgctcaggcgttctcagattttttcagtcacgcgcgtcttcatctctagccaccgggcaccggcccaccgctcgtccatggaaaaaaaaaccagccgccactatcctctacacgcgccagagtttcttccagccgcagagatttttctttcaccgcgcagctttcatctctatctcctcccgtcgctatttctgttcctgctcgcgatgtgaatctcctgcgcgcacttcctcccctgcgtgtccctgtttctctggtgccttgcactggcagccgcgcgcagccggcttctcccccagcgcaccgtccctgctcgtcctctactccatcctcttcccatccgagctcgcccggccaccgttcttcctgcgcgccctcatgtcgccgtgtgcccagctcgctccagctcgtcggtcgagtctcgactgcgctcggcctccagctctgttgtcgcgcaggtcgccggcgttgcccctgtttccatggctgaccgcgcggctcctctgcgctgccgtgggcacatgcctccctcctcgagcaccaaccggagttcgggtcgtcagccgccgtgctgctcggcttcctgcagcacatgtctagccccatgctgtcgcgttcctgctccccggcctccgttgtgctcggcagcaagtaatttatgtcgaagcggcagctgcgattccttgcgtcgtgctcgccagatcgagtctcgcgacgtcaatctatgcggttcctgtttggctatcggttccgcctacgtcgatctcctatttgtcttgcacagcgcctcgacgccccattacagcagtctgtcggggaactctagtgtttgacgttaattcttggtcgtctctaactttgtcttgttgtcgtcgttcagtcgccccgtctcgatacgggtccctatatgatgcctccgactcgtgttcgcaccgacaaaagaatcctaagaagatgtggagaagtgagccccaggtcgatgcccccaagtactcggcgaaaggccagaacaagaatcatcgccagttgcggagttctagttaatatggagaaattccaagaattgaggatggaagagaaagtgaagctccgttctatactcatcaactattttgatcgaagattttattcggaggctatcgacgttctcgcaagctttgagttggacttgctttggatgagaaatccctgatgttcgagaaaggtgaggcctgtaagcgctctcttgggactcgaccaaatgactaaattggaaaatcgtcatcgctctcgtggatatcgaatccattcggtcttggtaagccaatttattttttcggttaattgaattggatgaactagactcattagtcgtaataattctcgtgtttagcagatgcgtcgtgctcgtgttagatgtttgctaaaatacctcagcccctctggtaatgtaattgtgtgaattaaatgtgtaatatggtgcaccttaggtctaaaatgcaggataaatgaaatattttatttagtgggagttatgcggcataataattgagaatagtaattctagaagttaatggaatgatttctatttctagtctaagtttagatgttgtgctctagtcaagagagatagagtgcctgtaaacggttcgctatggtt

SEQ ID NO: 451 - DNA, 2482 bp, Zea mays
tagtcacatggctaattataacaaacatgcagcgcgggttaacgccactcgccgcgcggcgtaattagcgagggggcgcgagggtacaggcgtcattttgcttgctttgtcctgaccagtttttttccactgcctagtaacggatcaatggggccaggggggaaaaggacatggagatatggggacgaggggagcggaggtttgaaatgtgagggagaagcaaaagcccagataaaaaataatatcggttttgttttgcgtcttccgtttacgatttggggtgagcggcagtttggagtgggttcttgcagcggcgcggcagagaggtgtgttgtgcggccgtgctaggaattatcctgttccttcagtgctcgcgtcctgatgcgttttctccgacgatgatttcgtcgtggctacctgcatgtgctgctgctagtacgcggagcgctttgattcggcggaggcgttgcttcggttttggtttctttcgcccaagatttcagctttagcagccgcagccttttctcctcggccgattccagccttggcccggctatccccccttcaaaatcgcgcatagggtgggggttttactcggccccttgctgcgggcagcgcagaaatttttcctcgggcgttcgattgtcgcttagttgagcttcagaacctgattatttttgagagatttctggaggaattttgactcttgtcgtggaatttggggtttggcgggttgccagttttcagcccttggcgagttagaggctattgcctctgaagttatcgcctgttttgatgcgaattggggaaatttctggtccctgtgctgttcggctattggatttggcgagctggtgtttgagccctggtataaatcaccggtctgtgctggtggccttttgatttcccggtggtgatgctctctgccgccgctgtgatggcgccggcagcagccacgcagaagagctcccttgaggtcttgcttgagacgctaaagaagcgcgatgagcagcccaaggatgcgcctccaacattgccagcccggcccatgtgccgtggccgtctgcccaccaccaggcggccatcactgcctgctggctttaagctcgagaatggcatggtaacagttcctgccacagaagctgcagcggttgacaagaaggcagatgccaaggagattactgggttggaggtcaaggaggaaaaggcagtgaaaggatgcatctttgggactaagaggaagttccctagcacacaagtgctggaggagtcgccatatgttgatgaacttcatgaggagaggaagcgtacaacagtttgtaaagagcccccttctatttccccggcaacaataaatatgaacgggaagccagcatgtacagatatcatggactatgttctccagaaggtgagaggcttgttcattgtggagtttgtaagaattatttctattattgtaaatttgcaatgtgaagaaatggaagtaatctgactacattgtctaacctgattgcaacatttcattcatgagtcaaaacaggaaatgttgatcaaattgtcccttacatgtgtttgttatatgctgaattaatagaccccctttttttaaagattatttctatatggtatatgtgaataagactttcatgtgagaacgtggttatgtttgggttatgcttagcttactgtgtttcacatttaccagaagatacagttagtgatcgcttaatgattttttcctggtctcacacttcagatttgttttggccagtttgtttgttacatccacaaatagctgcatgtcatgttactttaaagtttaaaccttataagtatgagtatcggatgaaagaacctgtttttttaaccttaggatatatggatactggatattcagaaagtgttgtttcttacagcagtataggtctcatggaactagttctcttatcacttgatggttcaactttgatgtttataggtttatattgtgattggaagaaccgtccgagataataattttttttatcgattttcagaagctacgagtttggtgttcttcatcaaatgcaaagtgggaacttggacagatccaatcaatatctggagatgatgctgaaatactcctggctaatggaaaagtgagtgtcttatattctcacggtggtatagtcacatggggacactcctgtacaattcttactcaatgtttattcgcgtaggttttgacggtgtcaccagaacaactcttgcctgccaaccctgatatcctcgatggagtggatgatttaatccagatgagttacttgaatgaaccttcagttctttacaatctgcaattgcgatattctcgcgatcttatctatgtaagcactatgcaatagcttcatcatgctaaatatgagaacataggtgagaaccaatacaagaatggaggtgagaggacctttttaaaaatatctgtgtatgggtgtttgctgggttt

SEQ ID NO: 452 - DNA, 2477 bp, Zea mays
tacattaatgtccataaccatgaaacatttgaaaaaccaatacgtatcttatgttataactagcacaaacaagtaatgtttacaatttggcaacgagagcaaattgtaatgtaatttttctttgtttaattgttttatgataaatactattagtcccatactcgtttttgagtggcctcaagcttgcattgatgtccttaaccaaggaacatttgaaacaacactacatatcttctaagatgaggtgcccaaaccagtatttttatagtctatcaacgtgctaattgtaatgaaagttggaatgatgtttttctatatttaattctttgggataaatattattggtatatctatagtagaatagtaatgattgtcttgaagttgggttaatgagggagcatgcgaaataacaagttggttatatatgtaaaaactttctatctaaacaatacaacatttacgccttcaaaatgcttcaaagttgacgcacatgagaaattgatatattatgtagcaaacatatacgaagttaatacccattagtcccatactcatgtttttgagtggcctcaaacttgggttaatgtgttcataagtgaggaacatggaaaatattattacgtacatttcaaataataagcctaaacaagtatggtttacagaacgacaatcagaaaagagtcttgaaagatggaatataaatttcctttaattaattatttttccttaaatatagcccgtaactctacaaaatagtttaccccaaaaaaatctgagtattgtgattcaaatggtttttcaatttacctaattctttatatcactgaacattaatgacagcatgcatctaattctgtgggtctcatactaaagtattgattgtgttgaactttggttgatgtcggaacatgtgaaataacatgttggatcattatataaaaactgccgattaaaaatatatatatttggggcttcgaaacaatttaaagttgtcgtgcttcatgcctcaatgttttggagaaagcatgcaagaaatcaagaccctttactcccatacaattttttgagtggcttcaaacataggttgatgtttccattatcaagaaacattacaaaatctactacgtaccttctgaattaatgggtctaaactagcatggtttaaacatccaatatgttgggccccaaactcatgctataggttgtcttgaacttgggttgacgatgaagtatatgaaacaaaagttggatagagttgggtctatctataaaaactgtctatctaaacaatacaacatttgtggcattaaaatgtttcaaagttgatgcacatcagaaatcgatatattgtgctgcaaaattgcacaaaattaatacccaatagtctcgtactcatgttttgagcggcctcaaacttggattgttgtgtacatatacaaggaacattacaaatagcactatatatgtcttgtacttacgtggataaccgagcgtgtgaaaaaacatgttcgatcccttttgtaaaaactaccgttataaacattacatcacttagggcttcgaacctcttcaaacttacattgatgttcataaccaagaaacatttgaaaaaaaacactacatatctaatgatataacaatcccaaacatgtattgtttacagtttagcaatgagcaaattgtaatgtaattttcctttgcttaaatattttgtgataaatatcatgagtcccatactcgtttttgaagtgacctcaaaacatgcattgttgtccataaccaacaaataacaaaaaaaacactatatatttttctagatagcatgcctaaatcggtattgtttatattcttgcaatgagcaaattgtaattaaaattggaatgatttttttctttatttaattcttttgttataaatatcattgatataaccataatagaatagtaaaaaataaacttaaaacatggatggaaataaaagtcgaatatcataaatatatatatgttgccctttaaacatttctatgtatgttgcccactaaacatttctaaacatctcaacttctgaaaaattatgaatctaaataatatatatgttgccctctaaacatttctaaagttagattgttctgcatgtccaaactcaagtgcgagcattcatacatctaatatgttgggcgccgaactcatgctatagattgtcttcgacttgggttgatgatgaagcatatgaaacaaatgttagatacagttgggtctatctgtaaaaactgtgtatctaaacaatacaacatttagggcttcaaaatgcttcgaagttgatccacatcagaaatcgatatattatgcaacaaatttggtcaaaattaatattgtttgtcccatactcatgttttgagcggtctcaaatgtgagttgatgtgtacataaccaagaaacgacttcgaacttcttgaaactgacattgacgtccataac

SEQ ID NO: 453 - DNA, 2475 bp, Zea mays
acactgatatttttcatggtctaattcactaaaggttttggcataatattgtttaagaaagcgatccaaaggtgttcatccacttttggatagttttgtccttaaagtataacatttttccatagtataccatattcatctgatgcaaacttatttaatgccaggttgcgctctacttttcatagaatatgatcagttgcaacagggaacaggcgttgagggccagggaaattgctctaaagaagatagaaagcaaagatttttttggtgcccagaagactgtgcttaaagctcaaaagctttttccagagctggagaatgtgtctcagctgttaaccatctgcagtgtgcactgtgcagcagagttaagggtgaatggagagatggagttttatgaagtcatttaggtgggcacatactataccttgacaacagcagcatgcgtactttgtcggtatcagcaaagatgggccaaaagatcaccgaataagttctgaagaggacaaaacagagacatgaatttggacattaaaaattaagacaaaatagagacaacatgcagaaaatatatgaataaaatagtttgtgtctggtgccatttcctctacttatatggaagtgctgccagttaacaacaacatatatctgatcatattttcacttctaatcaagcatatatctgatctgtatataagtatagcaatgtgacacatccttatgcaggaagatgggtcaaacaacgatttgaggcttcgaatgtctctgagttctactgatgttgttgctgctcttgcttcgaatcaagcatgtaccttctggatccacagacacaatctcaacagggaagattgcttgctgctcttgctcttggagatcttttccaaaacgaaggtcttgctcgttctattgatgctgttgcagcatgccgcgctctagtcaatcttcttgaaaatcaaccaactgaagagatgaaagtggtagcaatatgtgccttacagaatctagtcatgtacagccgagcaaataagagagcaattgcagaattcggtggtgttcaggtcctgctggatcttatcagttcaagcaatcctgacatttctgttcagacagcaatgtttgtcaaacttctattcaataaccacactatccaagagtatgcgaccagtgaaacagtcagagttataactggtaaacaatatccctttcttgttctgtcatgttcattttgcatagcaaattcattgttatcaatgcctgtcttgctaaagatgtcaatatccacctttagtatatatgagatttatggaatttctatgtaatgtctagcaaatacatgaatcgagtcacgtttgtgaagttcacgtgtactttgtgagttctaatcaaacattttgtgtacagtatgtgaaaggaggccatctttttttagataaaagcaaataatccggcatcagcattcacgtgtgaatgtttatagcccaagaggccatctatcttagtttagttattactcctagccagctggaatatgtatatgtttacgatcatacccagtttttatacatttaatgcttacatttttcatgcagcttctatttaaaaggatatatgggcttctggaagtgctaacgaagagtatctcaaagcacttaatgctttgctgagtaacttccctcgtctgagggtcactgaacctgccacattgtgcattcctcatcttgtaacatcccttaaaactggttctgaggcaactcaagaggcagcactagattcactatatcttctcaggcaagcttggtcagctgaagtgtttaaagcacaatcagtcgctgcatcagaggctattcctctacttcagtacttgatacagtctggcccaccacgatttcaagaaaaggcagaattgcttcttcagtgcttgcttgtgactcttactgttacgataaaacgtggcaacaatctaaagcaatcagtcggaaaccctagtgccttctgcaagcttactcttggaaacaatccgccaaggctgacaaaggtacaccaacaatctagggatatcggtccttctctatccattatcctcgttctgagactttgcttgcaacagcttgcattagcttttattggcatgcttctttgactattggtttgggacattcctaattttattgcatggagtgttgctgacctaaacttacgtggcctaaatcatagattgtctcgactggtgcaacatctgaatgggatgaagcctttgcatgggcatttgacagtcctcccaagggccagaagctgcatatctcttgcaaaaacaacagcaaatttggaaaggtgcgataaaaggatagatgtagctcaccaatcactttacattcctttttggacttcacatcactgtgacacctgtctcttatacacatctgacgctgccgacgacgtcatgagtgtagatctcggtggtcgccgtatcattaa

SEQ ID NO: 454 - DNA, 2473 bp, Zea mays
gcgacaacttgtccacattgcaagttcttctgattctgtccgtgataaaccatatgtgcagccactaaaggcaagcatatccttctcatagcgcaaatgcaaagcaatatatttcccaaatgacctcatcctctccaccaatagctgcaagaaaatcagttaatctttgcttatctaaacaacacacggtatacatttcagggaaaataatgatcaagatgggaagatatgagagagtgatttactttgcctagagcttcaattgggggagcaaatctcagtgcttggaaaaaagcccgacaacgaagcttctgaatgtcaggaggaaggtggttgtttgcaaggcgggaatctgacttagcagctcgaatgacctagtacaaatcttcaatcagtattcacagttccaaaaattgcatcagtaaacatggcttagatttgtctagtatggaagtgcaaagtggtggttgaattcagacctggcgatgatcccacagtggagaaatctcatcctggtaataatctactccagaccaactcttgaagtacctgacagactttggagctttcaccaattcctttggcagttctttctcaactttcacatcatttgctaaagaatttatgaagtgttcttcatcaaatacatctgaaaagttgctgatattgaaaagtggtttcatcagtctcttatcagttcatggaaggatgaaaacaaacccagcatatgatctaccttttgtcatgccaaaatgatttcttatcaagctctggaatgatgagtgtagcattaagtacgcgtgcaacagccaccatatcactgatctgccataagaacaggaatgttcaattaaaaaggagacaaaacatttgaggattttgtgtccaaagtgaggggcctcttattattcatttagcaacacagatatgtatccagtaaacaaagaacatgtgcaacaaacagtaaagaaacattcccctttctatatccaaatcacatgaagctgacattgagagtattaggacaagtaccaattggcaaaaaaaaaatcggttatcttaaccataagggaacctaaacaaaaacagagttttcattaaactcaagtgcaaataaaacactactagtagttagttccagttatctaacaatctgcatgcacaagtagagtgtaactgcttttggtctcccctgctaaaacgaacagctttctttgtccaactataaagaaaaaacaaaatcatgattgaaacttggcatgggtatgacagaagcacatccaaacaagtgtcatttatcagaatcagaaaaataaaaatgaacatgatattcaataccaagcaccaggaaaagaaattggaattgcaacgagaaaacatccacccaccaaaaattataaggagtaaccactctatctttaacgcagttgggccattcaatatgtgtcgccagtaactcaattaattaacaaaattctaattgggaaacaaacagcttaaatttagcccgccatatacatcttaaacaagcacatccgacatctctaacagagtggaacattagcaccagaataccaactgcacgtgattaaagcaccaaaggactgctcactgcccacagacactgggttaggcaaagcacattgaaagcaccaaaaattgtatgtgcaaaaaagaagagctgataatgatgggtgctcacaaaccgtcaactctgatcaaacaccccacatgcctgaacgacaatgctctcccacgcttttttttagatgagatattggccctccccactcaagtcaacacatctaatgcgaatcaagcaatgaataacttcggtcatcactaaggcaagtgataaatttccaccaggacggtccagcttaccccagcgcgcatctggttgagtccgccattggtgtgtacgagcaagtacccctttgacgccaccggacctgcaatgcaagatgaacaaaatcagaactgcgcacaataatttggaccatgaggcgagaaatccatgtagagggaggtgtgccaataatgcgcatacttctgtattccggtgacggcgccacgcagggcacgaacccccgcgccggcgccggcagccacagcctcttccccaacgcgtcgtcggccgcaccgtccagctgtcaaatctagagattaatcccggcgtcataggctcccatgaattcaaaaacagaacaaagaaagcaacagcggcggcaactagcagcgaaacagcatcgtggagaatcgttcacctttcgtgacgacgcgagctggggcgatgcgaactcctgctcccaccgcagctcctctgtatcccatggctgcgagaggcggtagggcgcgccggaggagacggagggcatggcgaggccggagacgtggagagtgacggcgagcagcgcggcggcggcggtgatgatggcgcccgctgcggcgagggagagcagccaccaccgca

SEQ ID NO: 455 - DNA, 2472 bp, Zea mays
cccccccccccccccctcattatcttccgatatagagccagcagagctcctgttaatctttgggggaaaagttgttaacttgtttatcttttatgtattttgttgacatgtctactgactacgattaggcaccacatccgtctccacaagtggctgttcgttcttcattgcacactaatctgtcatacaacaacagagtttcaaatgttggatctgacctttgtgagatgcagtcaactgagattacccaaccatatgaaagaaccagtagctgtgctaatcaaagggtgagtcccatgagtcagcagaacacaagtaaagcaaaaatgccaataggttcaatgcctccagaaataattgtaaaatcatatacatcaaggcttcttgtcggcaacccagatggtaaaatagtcattaggtctgatcaatataacagacatgatttccctgtggtgtatccaaatgcaaaattctttgtgatgaagtcctatgacgaggcagatattcacaaatctatcaagtatggtgtgtggtcaacttcctctgttggaaaccagaagttggatattgcattcagagaggctcaagctatatctgcaagtagttgtaccttgtgcccagttttccttttcttttcggtgagttgatcttaattttaaggtatttgacctctttcattaaattccatgttgttgaacttgaattactgagtccaaaattatggtcagcaggtcaatgaaagtttccatttctgtggtgttgctgagatggttggccctattgactaccaaaatgacatggacttttggtgcatggataaatggactggcagcttccctgtaaagtggcacattataaaaaacgtacataactccactttccgaagtatcttactgcagaacaatgaagataagcctgtaacctctagcagagatacacaagaggcgagctctctttgatatttcactaaatttcttacagttggaagaatattgtttcactgtttatgattggtttctttaattaaaggaaaatatgtatatgttcagttctctggttctatgatattttgatatagaccctaaatattgattccacataaatgggtcacataaatctaaggtactaccgtactagtaagttttgtttctttggatgaaactggcctagcaatagccagtaggttttatccatttgcagtattttgctgttgcacctttgacaacattgtaccttgatctgctgtttatcttgtgatctcatcctgcactctgacattgttccatacttgcatttgcagatacactacactcctggaacaactatgctcgaactcttcaaatataccagagcagacggctgtgtgcttgatagcttcatgttgcacgaggagaaggaagcaagtagtagacaactccaaaagtttaagctgcgcaggggtgctccacattttatacctgcatggcatggccctcgtccctacagacatgtgctgccaaaatctgacagtgtagtgatggggaaaattaccactgactttgagaccagcaatctggctaacaagctacagaatctcaacctggagaagaaccaggcttcatggcaagacttcaggcacctgactagcatagcttccaccaaaaagaggcagaaagactgttatccctatggaacccgggctcatggcaggagaaacaaggatattgtgaaggcataccatcccatggctcctaacaagaaatctgctttggatgaagaacatcgatactggaagaaaaaaccacaaccaggaaccgtagccagcgtctcatcaaaagcaccacctgaggagcatcagcaaggagttaaaaataccgatgcgcacagtgcattagtagctcctgagatgacttgtgaagagcaaaagattgtcgggaaagcctgtccacctgcggtcgtttcgacaacgagtaaagcctgctcagaactcctgcctggtgtggttgctattggctcaatgctgatcccgattacgatgcccaattagtagttccaaaggcatctcttgttgacctgcacgagtcaaggcctctcttgtaaatgcacgattccattttgagctcttctgactctatggtctcgtggcaaccatggagcaagccgtcttcactttaatctggcaaactagaaatcgcttataggttcaggttgtcttttcaccttttctgcgtccttgcttatgaatcttcagttgccaggtctgaactttttggttaccctagtctctggaatgggaaataaaaatacaggctgtggtgatgcgcttaaaacttctgttgaggtgggtagcagagtaagtcgcatgttatgctgaaatgatttctttgttgaaagcgtatgctgtatatatcaagtacatctttgttcgcatactctgttgttaaagctagacatgtcccgatcgtgcattgattaagggtgtgcattgggtaa

SEQ ID NO: 456 - DNA, 2469 bp, Zea mays
ctactgtttccctgaggaatgcctcctgaaactccaaaccccaatgccacagaacatgaaagaaaaaagaaatggaaatttaacttcttttcagaaaattggggtatcacatctttgccaaactgtaaacattactaatttgagcatgttattttataagatatgtggaaagatttcaaatgtttcatggttatggacattaatgtaagtttgaagacgttcaaagcccttaatgttgtaatgtttagaatgaaagtttttacaaaaaacgacccaataaggtttgtcatcaaagttttcgcaatacaatgatttgggagtaaagcgtcatgatttcgtgcatgttttctcgaaaagattgtggcatgaaccatgcgaaaactttgaagcttttcgaaaccctaaattatgtggtagatttatagaatgatccaaaatgttgtttcacacggtccaccagcatctaaaattcaacacaatcaaaacttgagtgtgggacccacataattagatggtcgcatgccgattaaagttcagtgttttgaagaatgaggtaactttaaaagtatttgaattgtaatatgcagatttttcaagataaacgattctgcagagttacgacctctattaaaggacaaatagttaatggaagaaaaattatattttcactttcattactcttttccaaatgtcgtactgtaagacatacttgtttaggaatgttaccttaaaaatagacaacctatcgcatgagtttagggcccaagatattggatgttcgaatgctagcactagagtttgtaggtatgaagaatgaggtaactttataaatgtttaaagtgcaacatgtatattatttagatcggtaattttctagaattgagagaaatatttatgcaattctgcttttagtttgatccatgttttaagattctttgttattattctattacatttatatcaatttataataaaaaaaattaaatatagaaaaaatttcattccaattttaattacaatttgctctatgagagactataaacaatactagtttaggcatgctatcttaaaccatatgtagtgctattttatatatttcttggttatggacaacagtgcatgttttgaggccactcaaaaaacaagtatgggactcatgatatttattacaaaacaatttaactaaggaaaattatattacaatttgctctttgccaaactataaacatcacttgtttgggcatgttatctcataagctatgtggaaagatttcaaatgtttcatggttatggacattaatgtaagtttgaagcggttcaaagccctaaatgatgtaatgtttagaacggtaatttttacaaaaaaggacccaaaaagttttgtcatcaaagttttcgcaatatactgatttgggagtaaagggtcatgatttcgtgcatgttttctcgaaatattgtggcatgaaccatgcgaaaactttgaagctttttgaagcactaaattatgtggtagatttaaagaatgatccaacatattgtttcacatgctccatcatcaactaaagtttaacacaattaataatttgagtatgggacccacataattagatggtcgcatgacgattaaagttcaatgttttaaagaatgaggtaactttaaaagtatttgaattgcaatattcagatttttgaagataaactattttgcagaattacgacctctattaacggaaaaatagttaatggaagaaaaattatattttcactttcattactcttttctaaatgccgtactgtaagacatacttatttaggcatgttaccttaaaacttatatagtgctatttgcaatgttcctcagttgtgaacacatcaacccaagtttaaggccgatcaaaacttgagtatgggactaatgtgtattaattttgtgcaagtttactgcatgatatatcgatttctgatgtgcgtcaacttccttgcattttaaagccctaatattgtattgtttagacagatagtttatacggatggacccaacttgttgtttcgtgtgcaccatcattaacccattttcaagacaaccataacatgagtatgcgaccctagattgtggcatgctagcactagatttaatcatatggaggacgaggggattctagaagcgcttgaagcataacatatagatttttttcagatcatcaatttactgtaggcgtgagctatccaacatgttgtttcacctgcttcatcatcaacccaagtgcaagacaacctatatcatgagtttggggcccaagatattagatgttcgaatgcaggcactatagtttgtagacatgaagaataaggtaactttagaaatgtttaaagtgcaacatgttttttttagatctgtaattttccggagttgagagctatatttatgcaattgtgcttttattttgatccatgttttaatatactttg

SEQ ID NO: 457 - DNA, 2468 bp, Zea mays
tcccttcgttcctcgccgagcacatgaatttttttgccgctgatattttccagcagccaacacctagaacatttctgctccctctccctcgtcatacgcaagccgactcatgtgatactttatcttatgtattggatgccgctcatccgcctgctgcatgctttggttccctaaaaaaaactcattttgtccaccatgccgtttaccagggggatttttctccctcacccttatcatctcatgacacctctcctcatcctgttgcttcctcctctgctcaaatgcggcagccaccatttgggtgggtgctcgtctccctgctcgctctattccccaccgtacccctcaaccttggagctcgagcgccactagggccacgcccagcagctccttgaacgcgcgcgccttccgagcatctcgttcctttgtcggccgttgtcttctacctccgtcctaatcgccgctggctctctccccgtcgtgccttggtccatggccgccggagttttcctgtcgtcgcgtcctcggccgccagcgctcgtccgaggctgtcgctacgtccaggtctaggccttgtccttctgcaagccggcgccctcgactcctcagcctggcgcgctgctcccttttccctggctctgtgcacgagctgctccagcttgccggtcatcttctgctcctccccatgccggtgatgttccccaccaccgctccagttttcgtgctcgactcctggatgcctcggctccgcggtactcgccgggtctcatcctcgacgtcggtcgcccctggtgccgaccccccaacctctggtgtcacgcgccttctcatcgtcctccaggctatgagctccatccttgcgtcacgcactcgccctttggctcccatcgtgtttgccgtgcagtcacggccttcgttgttacttgttgcttccacaagtgcccatcgtcgcgaggctctgtttcgctgcactcgctgtccatggtgctcgcccacattccctgacctcgccagccatccctatcctctgttccatctctagctgcgccgtctcaacttgatggtcaaattttgcaacgccggtgtcgtcctcccctgcctccccgtgtccctcctcgttgatcttgctaggacagcgcctcgacgccccatcacagcagcccgtagtggaactctagtgcttgtcgttgattccctatcgtctccgacctttgcctcgccgtcgtcgttctgtcacctcgcctcgatgccggcccctacgtgatgtcttcaacttgtgttcgcgccgacaaaagaatcccaagagaatgtggaggagcaagctccaaatcgatgcccaccaaatgctcggtgaaaggcttgaacaaggatcattgtcgtttgtttggattgctagtcaatatggtaatcgtactctgattcactattctagctaattaatttgatagatggattagagggatattaatcgtgatgattattctatctatagcttagacgcgtcgtgggtgtatttcatgtatgataaaggtcgtaattgtgtgctgtttggttactgtcatgattgggaagtagtcgcgaggtgtgttaaagtataggttgcagtataattcatatgaagaatgcattagtgggcatgtgccgagtataattgtattggtgctacatagatggatttaatagttcaaatgcttagccgataggttctgtcaatcttgtaggtgttaagtttgtttatttggggaaatggtgtcttgcctaatagttttcacatatgccgtgtctatagaattggttgatgttatagactttggaataggagtttggatgttttgttgtttgatctttatgctagacccggttaagctgaaagaatgtaattgtcaagattgcagttttgcagggatccatgcttttgctaatgtgttatccattggatctaggaatattgttatgtatatgatagcttggagtggtatgtaatttagtccggtcacgtggtctagaaagttgatgtgcttatgttcttgttttagatttaaatttcttagaccaatgagtttaaaattattaagtttttggtgttgaactttaactaagacacgtagagcttacgcatagttatcatttcttaatgattgagttagatcgggttaagctagaggaacatgatttttatatttagtgagttaaagatatctagtattgcttgagtgttgtaatgtctctcctctaagtgtttaatccccttccatgtggccatatttagtcattgctattcctgcttctattcactcatgtgcattatgcatatcatttagctacgttaattgatcacgtgatgtggaggccaaaagctggattgatctcaagacgatgctgatgggtgaacttaaagatggatgacttgaacaagtgtcagaccaaaagttgatcgtcatgtaacaacactaacttagtgttatccc

SEQ ID NO: 458 - DNA, 2467 bp, Zea mays
acataacatgcctaaactacttttgtttatagtctcgcatagagaaaattgtacttaaaattggaatgaatttttttctatatctaattcttttgttacaaatatcattggtataactgtaatagaataataacaaagtatcttaaaacatggatcaaaataaaaacacaattgcagaaatatagctctcaactccttaaaattatagatctaaaaaatatacatgttgcactttaaacatttctaaagttaccttattcttcatatctacaaactatagtgcctgcattcgaacatctaatatcttgggccccaaactcatgctataggttgtcttgcacttgggttgatgatgaagcatgtgaaacaacatgttggatagctcacgcttatagtaaattgatgatctgaaaaaaatctatatgttatgcttcaagcgcttctagagtcccctcgtccttcatatgattaaatgtagtgctagcatgcgacaatttagggtcgcatactcatgttatggttgtcttgaaaatgggttaatgatggtgcacgagaaacaacaagttgggtccatccgtataaactatctgtctaaacaatacaatattagggctttaaaatgcatggaagttgacgcacatcagaaatcgatatatcatgcagtaaacttgcacgaaattaatacacattagtcccatactcaagttttgatcggccttaaacttgggttgatgtgtttacaactgaggaacattgcaaatagcactatatatgttttaagttaacatgcctaaataagtatgtcttttagtacggcatttagaaaagagtaatgaaagtgaaaatataaattttcttccattaactatttttccgttaatagaggtcgtaattctgcaaaatagtttatcttgaaaaatctgcatattgcaattcaaatacttttaaagtaacctcattctttaaaacattgaactttaatcgtcatgcgaccatctaattatgtgggtcccatacacaagttattgattgtgttaaattttagttgatggtggagcgtgtgaaacaacatgttggatcattctataaatctaccacataatttagtgcttcgaaaagcttcaaagtttttgcatggttcatgccataatctttatcgagaaaacatgcacggaatcatgacccgttactcccaaatcagtgtattgcgaaaactttcatgacaactagtccttttgtaaaaattaccgttctaaacattacatcatttagggctttgaaccgcttcaaacttacattaatattcataaccatggaacatttgaaatatctttacatattttatgagataacaagtccaaacaagtgatgtttatagtttggcaatgagcaaattgtaatgtaattttccttggttaagttgttttgtgataaatatctcccatacttgttttttgagtggcctcaaaacatgcattattgtctataaccaagaatcatttaaaataacactacatatggattaagatagcatgcctaaactagtattgtttatggtctggcatatagcaaattgtaattaaaattggaataaatttttttctatatttaattcttttgttataaatatcattgatatagttgtaatagattaaaagtagaattacataaatatagttgtcaactctagaaaattactgatctaaaaaatatacatgttgcactttaaacatttctatagttacctcattcttcatatctacaaactctagtgccagcattcgaacatctaatatcatgggccccaaactcaagctataggttgtcttgcacttgggttgatgatgacgcatgtaaaacaacatgttggatagctcacgcctatagtagattgatgaaacatgttggatcattctgtaaatctaccacataatttagggctttgaaaagcttcaaagtttttgcatggttcatgccacaatcttttcgagaaaacatgcacgaaatcataaccctttactcccaaatcagtgtattgtgaaaactttgatgacaaaccttgttgggtcctttttgtaaaaactactgttctaaacattacatcatttagggctttgaaccgcttgcaaacttacattaatgtttataaccatgaaacatttgaaatctttccacatatattatgagataacatggccaaatgtaacaccctaaaaattaaaccatgtttataatccaaatatggtgtgtcctatggatgatcggaggctgtagatgtatagatctcatcgagatgattccgatcaattactagtttgccttgtttggagtctggatgagtcttttcgagtgtcggttgatctgagcaattggaaattaggattgtggaagttttattctatttatacctccctaaccctagaagcctcccacccctagcagccatcacccttctgtgccttgcccc

SEQ ID NO: 459 - DNA, 2464 bp, Zea mays
gcgatggggaggggccgcaaacgcaaacatagaaccgtaccatgagtggatgtttttgacaacggcaatcaacagggaggcagatttgatgaagaaggcaaatatataggtgtggtaatacccggcgtggtaatgcccaacaggacagatttggaggaggagatgccgagaatgacagatgacaagctacggcgggagatcatgctcattagccgcatgcacccttggatccaagtgtttctcaaaaatggacgcggaagtaacctcatccgctgcccgttgctcgaggccgaggcgcgccgccggggcatcaacacgtgcatgaaggtttttgctgacaaccaataaaatttctgtactaaatttcagatttcctctactatctctgttgtgtcttttttgattttattaaacagcgaaataacattaaagcatttgtgccaagttttataatggcatttaaatgaagccctctcgatgaatggtgcacaattccaattttctcgaaactacatggtgcataattgagagttgatgactcaataattctataatcagttagagggacacgagactactgatatctttgcttttgtgtccaccacatagggttgtgcatttaactatatcttactttcctggaatagtctgtgttcatggcttcatgataattgattcttttccttagaaactaggccatcatatgtcgtataaatttatatccctaatccctatgatgtgcccttgccctatcactatcaggttcctgatgtgttctctatcaggttcttgaggtggtgccctatgaggtagttccctgtcaggatcgtgatgtcggtgtggttctcctggatgatgaagatgtgcaaccagagagacacactgagaaacggtaagcttcttttctttttactggaacggcaaatacattatctgaaacgagttcatgacagctactatccattaaggtgaacattgtgcattctttcagaacattggattcatggagagttttttctcttaacttataatgttgtaacttccataattttttacgtgaacagggatgattcaaaagctaaagagctcagtagctcggatattaaatgccttaatcctagagtttctttgtcatcatcagtgataaactactacatagagtacgaatgcatctccttgtcctgatgttggtaatatattgtataataagaattataaagtcaatgttgtatgacttgctggcaatgaaatatctagagcatgatcaagctatttaaaattatgtgagatcgtttacacttctgccaacaacaaacccttgtaggcttgtaatccaaagaaatcattcgaattgcacaaaatatattaaatctgcataaagttgggcattctgaattcatatttattgcatcttatatcaaaaatctgaatttatattgcaaaaacttgcccctccccactagccccacacatgcgcacaaaagaactgaagatctctctcctgtcatctgaagtttgaaccaaactataatcagattcactcaaattttgaattttgagtaacttttcattcataggagaattattaggatggaattttattttctattttctttgggggtggggttccaagtgtaccaaactttgtcttatgcatgtgacaggtacattataaggactaagttgtgtggtaatgattacagagacaaattctacatatttaatacatttttttataccaacttaccaagcttgaaaaagttttgaaggaggatgaggaggtacctttttttgtctcaaactcatacctcttattccaagtgcatttcgtggcatgtcatgatatgcaaacgtggtgagttcactatggtggatacatgagagcttaggagtagaagcctcccatatttccatgcaatcagattattagctgcagcatcaataataccatcttttatatcagtgctacaattgctacttgatagtagcctaattctgtaacggttctgtagatgcattgtatttatagctactgttctctaccttctattgttttatcattgttgtattatcttcagataataatgttgggcttcaatatttgtatttgtctttgatggatttttattgtaggacaactactcgaagttgagaagatggtggaaagatatcaatatatatcacaaggcataccttatcttgccaatctatggaaagtgagttgctacttattcatacataatcccaaaagagtttacattgcagtttggtatccctaagcaagcaaaatatatgacccttttgaccgtgcaattataagcttttataacttctcatatctggatctctacttgaaaacatgcatggtttagtatattacattgaagataacttcattttataattcgattgcctatgacacttggcctgaaatgcagttgaattcaaaagctttaggttgctc

SEQ ID NO: 460 - DNA, 2460 bp, Zea mays
cacactcacacacacagtctaacacatagcattcctttcacctggctgaaggcccctctcagtagctacttcttgcagtactacctagatgctttgttgtgcactattaaagacaattattcttgtgttttcagatgcctttcatgggtaatctattaggcactacttaccttgcacctgattacatgaacaattgtgaagtttacttgaattcatgatttctctgaaattgtaaattttgtgtttcataacccatgtgttcatgtatttttctcttctttttgcatgtagtgctattgttatcaattaaatagccaggtagtgctctaatattcgaatattgataaaaatgaaatcccaatcataaactaagttcaaatattatcattctatatacattatcatgtgttatgtgttgtacattctccttgtggttgcaactttttattaaggatttaagcatccaggtgcatgagcctaaaatgtcaagtattcaggtcagaggcagtagttattatacgacacttatttaacagttgtccaatccatttcaggaaattttatgttatcaattagacctgatatttcggaacattctgaaaatattagccggttagcttcagtgaagtggtccgaggacatcattggtgaaaaaaccatccgaatatctgggattattgaaaaacttaactataacctaaggaaggccttcaatgttgattccatgaagtcttctttcagctctctaagttgccctgttttttccaatgggcatcatgttacagatcttcactttttaattcatattcttggtagagatgtgcctgtgcagcctacaaatggatctcgagttgctgaaagaagtgcaccagttgctttacagttccagagacaaattttcatatatccaactgtgcaagtgtataatttcttgcaaacagacatacacgtgcttctgacagattgccaacagggtaaactcttatgtacgagcatttagttttggggaagtggatgttcctgttgaaggaagcaaacaataaaaagatatgttttacttaattcttttgtatactataatacaggaaacgtcatagaagatggctttggcggtattggcaagcagacaacaatcataagtggttcaagtgcttatttctatgtgaatcctacaatgtttaatttctcagtcacactgatttcatatggttcaaagtctaagacagttaatagtagtgattgggttaagagaatgcaaaagcagactagtaaagctcagtttcttgacatgcaattagaatttgttcctgggaagtttcattctaatttgagattactacgtcaagagaaaggcttgttggaggtagaatggcgattttgatgttgttgcttcttaatttcccattgacatctgatgaaaccgcttgacttcgagaaatttaaaagtttgaagatatcaaatgatctatctgatatccagtctcttgattgtgcaggttgctgtattcacaagatacacattacacaataccagtgactacatgctgcagtgcacagcttcacataaaaaatcactacctgtgtatgtaaatttgtgtactaggtaagcaatcttacatgattgctcataaaatgctgaaatcttgcaggttggaatctggaatgaacagtatcattcttcctccacaacatggttgtattttgccctcaatgtcaatgagctcctggtttataaagtaagcagtcacattagttttgttctctgctgattgaaaaaaatggttcttgattcaacacagcggagatagctattttgcacaaaatttcattaagcctctatatcttgtattgtagagtttgcttttgcaaatagtcaatctggtatggttatgaacactttgttcctcacctaagcctcagcaggtttgtttgctctagccctagcccaatgatagacttgcctgatcataacacagttatttcagtactatagattatgttagaaatatggccaattgcccacctgatgtggtatcataatcatatggctggtttaatggttcctgccagaaagttcttcataaacagcaacgtgcatcgtctgttccatgttacaacttacaagcacacattttttcttaacttttggtcttattcaaggtgaggaccatataattcatatctgttcctctacatggctgtttagcctgtttacacgctgtgtaaatgctacacaatggcttgtcgtgtttgtttaaccagccacttatcctgtttaatcgccgtttagtctgtttaaatggccatttagcctttataaacagctaaacgataggttactgtttagtccgtttaaacgtttacgctaacattttgtttgtgaaacattcttcattggctaagataattttgattgttgatgatatagaatataaagtcaggaaagtggttccattttcc

SEQ ID NO: 461 - DNA, 2458 bp, Zea mays
tagcattcgaacatccaatatgttaggccccaaactcatgctataggttgtcttgcacttgggttgatgatgaagcatgtgaaacaacttgttggatagctcacgtctatagtaaattgatgatctaaaaaaatctacatgttgggcttcaagcgcttctagagtcacctcattgttcatatgaccaaatctagtgctagcatgcgacaatccaattctatggatcgcatactcctattatggttgtcttgaacatgatttaatgatggcgcatgcaaaacaacaagttgggtccatccataaaaactgtttgtctaaacaatacaacatttagggtttccaaatgcatcgaagttgacgcacatcataaatcgatatatcatgcaacaaacttgtgcgaaattaatacccattagtcccatactcatgtttcgattggccttaaacttgggttgatgttttcacaactgagaaatattgcaaatagcactattaacatgcctaaacaactatgtgttacagtacgacatttagaaaagagtaatgaaagtggaaatagaactaatttcccaataacagaggtcataactccgcaaaatagtttatcttgaaaaatctacatattgcaattcaaatacttttaaagttacctcattctttaaaacactgaactttaatcggcatgcgaccatctaattatttggtttccatactcaagttatttattgtgttgaattttagttgatggtggaccgtgtgaaacaacatgttggatcattctgtaaatctaccacataatttagggcttcgaaaagcttcaaagttttcgcatggttaatggcacaatctttttgagaaaacatgcacgaaatcatgatcctttactcacaaatcagtgtattgcgaaaactttaatgacaaaccttgttgggtcctttttgtaaaaactaccgttctaaacattacataatttagggctttgaaccgcttcaaacttacattaatgtccataaccatgaaacaattaaacattttccatatatcttatgagataacatgctcaaccaagtgatgtttacggtttggcaatgagcaaattgtaatgtaattttccttggttaaattattttttgataaatatcaagagtccacataattgctttttgagtggcctcaaatcatgcattgttgtccataaccaataatcatttaaaatagcgctacatatagtttaagatagcatgcccaaagaattattgtttatagttcgacatagagaaaattgtaataaattggaatgtttttttatatttaattattttgctataaatatcattgttataactataatacaataataacaaagaatcttaaaacatggaacgaaataaaagaagaattgcgtaaatatagatctcaactccggaaaaatatcgatctaaaaaaatataaatgttgcactttaaacttttctaaaattacctcattcttcatatctataaactatagtgccagcaatcgaacatccaatatcttgagccccaaactcatgctatatgttgtcttgcacttaggtttatagatgaatcatgtgaaacaacatgttgcatagctcacgcctatagtaaattgatgatatgaaaaaatctacatgttgtgcttcaagcgcttttagagtcaccccattcttcatatgaccaaatctagtgctagcatgcggcaatctagggtcgcatactcttgttatgattgtcttgaccatgggttaatgatggtgcacatgaaacaacacgttggatccatccgtaaaaactgtctgtctaaacaatacaacatttatggcttcaaaatgcatcaaagttgatgcacatcagaaatcgatatatcatgcaacaaacttgtacgaatataatacccgttagtcccatactcatgttttgatcagccttaaacttgggttgatgtgttcacaactgaggaacgttgcaaatagcacaatatatgttttaaggtaacatacctaaacaagtatgtcttacagtacgacatttagaaaagagtaatgaaagtggaaatataaatcttcttccattaactattttttcattaattgaggtcgtaactctgcaaaatagtttatcttgaaaaatctgcataatgcaattcaaatacttttaaagttaccgcattcttgaaaacaccgaactttaatcggcatgcgaccatctaattatgtgggtcccatactcaagttattgattgtgttgaattttagttgatggtggagcgtgtgaaacaacatgttggatcattctgtaaatctatcacataatttagggtttcaaaaagctttagagttttcatatggttcatgccacaatcttttcgagaaaacatgcacgaaatcatgacccttttattgacaaatcagtgtattgcgaaaactttaatgacatac

SEQ ID NO: 462 - DNA, 2456 bp, Zea mays
  misc_feature (1003)..(1004): n is a, c, g, or t
  misc_feature (1384)..(1384): n is a, c, g, or t
  misc_feature (2056)..(2057): n is a, c, g, or t
aagaattaaatatagaaaaaatttcattccaattttaattacaatttgctctatgcgagactataaataatactagtttaggcatgctatcttaaacaatatgtagtgctattttatatatttcttggttatggacaacagtgcatgttttgaggccactcaaaaaacaagtatgggactcatgatatttattacaaaacaatttaaccaaggaaaattatataacaatttgctctttgccaaactgtaaacatcacttgtttgggcatgttatctcataagatatgtggaaagatttcaaatgtttcatggttatggacattaatgtaagtttgaagcggttcaaagccctaaatgatgtaatgtttagaatggtagtttttacaaaacgacccaacaaggtttctcatcaaagttttcgcaatacactgatttgggagtgaagggtcatgatttcgtgcatgttttctcgaaaaggttatgtcatgaaccatgcgaaaactttgaaactttttgaagccctaaattatgtggtagatttatagaatgatccaacatgttgtttcacatgctccaccagcaactaaaattcaacacaatcaaaacatgagtatgggacccacataattaaatggtcgcatgtcgattaaagttcagtgttttaaagaaagatgtaattttaaaagtatttgaattgcaatatgcaaatttttcaagatcaactattttgcagagttacgacctctattaatggaaaatagttaatggaagaaaaattatatttccacttccattactcttttctaaatgtcgtattataatacatacttgtttaggcatgttaccttaaaacatatataatgctatttgcaatgttccttagttgtgaacacatcaatccaagtttagggcacatcaaaacattagtatgggactaatgggtattaattttgtgcaagtttaatgcatgatatatcgatttctgatgtgcgtcaacttcganncattttgatgccctaaatattgtattgtttagaaagacagcttttgcggatggacccaacttgttgttttgcatgcaccataattaatccatgtacaaggcaaccataacatgagtatgcgaccctagattgtcgcatgctagcactagatttggtcatatgaaagatgaggtcactctagaagcgattgaagcataacatgtagattattttcagatcatcaatttattatttgcgtgagctatccaacatgttgtttcacatgcttgatcatcaacccaactgcaagacaacttatagcatgagtttggggcccaagatattagatgttcgaatgctggcactagagtttgtagatatgaagaatgaggtaactttanaaatgtttaaagtgcaacatgtatattttttggatcggtaattttccggagttgagagctatatttatgcaatcatgcttttatttcggtccatgttttaagatactttgttattattctattacagttatatcaatgatatttataacaaaagaatgaaatatcgaaaaaatttcatttcaattttaattacaatttgctttatgcgagactataaacaatactagtttaggcatgctatgttaaaccatatgtagtgctattttaaatgattcttggttatggacaacaatgcatattttgagaccactcaaaaaacaagtatgggactcatgacatttatcacaaaacaatttaagcaaggaaaattacattacaatttgctcattgccaaactataaacatcacttgtttggacttgttatctcataaaatatgtaaaaatatttcaaatgtttcatggttatgaatattaatgtaagtttgaagcggttcaaagccataaatgatgtaatgtttagaacggtagtttttacaaaaaggacccaaaaaggtttgtcatgaaagttttcgcaatacactgatttgggagtaaaggttcatgattccgtgcatgttttctcgataaagattgtggcatgaaccatgcgaaaactttgaagcttttcgaanntcatcaaagttttcgcaatgcactgatttgggagtaaagggtcatgatttcgtgcatgttttctcgaaaagattgtggcatgaaccatgcgaaaactttgaagcttttcaaagccctaaattatgtggtagatttatagaatgatccaacatgtttcatcaatctactataggcatgagctatccaacatgttgttttacatgcgtcatcatcaaacctagtgcaagacaaactatagcttgagtttggggcccaagatattagatgtttgaatgctggcactatgaagaatgaggtaactatagaaatgtttaaagtgcaacatgtatattttttagatcagtaattttccggagttgacaactatatttatgtaattctgcttttattctattacag

SEQ ID NO: 463 - DNA, 2453 bp, Zea mays
ccccactcaacggttagggtttcccacacttatgtctctcaaaactagaagggatcccttcgcagagctatgcagtcagtgcatcatcaagaaaatagttctatttcatcatttctaatgtcttcctctgctatacgcttggaagcacattgttcaaatctttgacaaccattctcgatcatcctgccgagattgtgaatatgcttgccaagaacatgtgaagtgcaacattattcctcgcattagtcgtgctgaagcaattttgtagtctcacttttagagtgccgaattatctatcttaacatctttgagtttgatagcaactttacaccataactctttgactgttgtcattaaccgattctttgttggctatgtccttgagctctctcactaggttccgctcattatttccacatgaaaacgaagtaccaatgcaaagcagaggatgaagtgaaaacaacaggggctcatggggatctaggatgtagcaccagggttctaaatgatatgatcatcactagtacttagtcattgcatctttgattagtccatttggtgttgcatactttgcccttggatggcttatagctaaaattaggtgagccagacattcttttctttttttttgaaacaatcaggtagaagagcttttgattatattgaaaaaagaaaaaaaataaccatgctgggtaaaacaatagtgcaacgagtgcaacacttcagtgtttgcacactttggtatccattttgttaatttcgtaactttttatgctattttgggaattatttcttatgtacatgatcttgttttgttaattagttgtttggtgaagttggtgattgatctgccaaccttaatccaatgtagattctgatagttatgttccttgcaatgagggctatggacgaatgtgaccacacatgcacacatggatcattgtgactctgatggtttactagaccaccatggtcggcttcatccccatgaaaaagcttttcttgtgcccctccttccaataagcaaaatctattactactctattaagagtgcaaccagagcgtccacaccctgtgccctcgcccgcacgccccctccccacgcgtgcatggaaccacccagcccccgtcgtgccctcgcctgcataggagcgaggggccatgcccctaccccagcacctcgcccccaccgtgccccaagatagcccactgctgccctcgccactcatccccacaagcgatgccctaagccgccagagacgtcgcctccgtgcaccacatcaccgtgcacgatgcccgcccatccacgccgccacacccatcctcgatgccacccctaccctgtcgtgagatgctcgccagcgcgattgccgccccaccgcgacagcccgcctgcccccagcattgactccctctcctcgctttgctacctcgacctctccaggaaccgcttctacatgctcgtgccggcccgcctcgccaacttctccagcctcatccacctcaacctctctcgcaacaacttcacttctggcttccccacagatgggatctagcagctctaccgtgtggtgatgcatcgcaacgccgtctatgacaccttcatcgtagctagcaccttcgtgcgcgagcaggtacgccttccctccctccccttcttactctgccactagatcctagatctgccattccatctcaaagggttgtctcttcgattcctaatcggttatctgtcgtttgcaggcggtggactacgacgttcacaagatctggaagatgaacaaccttggggtaacatttctcttcctagcctccctttcgctctgttgttccattcttatcaagacactgtagttgtcatgggccaatctgtgaaggaaatcaaggttgtcctgacgatgaaaaacctatttgatgtgatctgttctagattaaggtcgtttgcaagagaatgtcgatcattatctgtgtgattaggtgtgtgtttagtgcctgatcccattttgtccttctcacttttagagtgtggtcctctcctgtcatccactttgctgaatcgctaccctggactagaagaacaggggagtggctcagtaggctccaaggagttccctcccactgggagcttaggagtagagatagagaagggtgatttggaagcagttgctaatgtgaccaagccaactgcgggtgggagtgtgtgcgaaattaggagaggataaccaggcagaagtgggcggtgaagagaatgctgaggctataatgcttgtggagccaagttctctagacactccagttgcggagggttccaatgagcttgagcaaggtaatgatgccagtttggcagaaactgaccaaattgggaatcagattgaggctgcctatgatgaaaatgaggatgaccaaattggaggtgataatcatgcaagaactttttttgtttactagaggat

SEQ ID NO: 464 - DNA, 2453 bp, Zea mays
atcctccagtaaacaaaaaaagttcttgcatgattatcacctccaatttggtcatcctcattttcatcagacagcctcaatctgattcccaatttggtcagtttctgccaaattggcatcgttaccttgctcaagctcattggaaccctccgcaactggagtgtctagagaacttgcctccacaagcattatagcctcagcattctcttcaccgcccacttctgcctgtttatcctctcctaatttcgcacactcccacccacagttggcttggtcacattagcaactgcttccaaatcacccttctctatctctactcctaagctcccagtgggagggaactccttggagccttctgagccactcccctcttcttctagtccagggtagcgattcagcaaagtggatgacaggagaggaccagactctaaaagggacaaggacaaaatgggatcaggcactaaacacacaccttaatctagaacagataacgatcgaccttctctcgcaagcgaccttaatctagaacagatcacatcaaataggtatttcatcgtcaggacaaccttgatttcctccacagattggcccatgacaactacagtgtcttgataagaatggaacaacaaagcgaaagggaggctaggaagagaaatgttaccccaaggtttttcatcttccagatcttgtgaacgtcgtagtccaccgcctgcaaacgacagataaccgattaggaatcgaagagacaaccctttgagatggaatggcagatctaggatctagtggcagagtaagaaggggagggagggaaggcgtacctgctcgcgcacgaaggtgctagctacgatgaaggtgtcatagacggcgttgcgatgcatcaccacacggtagagctgctagatcccatctgtggggaagccagaagtgaagttgttgcgagagaggttgaggtggatgaggctggagaagttggcgaggcgggccggcacgagcatgtagaagcggttcctggagaggtcgaggtagcaaagcgaggagagggagccaatgctaggggcaggcgggctgtcgcggtggggcggcaatcgcgctgacgagcatctcacgacgggggtaggggtggcatcgaggatgggtgcggtggcgtggatgggtgggcatcgtgcgcggtgatgtggtgcgcggaggcgaggtctccggcggctttgggcatcgcttgtgggaatgaggggcgagggcagcggtgggctatcttggggcacggtgggggcgaggtgctggggtgggggggaatggcctcgctcctatgcaggcgagggcacgacgggggctgggtggttccatgcacgcgtggggagggggcgtgcgggcgagggcacagggtgtggacgctctggttgcactcttaatagagtagtaatagattttgcttattggaaggaggggcacaagaaaagctttttcatggggatgaagccgaccatggtggtctagtaaaccatcagagtcacaatgatccatgtgtgcatgtgtggtcacattcgtccatagccctcattgcaaggaacataactatcagaatctacattggattaaggttggcagatcaatcaccaacttcaccaaacaactaattaacaaaacaagatcatgtacataagaaataattcccaaaatagcataaaaagttacgaaattaacaaaatggataccaaagtgtgcaaacactgaagtgttgcactcgttgcactattgttttacccagcatggttattttttttcttttttcaatataatcaaaagctcttctacctgattgtttcaaaaaaaaagaaaagaatgtctggctcacctaattttagctataagccatccaagggcaaagtatgcaacaccaaatggactaatcaaagatgcaatgactaagtactagtgatgatcatatcatttagaaccctggtgctacatcctagatccccatgagcccctgttgttttcacttcatcctctgctttgcattggtacttcgttttcatgtggaaataatgagcggaacctagtgagagagctcaaggacatagccaacaaagaatcggttaatgacaacagtcaaagagttatggtgtaaagttgctatcaaactcaaagatgttaagatagataattcggcactctaaaagtgagactacaaaattgcttcagcacgactaatgcgaggaataatgttgcacttcacatgttcttggcaagcatattcacaatctcggcaggatgatcgagaatggttgtcaaagatttgaacaatgtgcttccaagcgtatagcagaggaagacattagaaatgatgaaatagaactattttcttgatgatgcactgactgcatagctctgcgaagggatcccttctagttttgagagacataagtgtgggaaaccctaaccgttgagtgggg

SEQ ID NO: 465 - DNA, 2450 bp, Zea mays
catctaaaaatatataatcgagatgtgatcttatgtgaaaactcacacaagtagacgcagcatgcatgaccataacgattaaataatatataactatcgatgcttgaaccaaatcagttttataaaatcttggtcttacaaatgcatctatatatacacgagaccccacatatctcaaactacataaaaatattgtaatagaccaaacgacctaatctacgagaaagtatatcgtaataacaaaaccttaatattgctatcgtaataacaaaaactaaatcttgctaaaactattcattgtcctaaatcttactatcgtaataaaaaaaacctaaatcttgcttaaacccttcattgtcctaaatcttgctatcgtacgtagtaacaaaacctaaatcttgctatcgtaataacaaaacctaataaataaatcttgcttaaactctccattgtggatccttatccattatggccccctgcagctggtcgccggtggacgaagtggtggggtggcgcgctttatccgtctccattgtggccggctacttgtgctgctgctcgccggtggacgaagacccttgttcttcttgttcttctgatgacgcttgtccgagaggcatggcaagcgtaagtctaaggtcgagcttgctggcaccatcgacgtcgctgaagttgttagccacgggaggtgcaggtggcgacggctcttcagttttagtagggaagagcgcaagtgttacaggcagcggctgacacggcctcttgttgttcttgcgcatgatcggcgggccatcgtagtgcttcctcttgtggccaccaagcgcagtcccggtggtgaactccatgcggcactcctggcacacgtacgtcgcctgtgcgttgctgccgcggcggagcgcagcgagagagtcgcccccgccgttttgcatcatccctgtggacgccgccgcagctctctgcttgttcctgtgcccggctacatggccacctagcgcctgttgcgtcgagtaggtcatgccgcatagtttgcagatgtactcccgcgcgggtgccggcgagtcgacgacgacgaccgccccagacgaggcgccgcggtggtcgctgatcgtgtcgtcagactcggacgaaggcgtgggcgacggaagcggcgcgccgacctggcccatggcgaccaataccatcttcctgccggtgaacgtgctgcggatgtgcgtactcgccccctgcgcctcgctcgcagaacgtcgaggcggtgtgctctgctggggcttgcggttgtgggcgtaggtttaaataggtgagggatgagagttgttgcgtgcgcgaaattacgcgggaactggactccgatccccgcagcggcagcaacagactcgagtccgttcgctggactaccaggcgagataatatctggttacttctttcaatagacgcacgcagcaacagactccatattactgcctacctttctagacggatcagcttgaacgtgatatggatccgatctggctacgcctacgatacagacgctgctaataaattttattttctcctaataaattttatggcaaaaataacattttacttcgatgcaacaaaatcaatcgattttctgagatatctatatggctcgtagtccccttatctggcagttaaaactatttttccgtagtttcttcgtcttgtcaatgctaggctatcataacatatttcaaatcggactttgatcgatttcttcaaactctttcatgtcttgaaactagtcggcgacacggagggtcaacaaactgagaaaccgatcctgcttacgggaccaggaaaaggtacgtggatcttcgctcggctataagtgttgttttctcattatttccgcacaactatgttagctcaatatatatgtgcaacatattcatgttggacatgctctagacctatccacttgagtccttgttcggttattcctagtgtgtattgaatactagcctaccgaacaagaccgtaaatgtatcgttgtctgtatttcgtacgtgcagtattacacaaagcagcagaagacagccatgctgaacgggggcttaattcctcttttattcgcaatctattcttctctagagaactataaagaagggttatagcggtccaagtatttacaaatctaagaatatatactctttttattaataaaaccggagaggctttcaagctatctctgggtttcatgagtttgacggccacgacacatgccgacacgtgtccgcgtgagcgtccgagctcggacccgactttttcattcaatcgagcgaagctgcgaaggatggtaacatgcacattttacccgtgtgcccacggataaaactctatagaatgcgcgtttgggtgtgagtttgtatattgctattgacccattagtatcaggaagccccggataggtagacacgcgcgcgtttgca

SEQ ID NO: 466 - DNA, 2445 bp, Zea mays
ggtgtttgtggaccccggggtgttacaagatcctgatccacgagacccaatttgtagtagaaaagcatggataaagttttgttgacacctagaggagacggatcctacattgttcgactccagcgcactaattgggcatataaatgaacccaacaatgactccaactatgagggatgagctatcccatagaacacaaatcaccttaagggagaaaattaagttgggtgtatgatcgcaattaaatgcgagattactttcaggcctgctccgacggtgtatacaagcgatactatattttttaaacccgctaaccaccggtcataaagttgatatagttatgcctcatttggatcagctaaactcgacttcagctaagacttgtgttttagtcttttgttgatcttcattgttattagtttcaagatctttatgcttaacaaaagagaacaattttcgcagcgcatcctcatcaaatggcataatatctttggcattcgtcgtcactacttgtagtctaacaatttcgtcatcctttatttgggctcccagttgcagctcatcaacattatgcaaaaccttttgtcctgctttagtagcccgctttacctgtaagttcttcctcttaatggtcacaccataacattattccattgtcttaagttgtttccacacataattatttttcatttgttatgctgaaatttcattgtgcttctctaatcttaagatctcgtaagatttctttagtttcttaatctcttccctaatatcttctctatttttggagatccaaattgtcaatactaatctataaaataaagtttagtcccgacaatttggatcgccaaaaaagtgaggaagatattaggtaacagataaggaaactaaaaccggttccaagatcatgagatcagagaaggacaatgaaaattcagcataactggcagaaaagaattttgtgtgaaactagcttaagacaatagaagaagattacaatggaaccattaagagaaagaacttggatgtaaagcaggctactgaagacgctaaaaagcttttgcataatgttgatgagctgcaattgggtgcccaaaacaaggatgatgaaaattttaaactacaaaaagtggtgacaaatgtcagctgcaaaaattgtcatctttggtcaaagataaagatcttgaaacttataaaaataaaatcaactagagactaaaatgcaagatttagttgtagtccagattaactaatccaaatgaggcctagctatatgaacatgtggttagtaggttacagggttcttattgggtgagaaacttctgatgtcggtggattttgctatgtgggtaaacctgaatcatgtcacatccacacttcaagagactaaacacaagtgttaggtgcagtttagtttaactgatccaaatgaggcccaactatatgaactttgtgacatatggttagcaggttactggggtcttattgggtgagaaacatcttaggctggtcaaattttttacgtgtgtaaaacctcaatcatgtcacatccactcgtaagaagactcggttgtattcctattaatagaaatggttgtttcctctctaaaaataagttgactaacttggtctctatagacaagtttagtgacctcgtgggcaatttactctagcaggccccaaagtcaaacaacaagttacctacttctccataagaatgtagcaatcaataacatgcatgtttgtcaaactgacaactaagacccaattgcagcaagagcgcgtgacagttcctaaccacgagacccaatttgcagtagaaaagcatgcataagattttgttgacacctagaggagacggttcctacattgttcgactccaatgcacctaattgggcctataaataaaccaacaatacaccttaagggagaaaattaagttgggtatatgatcgcatgtaaatgcgacattaattttcaggcctgctccgacggtgtaaacaagcgaaactatatttttcagacctactaaccacctgacacaaagttaatatagttaggcctcatttggatcagctaaactcgactacatctaactcttgcgttttagtcttttgttgatcttcatttttattagtttcaagatcttcatgcttaacaaaagaggacaaatttcccagcgcatcctcaagaaatagcatactatctttggcatttatcgccactacatgtcacctaacaatttcaacacctttatttgtgctcccacttgtagctcctcaatattatgcaaaagcttttgagctgcttcagtagcccgctttacctgtaagttctttctcttaatggtcccatcgtaacattcttccattgtcttaagctgtttccacacataattctttttcgtttgttatgctgaaattttattgtgcttctctcatcttagg

SEQ ID NO: 467 - DNA, 2444 bp, Zea mays
ccttgcgactgagagcaagtaccaacacacgtaacagcaagtatggacttaagcgagaaatgctagtgtgagtaactatttcaatattatgtctatctccgattaccgagattattcgagaaatcccatttagcttggaatttaaccatctcacaaaagttcgagtttggtgtcgtattcatctccataatctaaacaattaaaaaggtttcaagacacttttggattatcaaatcttgtttgctggtgaatttggagatgttcgaatcacgtgtgtaagtgaattctaaaatcagaaaacttctgagccccgtgttgtccgaaaagcacaatgcgcttgttcagtaattgaattgttactctcagcatgttatccttggtgtcaaatcaaatgatcgatagctggtgagaatcgtaaaaattagacgcgattaaatatagtctaaaatatcaaagtcgatctcgtttggttcggtctatgtgtttcttgtctcaatctaaatcttcaaatagaaataatgggtacgaattaatcttacttcggagtagccatcaaatcagatcttgtccaaatattgttatcgatctcgttttgttcgaccctttatacatcgctaaaaatcctaattcgaaatatctgcaattttctttaataaaggggaaattggaaaaaatctgaaagaaaaatcttctgtcactgcccctcatccttctgatctttttttcactgccgcgcgcagcccacctcccagggccacgccctgcccggcgtttctggcgccagccaccgtgccatggtccctgctcccagctcggatcttgctcgaccccaagctaaagctcgatccatggcgcatctccttgggccctccccaatcgtggctcgcccctgccctcctgctggtgagttttccccagcgtcgtcagcttgtcggtcatctgtttgatggtagagtacgctatggccctggctgtcgtgccttcgcgctcactttatcagccacctcaagctcgcccctatgctcaggccttgctagctgccgagctccctctacgtcgtgcccttccggcccggtctcgcagacgccgagttcgctcaggtcgcaagcctatgtgtcctcgccgcgtccttactcggcttctctagcgcgccttccgccagctcagttcctcgcttacactacggacctggttctcctcttgtcacgcctgtcctctgtgcgcacgcgccatcgcctcatctagccattatgatcggccgatgactcactttgtgcccctgcttcgatgtatgcacaggcctgcgacgtccaaccttagctgtccttcagccctaccgtacgcctcgtgctatcgatggcggtccaggacttcaacatcgacctgaaccttgagtcagtgattgtatgtgtgtgtggtggtttggtgaaaatagtgttgtggatggagtaagggcgaagccccagattgacactggtcggatgctcgacaaaaaacccaaaccaagaattatgggcggtcttgcgaatctcaatccaggttaattgtggatggagctatggttaaagaagaaagtgaagtccaaaagcgacggcgtgcaacacttgtcaggtgttcggtgttgtgcgcggaccggatagcgccgtcgatttcgtggtttcaagtcggatttaattttggtaagctattttgttacccctatcagctaatttgattggtgaattaaatagatggtggtcgatgattcttttatttgtcgcaagatgtgctgtgatataccccattccatatagagatgtgattacgttcttgattgtaaagtagttgtgtcgttcagtgaagtttaggtttaaggtgtgtttgatgtagtcgatgctagagtaatagtgatattctatatttagtgataacaatcgctataatttgctgattgatatatatatatatgaatatatcttgatcattatgctgatattaccattggcttatgtctagagtggtagaaatgtttgtggcagtattagacatttgttaaaatgcttcatatatacggtgtgtggtttagttaaatatgcaagtataaatttgttagtggtgagtgtttgtggcgacggtttgattgttcgttggtgtaggcttctcgaagtggtttgcaggtttagttggaataagctaacgaagaaccaaattagtgcgatatttaacatgtgatcgacgaaaagcccaaattagtctttgttaactaatgtagtggattcgagctgaagttaatattagcgcacatttttgttattgctattagccgaaatattagaattaatggtctctatccttagactgagttaggtatccctaaataataagactaagtctggtccgcccttttggtgtgttctctagcttagaaatatacataagacttgtgtttagtttattatcgcttg

SEQ ID NO: 468 - DNA, 2444 bp, Zea mays
ctttctaaatcacttattctgactaatttggataacacgctaattacatgaatatcatattagttttagatctagcggacaacttattagcaacttagtagaattccataagattatagcgttaacacctaaaaacctagaaacactagtaaatcctgtcggccagccgtttaaaatacttaacctgcctttcctattataaatccaatcacacttgatttatacattcagtaatacactcctagcaaaatatgcatttaaacctaagctttacacgacacaattatttgttaatcacgaacacagttgcaacaatacatgtaacaaggcattttatcaaacatataataaaaccacagcgtgcctatgctatagacaagatatccgtcgcataatttttttatcaaaattctagaccttaacccctgacccgactactttataattctaaaaataattatatcaccatggaacagcatatcgacgcaacaacggatctaaacataatcacttagcgcatctatgctaaataaaaaggatcgtcgcaacctacatatctatgaatccattaattaaaacaaaataatatagtagcgaatcagctcacccatgattaaattcgacgcgaactctgcaagaaccacgatgatttatagttcaggcttttcgtcgagtacttggtgaatttcacgctgctagcttcgtcttcactcaactcttgggatttcttgataacgcacggaacgacgacgagatcgagtctggagcaagctagtgaggtgtggtcgagcaggttagtgcgagctctggcgaggacacgaatccagtgaggactccgatgtcggcaaggtcacgagctctagcgacacagggtcaagcggcgaatgcgtttggcgtgcatacgtgagccgaaccaaaagcgaggaaccgatgaagcgaagttcatcgacaagcaccatggaggaatcagcgacgttgttgcacacacgacgcgacaacgaacgatgacaatcggcatggagacccgacgcgattgaggaaggggttcgacgattcgacgacaccggcgaggtcaacgacgagccgaccaaacaaaactccacgacgtcgaccggcacacggaccagagaacggcggctggcaaaatccgagctggggaaaacggcgcgcgaccatggtgaactggagcaggggccagggacgcggcgaccatggcgagcctgaggctggaggagggtgtcgatgctagcgagcagggatgcaaggtccgagcataggggcaagctcggggcggccggcgaaccacgcgtgcacctgagaagagctcgcgccggagcggctagtggcgtagagggcggagcacggccagaagaacataggaagcttacatcggcgtctggcaagcacacgccatggatggagcatgggggcgaggagaatgagaacttagtgtggcgagcgtcctggcgctagtagggagcaacgtcccgcgagagagaatgacgaggtgatagagagagtgtccaagaagaactgagaggcaaagaagatacgactggcacacttgtgcgttgcaaaaatatcaactaccggatacgaacaaagatctggtatccacgtatgaagaaaaaaatatcaatgcatatcaactgtgggagatgaggataagagatattttcttttttttcaacactgttatatgtatgagaacaaatatttggacacgatttgatttgatgactactctgaagtcagattaattcgtacccattatttctatttgaagatttagatcaagacaagaaacacacagaatgaaccaaactgatttcggcttcgatattttagacaatatttaatctagccaaatttttacgagtctcacgtgctttcgatcatttgactacaaaacgatttgattaatgagctggcatattatttttctcgagcaacacgtaaacaaccagatccaaaataataccggcttcactacttcagatgatatttgatgcagctaaaatcggacaaatatttatctgccatttaaacctgtttgatttctctgtcaaggataaattgttggaaaccgaccacgattataattcctcagacacgatgtctcgcttgacgagaagggactaaattatttggcattgaaaactttagtcgtcgacttttaataaatctcgttttggacaaagttggaggactaaactaagtttctaaattcgtctttgcgcgagcgatgaattttaaataatcaccaggctcaccgattttcggaacaattatgttccgaacatcacgaaaatttaggacgagcccggatagataaaaataaaaacgatgtcgaactcatgacagacaaaatagattaagacagagagactgttattcactgctatcacatgttaaagtctgcactcgtggtcgagaagacgata

SEQ ID NO: 469 - DNA, 2443 bp, Zea mays
aaaccccacaacatgtatacaaaggaggatgaaagaagcatgcacaacacatttagtggagaaaaaatacgacattacctttagaaggctacataaatcgtgtgtataggacctatgggcatcactgtaaattcgtacaaagttgtacaatatcgtgaccctgtaaataggtgtccacgcaaacgtataccatactattcacgtgcttttgctactcttagaatgatctgcctctaaagctacccaagcattctcacactcctataaggtaatgtattgtaatagaatgtgatcatcaaggtagtataacagatggtgaacatggttcatgactcttccacttacacattttgcctctctcgacattcgtacttctgtaaccttcttcccatgtttcccacttttttcatgagtggacaaggggagaaagtgtttttaatttaattgtgttgtcgtgttatggtttctcataggagctttgataggtgaccaatatgcaaccttctagaaccttctacaaacaatcatggctaaccatgatacatgaaactttctagaaccttctacaaacaactgtggctaaccatgatctatgtacccttctataattttctatagcaatcatgataaaccatgaagcctagatatttttgccatgaagaagtcacctagatattgtggagaccaacaatcgtgatgaaccatgatgcctttttattgccataaagaactttttaacataggaccgactctagacctagacgagaggggcgactacctagggcccaaaccatcaggtggaccaaaaaatttattttcgataaatatagttagtaaaaattgctatatcagattatgtccataaatgcttcacttgaatagattaaaggggtcatctcgtattttaagaagtatatatatgaaggtttgagttgtaccattaatattggaatataaattgcaaaagtgatggatgtggaaccaaggtttcctacaaatgccaaggtaatcgaaagaaacattttgatgagcaaaatgatcaagatgaggattaaacattatcattcatagagtccataagatttaattattttcttataatgattgttatgccaattaatttattaaatagttgattcgagcaattacatgcaacattcttgaaccttctataaacaaccatggctaaccatggtaaatgcaaccttctataatcttctacaacaatcttgacaaactataaagcctaatatttgttgcaatgtggaactctatagatatttgtggagacatctctagaatggggacatgtgtctttcacccatgctcacgtgtaactatataagaggtgtcacccgaccagttgccatgatatacaacataacaaacttccaccacacacatattgggcaaaaaatgttgaaatagtgctaaacaaaaaataaaaatgaaattgatttatattaagtctagcataagcaacaaaaatgttgaaggaagatctaaaattgaaatggatgtatactaaggctaacataagtaatataaatgttgaagacaaagtcaataatataaacaaatagaatcccatattttataactgaatgatcatgaagaacgagttaatttaaaattttttaaagccaacttttggattttactagatcagtaattttctaacggtgcgatttatatttcgactttattaataagatctttatttaacattaatagtttttttaatgttttgtcaaaactataccaataatatttatcgaaaaatattaacataaagtaaaatttgatcccaattttcattaaattttgtttattatcagattgtaaatcatgcttgtttagttctgttatgtcggaatgtatatactagtatttgaaatgtttatttattataaaaaagtaagcttttaatccactttaaacaaacataatcataagattaaatattgtttatttaatgtacgttttatacaaagcataaaaaattatgggactaatgaatattaattgttttcaagtttgttgcagaatataaagattttagacatatcctaactttaaatcattttgaagcactaaatgatgtattgtttacaccgatagtttttacaaatcgatctaacttgttgttttgcatgcttcatcattaacacaagttcaaaacaataataaaatgagtatgtgacccgtagaattggattgtcatgtactatcactagaatatttcatatgaataatgaggtgactttgattattaatttctgaaggcacaagttatatttctagtatctgactttgatcattagcaaaaattaatagtttttcatttgttttttgtcacagttattcaaataacatttctttgtaaatattaaaaaaatttcatatgaaaaataaggtggctttaatcgtcaattttcatatc

SEQ ID NO: 470 - DNA, 2443 bp, Zea mays
atagcttctctacagaaaacatgattttgttcatcaaacatttaacacgaggacatcactgcgtgcagtccaaaacagcaactaataattttcagcttctatttacttcaaaaattaccctgtcctggcgactggaattactctaacactttaccgtttgttagagttaaaacaatcaaattaggatcaacaagtcgacttactaattttatccaagttatttcgggcgatagaagtaccatacttaattaacaacgtgttctccacgataatcaatatcgaagcgcttttcacccaatattttgcatcttagcttagacaccacatgagcactactaatttttatccgtgtcatttagtgcactaaaactaccatcaacattcaacaaacacattcaccacgtaaatagcatcatcacacatgacctcgacttaaccgcagaggaagtgatgactacttcggtatgtcaccacctctctacagtccactcaatattaactacatcgatcgaacctcatattgcgcaactcttataatttactatctcaaatacaaccatagcacgacatgcacttgagactctttgttcaagttaacgcaatcactactacaacgcatttcggcacacatgtttgataacacatctttctaaattaatctatctcatcttccaaacaccaattttatgtcacgaaatttacatttttcacctagtttaacctacagcaacgatgaacacataaatataattatcctagaatgactcactagccgagtgcggaagtcaccaagcatgctttaggatttaccaaatttttgccgcactaacacattaatgtacgatgaagcatgttagcaaaccattaacacattcacgaccaatccctacgacgcaccaaggaactatcgcagccacatatctatccaatccaacaacaaaataacacctcggctcacccacgcacctaagtgtccccataatacgcacaaggcatcaaccgtacaagtgactccaacaggattactcatactcctcattcgcctcgactatcccaatcaccgatcactcgcaaaaaacaattacacttttcacataaacacctatcgatgcatctcccaaaacataatccgcattttgtaacttagtttttcgcatcaaacaatgtatcgcatattcttcctaccaagatataaaaacatccgagttcttgttctacttcattttcttctatatacgtgtgcattcatacaattataatttcacgcacatattcacacatgcacatcatcgactaaatacgtaaataaaacaaatagcgaatcattcaaggcgaacaacctggctgaaatccgatcggagttgcacatgcatgccatcagattgggctctttgccgacgagcgacgcgcgaggcgtgacgacgacacgggctgcgagcatggcacagtttattacacgatttgttggtgcggccattcaatcgaacacgaaaagcgtaggacagcggggtctcaccatgggttccaacgacgacacgtcggcactgtgcagacctggcgaagcgagacgaggagacggtcgaaccgcgtagatcaacgacgcagcatggggctgtccaaacacccacgcgacgctttgggtcaggactgcgcagctccatgttggcgtacagaaatccggagcatgctgctgcggagagggagtcgagcagaggcactgcgcggagcaccagccgtggagaggctcaccattagagctgaggggaggggggcctcctgctggttttccatggaagaaaatggggttcagggaacaacagggggaggggcattgagcgttgtggagaagaagggcgcagctccctgcacttcagctcaagggaaacagagaggagggagggcactgggcagaggatatgagctgggcgcagggaggtggaggtgccatgggagggagaaactgggctccctgctgaccgccatggaaaccagggaggaagaaggggcgcactggccatggagcagaggcgtcgctaggggaaaacaccggcctgctcaagccagggcagaggcatggagcgcccaagaaaaaccaggaaggagggagctcgtggggaggtaccctgttaccgagcgccatggatccacgggggaaatgaaggggttgctgccctacgcgcgcgctgcagcttgatcgaggaaggggaggagacgccatggacagggagggagctccctgcgtgctgccgtgtgggagaaggagcgcgtgctgctgtcatgaggaagaagagatagggaagcaaggttgtggcggctgaaagaaatggaggggtgggagtgcaaagttgccaagtgcaaggggagagggctcctatttataggcatgtgctagggttagggttccttagttggcctattgggctggaatgggcttggcccaaaa

SEQ ID NO: 471 - DNA, 2443 bp, Zea mays
ttgtcccttgaagcccgggtgtgacaccccgacccgctaggttcttctcctctgcggcgaattagagcttgccggtggcgctgcgcgtcgatccgccacacctccatgaagtgcggccgatgcagctccaccccttgcccaagttgtggccctagatgtaacaaacccctcaacggagcctgtgctttcctcggtgcgctcgatagccccactctgtggttcggattgctcactagagtgcccctgacccaccaagttcttgtccactatggcgaattagagcttgccggtgccgctgcgtgtcggttcgccgcacctcctcggcgtccgaccgatgcagctccaccccttgcccaagttgtggccctagatgtcccaaacccctcactggagctcgtgttgtccacggtgcgtttgatcgccccactccgtggttggggttgcttgccagagtacccccgacccaaccggttcttctcctctgcggcaaattagagcttgccggtgctgctgcgcgtcggtccgccgcacctccatggtgtgcggccgatgcagctccaccccttgcccaagttgtggccctagatgtcccaaacccctcaccggagcccgtgctatcctcggtgcgctcgatcgccccactccgtggctgggatggctttccagagtacccccgacccgcccggttcttctcctctgtggcgaattagagcttgccggtgccgttgcacgtcggtccgccgcacctccaaggcgtgcggccgatgcagctccacccattgcccaagttgtggccttagatgtcccaaacccctcaccggagcccgtgctgtcctcggtgcgctcgatctccccactccatggttgggattgctcgctagagtacccctgacccgcccggttcttgttcactgcggcgaattagagcttgccggtgccgttgcgcgtcggtccgccacacctccacgacgtctggccgatgcatctctacccattgcccaagttgtggccctagatgtcccaaacccctcatcggtgcccgcgctttcctcggtgcgctcgatcgccccacttcgtggctaggattgctcgccattgtacccgcgacccatcggttcttctcctctacggcgaattagagcttgccagtgtcgctgcacgtcggtccacaacacatccacggcatccggccgatgtagctccaccccttgcccatgttgtggccctagatgtcccaaacccctcactggagcccgcgatatcctcggtgcgctcgatcaccccactctgtggctagattgctcgcaagagtacccccaacccgcccggttcttctcctctgcggcgaattagagcttgctggtgccactgcgcgtcggtctgccgcacctacatggtgttcgaccgatgcagctccaccccttgcccaagttgtggccctagatgccccaaacccctcaccgaagctcccactgtcctcggtgcgcttgatcgccccactccatggctgggatttatcactagagtatccccgacccgcccggttcttctcctctgcggtgaattagagcttactagtgccgctgcgtgtctgtccgccgcacctccacggcgtgcggctgatgcagctccaccccttgcccaagttgtggccctagatgtcccaaaccactcaccggagcccgcgttgtccttggtgcgctcaatcgccccactctgtggctgggattgctcgccagagtacccccaacccacacagttcttctcttctgtggcaaattagagcttgccggtgccgcacttccacggcgtccgatgaccgatgcagctccaccccttgcccatgttgtggccctaggtgtcccaaacccctcaccggagcccgcgttgtcctcggtgcgctcgatcgccccactacgtggctgggattgctcgctagagtaccctcgacccgcccagttcttctcctctgtggcaaattatatcttgtcgatcccactacgtgtcggtccaccgcacctccacggcgtccggctgatgcagctcgacccttgcccaagttgaggccctagatgtcccaaacccctcactggagcccgcgctgtcctcggtgcgctcgattgcccaactccgtggttgggtttgctcgctagagtacccccaacccgcctggttcttctcctctgcggtgaattagagcttgctggtgccgctgcgcgtcggtccgtagcacctccgcggcgtccggccgatgcagctccatcccttggccatgttgaggccctagatgtccgaaacccgtcaccagagcccgagctggcctcgctgcgctcgatcgccccactccacgtatgggattgctcgctagagtactcctgacccgcccggttcttctcctctgtggcgaattagagcttgccggtgcctctacgcgtcggtccgc

SEQ ID NO: 472 - DNA, 2441 bp, Zea mays
taatttggataacacgctaattccatgaatatcatattagatttagatctagcggaaaactcattatcaacttagtagaattcataagattatagcgttaacacctaaaaacctagaaacactagtaaatcctgcccgccagccgtttaaaatacttaacctgcctttcctattattaatccaatcacacttgatttatacatttagtaacacactcctagcataatatgcattttaaacctaagctttacacgacacaattttttgataatcacgaacacagttgcaacaatacttgtaacaaggcattttatcaaacatataataaaaccacaacgtgcctatgctatagacgagatatgcgtcgcataatttttttatcaaaattctagacctgaacccctgacccgactactttataattctaaaaataattatatcaccacggaacagcacaccgacacaacaacggatctaaacataatcactaagcgcacctatgctaaataaaaaggatcgtcgcaacctacatatctatcaatccattaattaaaacaaaataatatagtagcgaatcagctcacccatgattaaatttgacacgaactatgcaagaaccacgatgatttatagttcaggctttttgtcgagtacttggtgaatttcacgctgctagcttcgtcttcactcaactcttgggattttttgatgatgcacagaacgacgacgagatcgtgtctggagcgagctggtgaggtgtggtagagcaggttagtgcgagctctggcgaggacacgaatccagtgaggactctgacatcaacaaggtcacgggctctagcgatacagggtcaagcggcgaatgcgtacggcgtgcatacgtgagccgaaccaaaagcaaggaaccaatgaagcgaagttcgttgacaagcaccatggaggaaccatcgacattgttgcacacacgacgcgacgacgaacgatgacaaccggcatggagacccgacgcgattgaggaaggggttcgacgattcgacgacaccggcgaggtcaacgacgagccgaccaaacaaaactccacgacgtcgacccgcacacggaccagagaacgggagctggcgaaatccaagctggggaaaacagcgcgcgaccatggcgaactggagcaggggccagggacgcggcggccatggtgagcctgaggatggaggagggtgccgacgctagcgagcagggatgcaaggtccgagcataggggcgagctcggggcggccggcgaaccgcgcatgcaccagagaagagctcgcgccggagcggccagcggtgctgagggtggagcatggccagaagaacataggaagctcacatcggcgtctgtgaagcacacgccatggatggagcatgggggcgaggagaatgagagctgagtgaggcgagcgtccaggcgctagcagggagcaacgtcccgcgagagagaatgacgaggtgagagagagagagtgtccaagaagaaccgagaggcaaagaagatatgactggcacacttgtgcgttgcagaaatatcaaccatcggattggaacaaagatcgggtatccacgtatgaagaaaaaaatatcaatgcatatcaacggtgggagatgaggataagagatattttcttttttttcaatgtcgttatatgtatgagaacaaatatttggacacgatttgatttgatgactactccgaagtcagattaattcgtacccattatttctatttgaagatttagatcgagacaagaaacacagactgaaccaaactgattttggctttgatattttagactatatttaatccagtcaaatttttacgagtctcacgtgctttcggtcatttgactacagaacgattcgattaatgagctggcgtattatttttctcgagcaacacgtaaacaaccagatccaaaataataccggcttcactacttcagatgatatttgatgcagctgaaatcggacaaatatttatctaccatttgaacctgtttgatttctctgtcgaggataatttgttggaaaccgaccatgattataattcctcagacacgatgtctcgcttgatgagaagggactaaattatttggcaccgaaaactttagtcgtcgacttctaataaatctcgtttcgaacaaagtcgggggactaaactatgtttttaaattcgtctttgctcgagcgatgaattttaaataatcaccaggctcaccgattttcggaacaattatgttccgaacatcacaaaaatttaggacgagcccggatagataaaaataaaaacgatgtcgaactcgcgacagccaaaacagattaagacagagagactgttattcacagctatcacgtgttaaagtatgcactcgtggtcgagcagatgttaaacacctggggtgttacagc

SEQ ID NO: 473 - DNA, 2440 bp, Zea mays
attgaagtaccgtatgttttttctaaaatattttgcatcatcatctccctgactggtgaacaaccttttcaactcagtaggcacatcatgtatgtgcactttaatctttccctttctgcaacacattccgtgtggctcaaattgaaatttcacggctccacaataacaacagtcaggtatttttcgcaatacattgtgtctatcgggcaacttatggtagacatagtcatatggatcttcggtatgactggagtacccaagcaggcgatatgattcaaatgcatcatctgggttaaaaaacaaatgcactatttgcagttattaaaaacagaaatgaaccatttccgggtaaaataatataaatcataatttatggttaccttctccatgaaattctcgacttctagtatattcattatgttgagcaatattgaaatcatgtggtgatattggatgctctgatgtgtaaaccagacattagaaatgtgttaatgatgtatatactagtatatagcataaaagtatatacccatatgtaaccgtccagtttgaacgatgcaaacccccataaagaaaatgacccaaacaaccatttctcaaggatctctaattattttctactcacacatgcaatgcaaccatcatacgcagaataaccatatttagtaggaaaagaagtattagacagttaggtaccatgtccttccaagcttggttgtgtaggctcaattaatacagtatcatactctgtcaattcagactcatgggtaggtgtgtcatggacaatatgttgttgtgtatgaattgataatggagcacctgatagagtgtctggcagcgtagaaagccatggtaagccttaagaggagacacattgatttttttgaatgattcacttgtgctcaccaattatcgtgtcatcttgtccacattgtctaaactttttgtattcacgtcgcttatgcagtcgaatttctttatccgcatcatccatattgatgtacctcgctcggttcattatgaggttgcccatggtagatgcagtagttgctaaagacaaacggaaatcaaataataaattatgtaagtagtaattataacaacgaattcctaccgtattgattataggttgaatgttgagaaatggttgaacatggttcccctgatgttggcagttggtgcaaagagcccctctcaccatcaggcgttaccggctctgccaccttcctgttatcgtctccagtggttgtggtttgtattacgatcgaagatccagtagcataagcctgtgtctgtctgagcgagtatagtactgcaagaggaagaatgagtattagtaactaaaaaataggacgatgttaattctcggcaggaagtacctatgtcatccttcttcctcgctcggtaatcacacattcttttatttctcgcctccctttcttcgttggtttcttcagctttcttcttgcacggtattctcgttgttttctatccctctcctcccgatgacgctcatgttcatcggtcggacctggttgtggggccatatctgtatttaaaaaatgttcgacatcagtaataaataataaaatgaaaagactgtgctacttggtttgattatgcatgaacctgtgataatttggttagatatatcagtaagcgcagtctgtcgtcttgttcccattttaactggcgtactacatatttcgtcaccatattcactgtatgttcattgataatgtcggacgtagtaatcattggtatgtagccactccatgggatcacttggaccaattgagtccatgtattgcaatctggatgcctgagaaattgttgaacatggtgtctgcaacaagcaactcgtaccatacggcgtctcagcctgtgccacatgtgtgttgtcccctccaggagcttgcattacgatcgaagatccaaaaccaaaacgttgggactgttcgggcgagcatagcactacaatagacagatgaattatgttaaaaaacaatagaatgtagtataagatcataggggatacctgtctcagccttcttccatgcgcggtaatcacgcatccttttatttcttgtctccctttcttctgtggtttcatcagcctttctccgtgcatagtattctctttgttttctgttcctctcctccctcttacgttcttcgtcatcggatcactggttgtgggggcagatttattaagatatttaaatagctcgatattatcagtattaaacgaagacatggaaacatatcagtatgaacctttgttattctcatttgatatagttgtaagtgcactccgtcccattttgtttggtgatcacaaatatttgaaaccttacaacaggtaactcgttacaaattgaagtgattacatatgtagaatatgaactgtctgaatacatataattgggatatatatata

SEQ ID NO: 474 - DNA, 2439 bp, Zea mays
catatgtagtgttattttaaatgattcttggttatggacaacaatgcatgttttgaggccactcaaaaaacaattatgtgactcatgacatttatcacaaaacaatttaaccaaggaaaattacattacaatttgcttattgccaaactgtaaacatcacttgtttgggcatgttatctcataagatatgtggaaaatttttaaatgtttcatggttatggacattaatgtaagtttgaagcggttcaaagccctaaatgatgtaatgtttagaatggtagttttcacaaaaaggacccaacaaggtttgtcataaaagttttcgcaatacaatgatttgtgagtaaagggtcatgatttcgtgcatgttttctcgaaaagattgtggcatgaaccatgcaaaaactttgaagcttttcaaagccctaaattatgtggtagatttatagaatgatctaacatgtttcacatgctccaccatcaactaaaattcaacacaatcaataacttgagtatgggacccacataattagatggccacatgtcgattaaagttcaatgttttaaagaatgaggtaactttaaaagtatttgaattgcaatatgcagatttttcaagataaactattttgcaaagttacgacatctattaatggaaaaatttatatttccactttcattactcttttctaaaagacatacttgtttaggcatgttaccttgtaacatatattgtgctatttgaaacgttcctcagttgtgaacactgcaacccaagtttaaggccgatcatgagtatgggtctaatgggtattatatttgtacaagtttgctgcatgatatattgatttctaatgtgcgtcaacttcgatgcattttgaagccctaaatgttgtattgtttagacagacagtttttatggatggacccaacgtgttgtttcacatacaccatcattaacccatgttcaagacaaccataacatgagtatgcgaccttagattgtcgcatgttagcactagttttggtcatatgaaggatgaggagactctaaaagtgattgaagcacaacatgtagattttttcagatcatcaatttactataagcgtgtgctatgcaacatgttgtttcaattcttcatcatcaacccaagtgcaagacaacctatagcatgagtttggggcccaagatattggatgttcgaatgctggcactatagtttgaagatatgaagaatgaggtaactttagaaatgtttaaagtgcaacatgtatattttttagatcggtaatttccagagttgagagctatatttatgcaattctgcttttattttgatccatgttttaagattctttgttattattcttttacagttatatcaatgatatttgtaacaaaataattaaatatagaaaaaaattcataccaattttaatttcaatttgctctatgccagactataaacaataatggtttaggcatgctatcttaaactttatgtagtgttattttacatgattcttggttatggttaacaatgcatgttttgaggccactaaaaaaagtatgggactcatgatatttatcacaaaacaatttaaccaaggaaaattacattacaatttgctcattgccaaaatgtaaacatcacttctttggcatgttatctcgtaagataagtggaaaattttcaaatgtttcatggttatggacattaatgtaagtctgaattggttcaaagccctaaatgatgtaatgtttagaatggtagtttttacaaaaaggacccaacaaggtttgtcatcaaagttttcgcaatacactgatttgtgagtacaaggggcatgaaccatacgaaaactctgaagcttttcgaagctctaaattatgtggtagatttacagaatgatacaatatgttgtttcacatgctgcatcaactaaaattcaacacaatcattaacttgagtatgggacccacataattagatggccgcatgccgattaaagttcagcgttttcaagaatgaggtaactttaaaagtatttgaattgcaatatgcagattttacaagataatctattttgtagagttacgacctctattaatggaagaaaatttatatttccactttcattactcttttataaatgttgtactataagacaaacttatttaggcatgttaccttaaaacacatattgtgctatttgcaacgttccttagttgtgaacacatcaacacaagtttaaggccaatcaaatcatgagtatgggactaatgggtattaatttcatataagtttattgtatgatacatcgattttttatgtgcgtcaacttcgatgcattttgaaaacctaaatgttgtattgtttagacagacacttttacggatggatccaacttattgtttcgcatgcaccatcattaacc

SEQ ID NO: 475 - DNA, 2437 bp, Zea mays
acaagcactagagttttacgacgggctgttgtaatgggacgtcgatacacgatccatggcaattaggagatcgatgtaggcggaaacgatagccgaacaggaactgtgcagatcgacgatgcgagactcgatctggcgagcatgacgcaagggatcgcagctgctgcttcgacatgaattacttgctaccgagcacgacggaggccagggagcaggaacgctgcgcagcgaaacccacggttgcgcgcaggggtgtactcgattgggcgcggcgattggagcaggtggccactggggcagtgcccaagtacgcacgacgagaatccgagcagggccagtgcgcaacgaccatggaaaagatccgagctgggctgaatccgagctggagctcgcagcaacaaggagtagggcgagctagagactggaagacgccatggcgagcagcagggagcttcgacggagagaggcgcaacaggaaggtggacagggagacgtacgcgcaggggagacgcgtgccatgggagatggctgtgcgagcgcgttagggagaaacgttggctgcgcgcagggcgaactcggcacgacagccatggacgagttaggcgagcggaggaatgaagcgatggaggagcgcggcttgcactggagagcagggctgactagctgccatgggagatcgacttggcgagcactggcggctggagaaagttgaggggaggtcaaggagctgagcggctgcacagtggagcaagcagccatggaagagcagaaagtcgactgggagggaggagatgggacgacgctgggatgtccgggaccagggcgcagctgcaggaggaagatgtgagaacaagcgcctgttgccgtgtggagaggagagataatgctaaggaaaaaaatctgtagaagaagataaggctgggagagtatgcacatgtagaagaagatattctaccggttacccacttaagcggcgacagagacaaggaaaaaatgcatcgaatacgattgctagcaaagaaaatatcgatgacgaccaatgatattctaggaagtttacgtacttgagaagaaaacaacgatagagagatattttctatagtgaaaaatccaattacgttgaaaatcataccaaggaacggtggaaatatttagagaaggattttccctgtttttccttctttttttaaaaacaacaaaatacacatattttagggtatgaaattagagtctaaaaaatatacaaaaggatcaaacaaaaatgagactgacaacaatatttagataggatttgatttggtgaatactctcggaattagatgaattttcacccgttatttatatccgaagttttggatctagccgggaaacacaaggaccaaaacactatccggatacggtacttgagactctattaatttagttgaactcagataaaaatttatctgttttccgaatcgatttgatttctctacctagaatagcacactaatgaataatcccaattgttaatcttgtgcacggtttcttggtaacgcaagcgatcaggagtattctttcggacccaatattatctgctataaaatcaaacggtaatctctttgtctcggataatatcgggttcgggtaggatgcacatagaatgaacccaaacgagattgagactgatattttaaactatatttgatacgacttgaaaccatataacttcgtctgccactcgaacacctaatcactctgccattgatgatttattggagaatcaaatctcaattataattccttggttagcaatctcgcgcatgatttttctcatacaatacgcgattcagattattttgccctgaacattttagtcttcgagttcaaattaatttgttcaagataaaatcatctgagtgggtcgagattccaattcgtattcacgtgagtggaaacagggggtcacgtcagggctatatggccgcgaaggactaccaattcaccatgcacaaccaatttagggagaggaggaggcaatgcaaattttggctttaaccgagctcactgaagaactctgagtacctcgccgcgattcccagcgctatttaaaggcacgacaacttggctaactatccacggtcacgaagcacgtcgctaacgcttgacgaccacataacaaaggaacacagagaggtagaattgaggtgcgagtgacacggcaacgaaaggaccgagccacggtgatcgccagtgaaatatctccggccagacctcggcctaatccgcgaagcagtgaattggctcaaagttatcaagcggttgttcctatctccaattcatctgatcccatccaaatccacagtaccactgatcttttcttcagatatttcctaagccactgatcttcatcgttttactgaaccgacctccgttctcccccctttctcttgatact

SEQ ID NO: 476 - DNA, 2436 bp, Zea mays
ggcttggtggtttgttaagggcaacaagtaccgtgcaaatttcagcaatccttaatgccatcatcttttaggttcggtttagttgttaccgtaccttcagtcaaatggaactctaactcttgccaatagtgatgtgcatggtactggcacctaagaaagctgaattgctgtaaaaacacatcacatgttcgttggcttgtcagcagtgaatatggtgtgttgcagaagtattgctagttttacaagcagcccttgtttgtgttgagtattgtgcaagtattttgattgcttgagatccaattccgtatgctgggcacaaacaaacagaacaatgacaaagttatttcggtgtcattattctcttctcaaggacaaaagtattctttttccttcccttaaaaagaatattctttcccctgaggcaaagattggttaaatcgtagtgcactatcaatgctgtcattttctgatggagtaattgtataaatgtcctctcctcagagcattggaatttctttttctttttatgggagatactgcactttcattttaccaggctgtgcagtattcaactgtagctgatataaatgctctttcacatctttgcagtccatgcttcgtctgagactgttacgccagagaggtacggttgaggatgaaccgtggagtttactaaaaccggttaggccacaccaaccaaaacatgtgggcgagttgaggtattcaagtctacgaattgagcttccttctttagtggatatgcggagaactgtagattagctgattttatttatccaattaatgggcgcaggtattatagcagggacacagacttacgaaaagcaaacagttacagtcaacaaaataatgggtaaagatttatagtacattgcttgagtcgagcaaattatacttaatttgaaatatttgtagatttatgccttattattgctaatctatgcctcttgtaaatcttgttttcagcaattgcaggcctgacgaacaattttgtattgataaagttccagctgaggagaagtcaatttatgtatctgctgaagtccttgttgatggttcaggaaatctatggtgtgacgagcagatgaaaaccaagggggatacatgtcagaaagattgtcaaagcttttgtgttcacagtcagaacaattgtgaagcattaagctttgcaaggtacggtgaacatagtactatagatgagaatcagtttgtggaagatatctccccaagcacaacaagcacgttgcgtgaattagaaactccgtcatctagaggagataatctacgcgaagaagacaatcaaagcataaacggttcctgggaagggagaggattatggataagcagcctaggttggcctgcaccaatagatactttgagtccggatagcaggactcaggatacaacgggtgatactgagaatcacaataatcagattcaattcaatgatcgcccctggatagactccccgaactcgtggagatcactctgtgttgtcacgcaatcagaatatcgtgctttgtcacacagtgctgacatttgcaaccttcttgagaggtaaattggtcccagcctaactgttatgcatattgcttttgcaaattcagatgcatttagtcacacattatccccgcattggtgacagcagtgggatgtaaacgggccattctacttttgttagtttggtttatctcaaaataacaggttagcattagtagctttatagtatgatagttagtttctaaagttcaaacatcaaaataattttcccaccttgtcaaaaaggattatcatacacttcaaacaatttttcatgtgcttgacttgtttttttactggcttaactgaatctagccatgctatctcttcctttctcttgcagcaaaaaggtctcaaagtctcttgagagtgactttagcaataaaatgaaccagctgttgctaatagttctgcaaaaacaaaggcaacaacagatgatggatggttttggaggatactatgatgaatgcatgtactggagacaaaatgatgaaattcatgatgctcataaggaggcatctgctccatgttcatcagctcctgtctcacatcttggtgctcatcagcaagagtgttggcagcactcttcatatggaagtcaacatcacgataaccaaaatttacttgtaagtgagctgctgtttaatttcagtcgtggaaagttatattcttactatgttctctatcctaggaaatggaagtcagggtaaggggtgaaatgtcccagattcaacatgaaatatatgaactgcagaagttggtggaaagttgtattgcatcccaagtaaagatgcagcactccattaaagaagaggtgtgcagtgcacttcgtgaggcaggtgagttgtgacactttttttatagtttgtgttttctata

SEQ ID NO: 477 - DNA, 2432 bp, Zea mays
tagtggagaaattccccgcggggaatcggggatcgagtccccattgccatctctagtccgaccgcgcacggtcgcgccggccgtatcgcctcgcgcgtgtgggcccaaactgccccgctgtcactattatagtacggacccaacaaatctgagggggcacaatgttttttccagtcgagggtttcgccgatttccaatttggaaatccattcctattttggtaccgctgtccaggttttgatttttcaatgtagtttctccagatttttttgtttttgtatacagggtttgaggtgcaattattactggattatgcataccgtacatttctagatgaaaacatttatctgcaggtttttttatttgttttcagaaaacaacatgttgcggcgaggtgacgatactatgatttttgtttattcgcaatatacttttgtgagcaaacgatttttgtaggcatattatcatgtacatagtatactctttaagtaatgtaatatacatgcattttcagttattaccgatcagtaatacgtgtaacattcaatagtaacctcaaacatgcaacaaacagataatatagtttttttactttttgaaattactttcatatgtcgaccagcaataatatgtttatatatattctttgttgtctgaatttgttttattagtatagttagtaacaacgtcgaatactcagtaataagatccaacagtcaacaaccagatagtatatttttctttaattcctttttaattcacttacgtttggagtcagtaataactccaaacatttagtaacaaacgttgaacataagtaatatgattttctttgttcgactggatttgttgagtgtagtctcagtaacgtcaaacaatcaatttttttcaattccttttgaattcactcacgtttggagtcagcaataactccgaatattcattaataacgtcggacatcagtaatatatgcatatgtagaacgtctaagtgttagcaataatatagtttaattggtaacattctaatatatagtagtatattatggacagatagtagcctttttcttgaagttagcagagttagtaatatagggggtacatatttttttcctttgtatctgaaattttttacgtttcactgtcgcagacaatgtctacatccactgagcagaagcatgggtactacgttacaatgagatgtgctccatatgcattgaagaacgcaacattgttgatgtctcataggctaaaagaaatgataaagaagctaggcttcggttcattactacaaatgaacattgaatcaattaaggatgggatgttcgtcggtctcctgttgtctagtgtgtacgactctcttctacggatcaaatttggtggacgacccttgccaataacaatagaggctattcaaattgctactatattaccaaggggagaagacaagtttcctcagctggactactagtccacgacttctgctagaactagttttaggtcagtaacaataacacccattatttttgttattttccatttttagtagccacatgttcaataatttttttattattttgttatgtatataaaattatgcgaggaaaatggaatgattaagatattcacagatgatcatgcaaaaggaaataaatgtgtataacaagcttaacttgatggaggtcacttgttgggttgttgaaggaatgaacaatgaccacgcaaaacatgggtacgactggattttacaatgtttgtttgtacttgcaagcaattcccttttgttttctacgaccaactttaatatagctggtagtgattttgcccctatgcaagttttggagacatcgtagcggtatgattggtgacagactatttgtgatgatcttaagttgaaagtagagaaattgaggagtaatcgttgcaagaaatcagccacacccaccatccaggaatgtgcactttttcttatcgtcagttttttattttttcggtcagtaatatatatgctttgttttttgcaaggaattttgtttttatactttcttacctttttctgtagctttactacttcgacaacctgtagagtggcgttgctgtctggggcgtcacctcggtggagtgtattcagtaggaacataataaaatgcattgtggatctcgataaaaaatctgacagtgatggaaagaattatggcaaccttcccgtaagttaacaattataatcaataataatatacatatgatagacattgaccagtcagtaacaattttttcattcagtaataattacattaataagtgtgctatcaagcaattacatattttatactattttttaaactactcactaatcattattacatcgtcagtaattatcaatttaagtttttattgttcagatttgataacactaattatacataatcataa

SEQ ID NO: 478 - DNA, 2431 bp, Zea mays
ggattggagtagaataactgagggatcagaaccgaacaactgagtgccgacaccagaataactgagtctgcacatcataatcactgagttagccgacaagaataactgaggtattggaacagaattactgagttctggcaccagaataactgagtgcgtccattagaagtactgagttgttggaacggaataactaagtcatgaacatataataactgagtaggcacattacaataactgaggtatgacacgggataactgagggattggagtagaataactgagttctgtcacttgaataactgagtggtgaacatggaataactcaaggcgcgcattagaataactgagtaccgacattagaataactgagttaggaacatggaataactgcggtattataacataataactgagggtttagaataactgagttaagaacatggaataactaaggtattataacgaaataactgagggattggagtagaactgagttggcccacaagaactgaggcatgagcagagaataactgagttccatcactagaataactaggtgatgaacacagaataaccgagtactgaaccgagaataactgagaaatgaacatggaataactaagtgcgcccactagaattactgagtaccgactccagaataactgagacatgaacatggaataactgagtgcgcccactagaataactgagtcatgagcagagaataactgaggtattagaacggaataactaagggatcggagtagaataactgagttggcccacaagaataactgaggtattagtccagaataattgagtacgtccattagaataactgagttgttggaatgaaataactgagtggcgaacatggaataactgagttaatagaacgcaataactgactgtgaatagagaataacggagtccccactaccgagtgattacaaagagaataactgagtaatgagcagagaataagtgagtaggcacacgagaataactgagtcatcacaccagaataactatgtgcgcccattagaataactgagttctgacaaaagaataactgagtgacgaacatggaataactgagtcggcacatctcaataactgaggtattataacataataactgagggatcagaaccgaacaactgagtgccgacaccagaataactgagtctgtacacaataataactgagtgggcacattccaataactgaggtatgatgataactgaggcatcggaggagaataactgagttagcccacaagaataactaaggtattggaacggaattactgagttctgtcaccataataactgagtgcgtgcattagaagaactgagttgttggaacagaataactgagtaatgaacagataataactgagtagtgaacaatagaataactgagtgtgcacaacagaataactgagtaatgaacaatagcataactgagttacttgaacgcaataactgaatgtgaatagagaataactgagtaataaacaccgcataactgagtgggcacattacaataactgaggtatgatacaggataactgagggattcgagtagaataactgagtaatgtcacacgaataactgagtgcgtcgattagaataactgagtaatgaacgcacaataactgagtaacgaactgagaataactgagggatcagaaccgaacaattgagtgccaacaccagaataactgagtctgcacaccataatcactgagttagcccacaagaataactgaggtattggaacggaattactgagttctggcaccagaataactgagtgcgtccattagaagaactgagttgttggaacggaataactgagtcatgaacatataataactgagtaggcacattacaataactgaggtatgacacgggataactgagggattggagtagaataactgagttctgtcactcgaataactgagtgatgaacatggaataactcaaggcgcgcattagaataactgagtaccaacattagaataactgagttaggaacataactgagtgggcacattacaataactgaggtatgatacaggataactaagggattggagtagaataactgagtgcgtcgattagaataactgagtaatgaacgcacaataactgagtaacaaacatagaataactgagggatcagaaccgaacaactgagtgccgacaccagaataactgagtctacacaccataataactgagttagcccacaagaataactgaggtattggaacagaattactgagttctggcaccagaataactgagtgcgtccattagaagaactgagttgttggaacagaataactgagtcatgaacatataataactgagtaggcacacaggataactgagggattggagtagaataactgag

SEQ ID NO: 479 - DNA, 2429 bp, Zea mays
cagaagcatgaacaaaaaataaattagactacatactccacaaactccatacaaatagagatcctaacttaatatacaacagccacaattccacgaactctgtctaattatccttgctacagtttacaaagaagaaagaatacacaactctgtctgttttgaattagcagaatgtttaagttgctacatcttgaactattcccgcagttagtatccaaattttgaaatagggaaatgcagcatgtgtattctcaccgcttcaggcccaagtcggcatatacgcagcacacaatggcatcgagagagagagagaggaggggctggcccggtccgccatcccgaaatccatcggtcgcaatgacaagaccctctgtgcggtgcccgagcagcgcgcagcagatgcgtcggacccgtcatcatggcggtacgagcgacgcgaccaacagagccgtcggcattgtgctgcagcgtgcatgcatgcaggagacttggcgcgccggcttacgacctggccacgcacacgacgtgcacacacgcactatctaggcggcctccttgcagcattggcactaaacaaactcacgtaaataaaaacaatcagcggctgcatgcactcaaatggagcatgcatgcagtcgacgcagtcaacagtcgcctccgacgcgcacttcccccgcgagcgatctcaagacttgatggatcgttgttgttcgcatggataagaatcgaacaaattagggacagaaagcagagtggcgtacgtgtgccatgcatattgccaccgggggcttctattaatatacttcccttgcatgcacacaaatggagcatgcatgcagtcaacgcactcgccagtcgccagcaacgcgcgcttcccccgcgcgagcgatctcaggactcgattgatcgttgttgttcgcttggataagaacagaacaaattagggagaggaagcggagtggcggacgtgtgccatgcatattgccaccgggggcttctattaatatacttcccatggccttcagcgcgatagatctaaaaagaatccctgctgttatagcttattatcattgcgcttaagtttgcttccagacagtcacacctcagtcgtgacccgcagttttatgtgagttttcttacgtacgtacccctctcttaccagtaaatgtgctagcttatatgtatatgtatatgtttttttgtgatttctttcattatttcttgtagatggaaaatatgccccaatatgagggtaggttccgctggtatcctgatatagacactgtgttctgcaggggctgcgtcgacttgcttgacagcagcatcataaagcagaggcaatccaccttggatgatacagctctggaatatttgtcggaaaaactttataaggtgacaacaataacaatttcaaataaaacactcataaacagatggaaccgtatgaaacagttgtatgatgaccatgttctgcatcgtatccactcttcaaacatgggggagacgaaaagccgcaagatgcatattaaaaaaacaagggtattctctgtctctctttgattgaatccagattatatatattctaattatacgtttgtttcatttttagaaatgtggcaatgatttcaagcatatgataaatgaaccacctaagaatttggatctacttgagagattgtttcacgaacaagatgaagcgacaccgccacgacatgcgccattccagccaccaccgatgcccccaacacgtgcgccatcaaggacaccatcgccgtccccgccagcatcgtcgtggcatgacatgtctccctccaaggtagacgtttatgtcatccacaaacaactaaacactttgggcaaaagtatggatgccctgaaagaccaaatggatggcgttagcaagtcaaaatcttctcagtgtcgtgacagatgagtttttgatatgctgggctatttgcagccgagtagtggaatcaataagtattcacttttgtgtgttcagattatccattaataaattttgtcatcgatcaccatgatatataggttcaaggaactttttcagtgttgtttcttatgattcctttatgtgtttagcttgcatatttttacaatcagccatgataatagagatagagaaaggggcaaaaaaagaaagaaaagagggaagtggaataagaagagaaaaaggagaaaataatgagtaaggaggaggaagaaaaaattaagcggtagaaatggagaaaggaggaagaagccacaggcctccgcctgcgcagcccctctcggagccgatgatgccggtgatcgtgcattgcgtaacacctcctgacatctggcaccgacaatgatggtgatcccgatgtttgtggccggatcaggcgcatccgccggcgccatgtccgtgtgcgtacgtggtggccgagtta

SEQ ID NO: 480 - DNA, 2425 bp, Zea mays
cctgtttgaactttagcttcagatattaaacacaaaatataatatgaataatgctcctactgcccgtcataatgtgtttgatttattatgattatcttatttaggtaatgaaatttacaccaaatttattacataggatattgtttggggtgtgtaatcaatttaaagatatatcccgaagttcatattcatttattttgattgaaatcattttccagtgtctaatcttcattaagacctgttttgaccaacattattttattataatcattctctttagagagcggtggattctaaagttcaattatttatcaaaggcacttattttgtatagtgtgataaaaaaattacaaagaatttcctcaaatcccaagttaggattttgggtgttacatgaagacgcgaagccaagtgtgcggacgcttacctatgggtctggccatctggggggcagtgtgccattttattttcatgcatcaataatttgcatggacaataacatgtgttcatttccatattctaggcaggtgcaaagggtctcctttttgcagtacacattttcatatcgaatttgtaagtgaggcttctaatgtcgaagtaaaaaccaattctaggtttttgtgctagatgcattaattcttggaatgatcaaaccaagcaccatgccagggaatggtttaggatatgcttgggaatgggtatacatttgtgctttcaaggtaccgaactgagtctcattcctcttttattccttttttttaagaatggtataaaatgcactaaagtgactcagttgctatgcccaaccattttgattgcgctcgacattcctttttgtggttcattccctggaccatctgatggtgtagtagaaagtggacatatttgggtttctctgggtcatgctgctgaagcagggctgcaactcttaatctgctctcctacaccaatcttcggcaaagaggccatggagttgcatagaggagaatcaggctcgaaggtaattgttgcttgatatccttctacgtacaatggatagagggaagcctctccccaaggagtagctatagtactcctagaatcatcatgatgctggagctcttgctcttgcgccttccatcacaaacaggaatatttctcatgcttccacctgtagtccagtacctctgacaactcttgcaaaaatatttggtagcttaatgttgtagttgttgtactaacaaaactttgtatctatggattccaatttggaggtcctgagggttatgtgaagatagaggattttctctagctccttcaggaccttcgctccactcgggacataacccgacctacaaattagactctgatatggatatttcatcattgctggttgtttgattttcacactcatcactgaaattgttaaggctagaactatttgcctgaccaccatataattcccgatatgtgcattgcttttcccacagacactcatgtcccctctatcttcacatacaccatgacaaatataagaagactaagtaaaacaaatgtatcatgaaagcaggaaataaaaaaacccggtcgggaaggaaaagaccgccctcccggtattatattaagaagagaccgaaacatgattccagccgagaaaaccctcaaaccctggccccatcactaacgggccgatcaactgcccactctgcaacggcccagccggaggttggcgcgcaggatatcgatctccgagagcaggtggggcacagcaagaggattttttttaatcaagcctgaaattcgcccccgagggcgatcgaacccgagacctggaggtgctattcggaagccttaaccattacgctagagaccctttcacgatagcaggaaatatgatttgtaagatgctgtaaaatatgtttatataagaaaaaaggtcaagtaacatacctttagaaatccaaggagtcaagcaagtactcaatgcttatttattctgttataaattaaaattactcttatttattctgttatattaatgacattgttccattataaatggtctccgtctaatttatagaggttatctatcccccaccccacacacacaaagaagttctttttggctgactgcgctataggttgaccttgctttggttaccaaattcatttgctacgtttatggtgaggtgttgacctgtgcgcacaactaaggtagcacatattgtttccttggtttcatagtcagtttttatttaaagccaagtatatcatgtgcaatattataacggattagtaattactattatttatttatttatattcatgacattgttccattataaatggtctgatatagatgctatctattttcccccaaaaaaagttctttttgggtgactgcgctataggttgactctgctttaattaggtagtgtttggttga

SEQ ID NO: 481 - DNA, 2422 bp, Zea mays
tatactagtatatagcataaaagtatatacccatatgtaaccgcccagtttgaacgatgcaaacccccataaagaaaatgacccaaacaaccatttctcaaggatctctaattattttctactcacacatgcaatgcaaccatcatacgcagaataaccatatttagtaggaaaagaagtattagacagttaggtaccatgtccttccaagcttggttgtgtaggctcaattaatacagtatcatactctgtcaattcagactcatgggtaggtgtgtcatggacaatatgttgttgtgtatgaattgataatggagcacctgatagagtgtctggcagcgtagaaagccatggtaagccttaagaggagacacattgatttttttgaatgattcacttgtgctcaccaattatcgtgtcatcttgtccacattgtctaaactttttgtattcacgtcgcttatgcagtagaatttctttatccgcatcatccatattgatgtacctcgctcgattcattatgaggttgcccatggtagatgcagtagttgctaaagacaaacggaaatcaaataataaattatgtaagtagtaattataacaacgaattcctaccgtattgattataggttgaatgttgagaaatggttgaacatggttcccctgatgttggcagttggtgcaaagagcccctctcaccatcaggcgttaccggctctgccaccttcctgttatcgtctccagtggttgtggtttgtattacgatcgaagatccagtagcataagcctgtgtctgtctgagcgagtatagtactgcaagaggaagaatgagtattagtaactaaaaaataggacgatgttaattctcggcaggaagtacctatgtcatccttcttcctcgctcggtaatcacacattcttttatttctcgcctccctttcttcgttggtttcttcagctttcttcttgcacggtattctcgttgttttctatccctctcctcccgatgacgctcatgttcatcggtcggacctggttgtggggccatatctgtatttaaaaaatgttcgacatcagtaataaataataaaatgaaaagactgtgctacttggtttgattatgcatgaacctgtgataatttggttagatatatcagtaagcacagtctgtcgtcttgttcccattttaactggcgtactacatatttcgtcaccatattcactgtatgttcattgataatgtcggacgtagtaatcattggtatgtagccactccatgggatcacttggaccaattgagtccatgtattgcaatctggatgcctgagaaattgttgaacatggtgtctgcaacaagcaactcgtaccatacggcgtctcagcctgtgccacatgtgtgttgtcccctccaggagcttgcattacgatcgaagatccaaaaccaaaacgttgggactgttcgggcgagcatagcactacaatagacagatgaattatgttaaaaaacaatagaatgtagtataagatcataggggatacctgtctcagccttcttccatgcgcggtaatcacgcatccttttatttcttgtctccctttcttctgtggtttcatcagcctttctccgtgcatagtattctctttgttttctgttcctctcctccctcttacgttcttcgtcatcggatcgcactggttgtgggggcagatttattaagatatttaaatagctcgatattatcagtattaaacgaagacatggaaacatatcagtatgaacctttgttattctcattagatatatttataagcgcactctgtcccctagttcacattttgtttggtgatcacaaatatttggaaccttacaataggtaactcgtcagaattgaagtgattatatatgtaggatatgaactgtctgagtacatatacttgggatatatgtataatatgaactgtcccttagaatatgaacgggttgagactttttgtataagaaagcgtagagaagtttaggaggcgacaaatctcaaaggcaatgaagtgaataaacatttataatcgtggcaaaagtcatcaggataaagaggggggcgaaaaattttaaatctatgtttcttattgtaagctatgaaataccccacaagaagcattgcgaaagagatcaagtacataccagaacaaatgtacaaccacagttcgtaccctacgcttccaatcacataatggcatatttactaataaatgtttaacatattcaatgccgcctaaggtatagctactgaactgaaaaccagacaaagctatggttgaacaacgttcaataaaaaaacatagagttttcattctcgattccctttgtgacgttctatggaacgtgttatcagcacaagacgaggaacgtgttatcagcacaaga

SEQ ID NO: 482 - DNA, 2422 bp, Zea mays
gtgcgtccggtgattatttaaactacatcgctcgcgcaaatacgaacttggaagctcgatccaccgttgtgatctgtgtcccaaatacatttattataactcaacgactaaaatactcagtgcaaaataattaggatcgcaatctggatgtcgcatcgatatcgcgcgtttatttcacgatatgtcgagtcgtgtgtccgtataaaagttatacagagaatacgaaatcgtaagctcgacccactcttacgattattatctagagcaaatttatttagaactcgacgaataaagtttcggggcaaaataatccgaatcgcgcatcgtccgagagaaatcatacgcgagattaataatcaggagtatttggtaataaatcgattaaaaaagataaaggtaattagagctgaactcgaataatttctaatcgatttaacttcaacaaaatcagttgaaaattaaaataccaaagccaaaatccatgtagttcggtccgtgtgttctcgtctagatctgaatctccatttataaatcacgggtgaaaacgcatctcattccgaaaaatccactaaatcaaatccttctcaaatattctatcgaacttattttggttcaaccttttaaacatctctccatcttctctcccgccgttctctctctgatcttttcagccgcccgtggccaggatatttttcttcagccctatctccacgccctgatttttctaccgccgcctgtacttatcttcttccacctgcgcgcttattctcagccgccattcagttcatggacagaaaaatcccgccgtcgttcttcttcacgcggagccggccttcttccatctccatccccagctccggcggccgagctccaaactgaaacatctagtgctagcgcccaggacgcacgaccccctgctcctccatcctcagcgccggtcccagcttgggccctcccatggcgtccgctcggccctgcccttctccagccgcgcccgaccgaatctccctgcgtcgcgcgtctgactcgctctatagctcccgcgccctgtcatcctccatggctacgcgcgcgagctcgacggtcctccctgcccgagcccgtccctatggcgctcgacgccctgctcgcctctgcgctgcgccctgctttctggcgctcgccctgcctgctcaagcgcaagctcagctgagtccctctgtcgcgtgcttggctcgcccagctccctcgctcctgctgcgctcgcctgggtcgctggcgttgccctctgtttgccgcgcgcagccgacgtttctccctgacgcgtgctccgccttgccgtctccctgcgcgttgtggtatcccggctcttcctagctcggaccgcgctcagtccccagctcgccacgcgcggtcgagctctctgcgcacacgccgcgcgcagccgtgtccctatgctcgccgtggccggttccctgcgtcgtgccgggggtttcgccgcgcgtccctgcttgtcctctgtccacacgtcatgcatggagcaatgaaacaaaaatctgtgcgcgtcgagctcccgcgtcgaatcctttttcagcttgtccgtgacgcgcgcatgatggacgtgatgttgtcgcagcgtgtgtttgcgtccgagcccgcccggccacaacctcgctttgctctccgcgtcgctgctcgctgaatccagccccatgttgtcgtgtccctgttccagcttgttgtgccgcgtcgtcatcacttctgtcgcgagctcgatccccgctgtcatcgggcttcacacgtgctcgcatttgtcgtcgagctgttgaacccgtcctctcttgctcgtgactccgtcgtcacgtcgtgtgtgaagctctatatacgtcaccctcctgtatcgtcgtcaagctcgtcgaaccgcgaatcccggatgttagacaaaaataagcgaggtccatgtgcatcgcttatcaaggactcagtcaaagacttcaatcgaaggtcgtcgtcgttccatgcgtcatcaagaaatcctaagaatcaggtgatgacgaagctagaagcgtgatattcaccaagtgctcgacaaaagctcgaacaagccgttgatcgtcatcctcgtctacgccaagctctgtgaagattaggcgcagatgaaaataaatcagtacgcgaccggagaattctcgatatgagcaaagaagaagcacgattcgacgcaacactcaccctatttttggtgaaatgctgagctgataggcgtcgtcgatttcgaggtttcaagtcggatgtcataagggtaagttgattcatattccggtcaactaggtctataaatagattaaatagaattcttggtcacaataaatgctattaatttagcatgtgtatagtgtgatgatgcgatttagataaatcggtaaatcaagtaattaagata

SEQ ID NO: 483 - DNA, 2422 bp, Zea mays
tgttacatctgaagaataagcagtatgtatatgtgtaatcaagtttgtaatagcagtacgtattcagtagagtattcgtacattctgtttgagtattcgtagaggtcgaagtaaccgacctagtgggcctataaaatgtagtccagagattgaacagatatgaaccaaaaagaagaaagtagtcaccgcaactcatctgtgtcgagtggagatttcttcacgctcgtctcaggcgctcatgtcctgactctcgtcggcggccacaggtacaacttcattggtgacctagggtcatcacatagagacatgctagctgtctggtgggatgaatcaacatggatcgccatatccaaagctgctgcgaaggtcatcgtaggcgaaacactcggccttagcaaaggaccgtgccacggcgaaaaacggttagcaagggattcaggtttctcatgctccaaatgatcaatgatcttgttacaaattgtcaaagctaacccactttcagcattgttttctgcttccaataactcatttatggtaaagccttgttgtaaggctaacttagtgagaacaggtgtagagggaacaacagtgccatcatccagatcagactccgcatcagaaacagctgagtgatcccagaaacgacctctcagtgcggtctcaatcccatgaacatgcggttaagattttttggtcgactcataaacgatctccctttctttatgatagcactcgaaatccatgagtctatgtctatccacgtccgatctcaatttagaatctgagacaatgtctacagagctcgaccttgtgggcggtgccaacttgtttcgcataatgaagaaccaaggaccagaagaagaagaagaagggggagaaagacagaagagatatctggagccaaatacttacgccgcatgaaggaggtgacgccttgatcttaataaagatcctaactggcagtgaacagaagacgtcggaaccaagtcttccaaatatgcatcagttcaacctgaagtaaccagagatgaagaagaggaagccgatgaaaacacatcacacgtttacgaactggtatctaccctcagccatccgatgacatcccaacggtctggatctatttgagtgaaaggggtaccttgcatcaaatatgagcccacaaactgacgatcaatggttcacattggatgaaccctagatctattcccatccgcacaaccccgatcagacgttcacgaggtcgtcttctttcccatgctcggagtacataggcacccgcgcagcccccgagatgagcacgctggcgtgacccccgtggcagagctgggtgcacggcaagggatcctgagcgccccggccctcggtccatttccccctgggctgctccccagacccaagcggcaacgccgacatagtaggttgacagcggcaaccatcaatccggcccgcacccatctcccccgcctgatgacgccacaacgagttcgcatacgtccagacgaccatcctcaaccatacggcatgcgctgaacgacgagtaataggaggaacaatgatagagcagcggctgtcaatggcggcagctgggtctctctctcttaccagggatctcccgatttccccctgctctcagtattgcttcatggcgtctttgagtccgcaatcggctggacgagaggaggttcacggtcaccaatttatagcgaccatagatcatggtctcgtgagaggggaactcggccaactggggtgcggttgttacaacaaccagcgacattcacggggaggaagacgcttctggtgcaaggggcccaccaagaagccactgcgcgcgcgcccggctaagtaattgtgaggctgaccccgcggccccacaagatcagtgacacgcagaaaaaaaggagaggggaaaatgatgggcctccacgggaaaaaaacaagggtttaatgggccgctcgagctgcgagtggagaaaagaagatgggccggccgaagcaaatcagcataaacgcaagtatgatctttccttttgttttttctatttgctatccaatttcaaaattgagttcaaatctgcatttgagattttaactttaggtttttaatgcacaaacaaaaacaccagtataaaattcgccaaattattaatctaagtattggttgacatatgcaatacacaaataattttgaatgtgaaaagtttaatttagaaattcaaaaatattcattatattttttgtgaaaagtaaggttcaatatagagaattactttaggttggatatattctttacaagtattttatctatatagtttattccaaagtacttctagtcttacgatgattatattctcccatcttttcttagaatgagatgaattttctctagatcccaaaaacatggttttggggtgttacaatt

SEQ ID NO: 484 - DNA, 2417 bp, Zea mays
tacatatggtttaaaatagcatgcctaaactagtattgttaatagtctctcatagagcaaattgtaattaaaattcgaatgaaattttttctatatttaattcttttattataaattgatataaatgtaatagaataataacaaagaatcttaaaacatggatcaaactaaaagcagaattgcataaatatttctctcaattctagaaaattaccgatctaaataatatacatgttgcactttaaacatttataaagttacctcattcttcatacctacaaactctagtgctagcattcgaacatccaatatcttgggccctaaactcatgcgataggttgtctatttttaaggtaacattcctaaacaagtatgtcttacagtacgacatttggaaaagagtaatgaaagtgaaaatataatttttcttccattaactatttgtcctttaatagaggtcgtaactctgcagaatcgtttatcttgaaaaatctgcaaattacaattcaaatacttttaaagttacctcattcttcaaaacactgaactttaatcggcatgcgaccatctaattatgtgggtcccacactcaagttttgattgtgttgaattttagatgctggtggaccgtgtgaaacaacattttggatcattctataaatctaccacataatttagggtttcgaaaagcttcaaagttttcacatggttcatgccacaatcttttcgagaaaacatgcacgaaataatgaccctttactgacaaatcagtgtattgcgaaaactttgatgacaaaatttgttgggtcatttttgtaacaactaccgttataaacattacatcatttagggctttgaaccacttccaacttacattaatgtccataaccatgaaacttttgaaaaaatttcacatatgttatgagataacatgcccaaacaagtgatgtttatggtttggcaatgagaaaattgtaatgtaattttccttggttaaattgttttgtgataaatatcatgagtcccatactggttttttgagtggcctcaaaacatgtattgttgtccataaccaagaatcattaaaaatagcgctacatatggtttaagatagcatgcctaaactattattatttatagtctagcatagagcaaattgtaactaaaattggaataaattttttttctatatttaattcttttgttataaatatcattgatataactgtaatagaataataacaagggatcttaaaatatggattgaaataaaagcagaattgcataaatatagctctcaactccgaaaatttaccgatctaaaaattatatatgttgcactttaaacatttctaaagttacctcattcttcatatctacaaactatagtgccagcattccatcatccaatatcttgggccccaaactcatgctataggttgtgttgcagttgggttgatgatgaagcatgtgaaacaacatgttgcatagctcacgcctatagtaaattgatgatctgaaaaaatctacatgttgtgcttcaagcgcttttagagtcacctcatccttcatatgaccaaatctagtgctagcatgtgacaatctagggtcgcatactcatgatatggttttcttgaacatgggtcaatgatggtgcatgcgaaacaacacattgggtccatccataaaaaatgtctgtctaaacaatacaacatttagggcttcaaaaagcattgaagttggcgcacattagaaatcgatatatcatgcagtaaacttgtacgaatataatatccattagtcccgtactcatgttttgatcggccttaaacatgggttgatgtgttcacaactaagaaacattgcaaatagcacaatatatgttttaaggtaacatgcctaaacaagtatgtcttttagaaaagacaaatgaaagtggaaatataaattttcttctattaactaattttccattaatagaggtcgtaactctgcaaaatagtttatcttgaaaaatctgcatattgcaattcaaatacttttgaagttacctcgttcttgaaaacactcaactttaatcggcatgcgaccatctaattatgtgggtcccatactcaagttattgattgtgttaaattttagtttatggtggagcgtgtgaaacaacatgttggttcattctataaatctaccacataatttagtgcttcgaaaagcttcaaagtttttgcatggttcatcccacaatcttttcgagaaaacatgcacgaaatcatgaccctttactcccaaatcagtgtattgcgaaaactttgatgacaaacctttttgggtcctttttgtaaaaattaccgttctaaacattacatcatttatggctttgaaccgcttcaaacttacattaatattcataacca

SEQ ID NO: 485 - DNA, 2415 bp, Zea mays
tgtaacacctcaggtgtttatattcttctcgacaacaagtatggatttaagcacgtaatatcagtggataaaacgaatgctaaattttaaccatcttcgtctatcacaattttaatatcgcatctgtttcgtctgtcgcgagttcgacatcgtttttatttttatctatcggagctcttcctaaattttcgtgatgtttggaacatagttgtttcgagaatcggtgcgtccgatgattatttaaaatacatcgctcgcgcgaacacgaattcggaagctcgacccactagatgattttatcccgaacaaattaatcagacttccacgactaaagtgttcgaggcaaaataatctgtatcgcgcgtcgtctaagtgaaatcgtctgtgcgaatatgattcagtttatccgtctgcacgttgttttagcgacgaaatcatgtgtgctttcgcagatatggtttcgtctaacttcattcaatttacgcagagcaaatcctcgaagccaaaactatagtggttcggtccatttgtttctcgcctcgatttaaatctcaaaagtgaattaacagcacgattccgtccgagtttagagaattcgccaaatcaaatcattagtcctcggatttccatttcgagattcggggaatgggatgcgtagataactagtgtatcgacccagtgtacagcgctaaaaatcggaaacctaaaagcatttgcgaaattcgtttaggttcaactaaataaaaccgcgtcataattactgtctaccccgtatacatcgctaaaagaatcgtgatccgaaatatctgtaatttctaaaaaaaaaagggaaaaatatcctcgttcatctctatctacagtcgctctcctccctccctttgattttttctgccgtgatttttctgctcatcttcatccggccgccgttctggatccgtggaaaaatccagcgcgatcctatcctccagccgcccgcagcttggatttttccagccgatcttatctctggaaaagatctcagccgccgcgctgttaaaaatcctactcgccggcagaagttccgaagccaagcgcccacgtcttcttcctcgcggtgtccagcctcaactcagattcccggcgtcctctccatggctccctacgccctcgtcttccccctggtgccgcgcgggcgcgcccctggaacctcctcgctgcacgcagctgcttccccctcactccccagccgatttctctgcgcgcccagcccagccactcgccatggctcctccctgcgcgcgtcgaagttcctctgctcgtcccatctccccaaagcttcttcctccctgctcggcgcttcctattcccagcgctcgaccgccccagctcgcgcccaatcctcctgcttggatttcgtccagatcgagctgctcccatggcgatttcccctcggattcctccctgctcgtgccccatcgccatgaacgtgcgcgagtttccactggtggtcgtcgcgctggacacctcccctccggtctcctctctcaagcgctgcttcttcttcctgttgccgcgcgcccagccgcctttccttttcctctcgacgcccggccgagctcctccctcgcccatggccgcggttctccaagttcccctgcgcgcgcggtcctctgtccctgctcgccctctgcgcgtgcttctccctgctcctatgcgcgcgcggttctctgctcccccgcgcgctcgttctgttgctttttccagcacgccgcgcgcagctccctctagctctgaccatgccgcgtcgcgttcccgttcccagccatggtggtcgatccctgctgcccagctccttcggcacccagccaggccgtcctggatattgcgcgctcctcccggttgccatcgctcgccgtcgcctcctcgtgctggccgactagtctgtcgtggtcgcacgcagttccctgctcggccaggatggtcgcgtcgtcgatcccgcccggacctgcagccccaacacactgtttctctgctcggtgccaagtattctactacgtcacaccgtgtccacagtaagccgtgaagacgctactatgctcgctgctcgccacctgccaacataatgcaagaaccggctatcgatcttgtctctaccatcgccttcgctttacatctttgctcccgttgtcgcggagaccctgccagccctgcacgtcgtccacgctttgttgtgttcgcgtggaggggaattctgggaaattgggtgaagaaacccgcatggcgtttaccgggtgctcgacagatagctcatatcggagatcgtcgtcgttccgcgtgtcagcaagaaatttcaaaaatcgggtgaagacgaagctagcagcgtggtgttcaccaagtgcgcgacaaaagctcggacatcctgcgcgactcaagttc

SEQ ID NO: 486 - DNA, 2414 bp, Zea mays
tatattctgctcgacaacgagtacagatttaagcacgtaatatcagtcaatgaaacaaatgctaaaatttaatcatcttcacctattgcaattttaataccgcatctgttttgtctgtcgcgagttcgacatcgtctttatctatctaggctcttcctaaattttcgtgatgttcggaacataattgtcccgaaaatcggtgcgtccggtgattatttaaaattcatcgctcgcacgaatacaaattcggaagcccgacccactaagatgattttatcctgaacaaattaatctaaactcgtcgactaaggttttcggcgcaaataattctgtccccactcgtcaaccgagaaaatcgcgtccgcgaatttataattgagattcgattctccacgtaaattatctgttgacgtggagtcgggtgttgactgtggatgcaattatttgaattcaaatcaaatagaacacagtctcaaatactgttgttaacaccgttctgatttgttccgaggacgtctcgcccggattcaaaacttcgaatgtaaataatttgattcgctgaatttagagaatgaattgtgtatccgtattgcgtgtcgtcccgttgtttgtcattaaaaatcttaattctcaaaatatatgcgatttccatttaaaaaaaggaaattaaaaaaaagtgaaaagatctctagccgccgggggagaaaaaaatcctctctgcgttcctatccagcgctgcctccatccagattttttttcaccgccgtttctttgcttctttatcttctccgctgtggaggtttcttctacgcgtgctgtcgtcctctgctcggtgtttccctagccacagctgagctcccagcctgcgcgctctacttctccttcctcctgccgtgcccagcctctgtttttttccgtggctgcgcgccctccggttctctgcgtcgcgcccctggctcactggcgttactccctgccctctgctcgacatttccccggtttggatctcgtcaagctcccatgactgcctgctcgcgtgcctctggttccggccgcagctcggcgctcggagctccatccctggcgagcgcccttgctccctcgactatattccctccgcgcgctacagttttccctgccgcgaccccgccatggagctcccccgcggctcagctcggagttccctcggctcggtcccagttccctgcacgcgccctcgcttcctccctccatctctctcaagccgtgcgccctccctgctccctggagcttcctcgccgcgcccaaggttcctccatggctgcgctcccccgctgtctgagcgcagccgcgtcctcgagctcggcttcgagctccatctccctgcgccgctactctgctggccggctgccgctccctggtcggcacgctgcttcaagtttgctgagctccctggccatcgcgtcttccttgtcggcgctcagtcccgccgcgcgctttgtttcctgctcgccgtggtcggcgtctctctctgtccccagctcgaaccgtgggtcctcgcctgtgtcgcgttcctcagctcgctgcgcggcctgctccactgtgtcgatccgcccatctccctgagtccgtgcgcgcgctggacacgatgaaacgctgtgggtgcttgtgttcgagcccgcccgaccgtgtcctcgctttactctcgcgtcgttgctcgccgagtcttccccagcccgcgatctctccctgcccgtcgttgcgtcgttcgttggcgtgtgtgtagcaacgtcgatgattcctccatgatgcctttcgatgaacttcacttcatcgattcctctccttcggttcggctcacgtatgcacgccgaacgcgtttgccgtttgagcctgtgtcgctagagctcgcgctaacctgctcgaccacacattgtcagctcgctccagacacgatctcgttgtcgttccgtgcatcatcaagaaatcccaagagtctggtgaagatggagttagcagcatgacgttcaccaattactcgacgcaagggctgaaccagaatccttatcgtgttcgcggatagcgcgtcagatttagtatggtaagccgattcatatttctgttagtttaattaattggtttaatagattgtgtacataagtagagagtggtcgtgtcacgcggaacttaagtttaaaataattattgtgtgaggagtggttaagaaaataataggtctagtgtctcgctcatatagctggtaaatacggtcgtggttgattgtgcaagtgtattgtttaagaacatcgatgccctgcttaattagttaacttattctaggattagttggtggtaagcattttcagattttcttgtgtcaaatgatagtgggcataccatgctgactagataaaaatatatgtagtaatatgatt

SEQ ID NO: 487 - DNA, 2413 bp, Zea mays
  misc_feature (1218)..(1218): n is a, c, g, or t
cgccttgtgcatgcagaccatgcctgcatatagtgcgagtcttgcatccaccagttggggaacgcgctccagtgcggcctatgtttgaagagacacgtgtggttggcctgcagttgtgaccgcttctcatggtaagacgtgtgcatcatgtggcccggacgagacgagaggtgcagtgtctaggcatgtcgtcgtctacttctatttatttaatgggtgctagcgctgtatgtagggatccatcaatgatgtgccatctagtgctatgcgaaattgtggtgctctggtaggagaaagctagcaagacgatgctcctaatagtcacaagacagagagttgtgtatgtgtcttctcggtgagtcaaagagagagagcaagagaacaagcctattgattttgtgagtcctgacagttcatttatgtttgcagttcgtccgtgtgctagatcttgctgcaatcgggtctcaatggtcagtttgactaacatgcatgttattaattgcaactttctcatggagaagtagctaacttttcgtctaacttttggcccacgagaccactaaaaattgtctatagagaacaaattagtccacattattttatatacgccaaagttaaactaatctgcacctaactcttgtgtttagtctcgagatgagtggatgttatgattcagggtttacccatgtagcaaaatccaccggcattataagtttctcacccaataagaacctagtaaccagctaaccacctattcatatagttaggcctcatttggattagttaatctggactgcaactaaatcttgcattttagtctctggttgattttatttttataaagtttcaagatctttatccttgaccaaagacaacaacttttgcagctcatcctcaagaaacaacatcctctttttggcatttgtcgccactatttgtagtctaacaatttcatcatccttcttttgggcacccaattgcaactcatcaacattatgcaaaaactttttagcggcttcagtagcctgctttacctctattttcttcctcttaatggtcttagtgtaatcttcttccattttcttaagctggttccacacaaaattcttttttgcctgttatgctgagttttcactgtcctctgatctcatgatcttggaagctttctttagttttattatttcttacctaatatcttcctcacttttttggtgatcngaattgttgggactaaactttatttcatatattagtattgacaattcggatcccaaaaaattggagaagagattagggaagagattaaaaactaaagaaagcttactggatcctaagatgagagatgcacaatgaaatttcagcataacaaacgaaaaagaattatatgtggaaacatcttaagacaatggaagaatgttacggtgggaccattaagaggaagaacttacaggtaaagcaggctactgaagcagctcaaaagcttttgcataatgttgaggagttgcaagtgggagcacaaataaaggtgttgaaactgttagatgacatgtagtggcgataaatgccaaagatagtatgctatttcttgaggatgcgctgggaaatttgttctcttttgttaagcatgaaggtcttgaaactaataaaaatgaagatcaacaaaagactaaaacaaaagagttagctgtagtcgagtttagctgatccaaatgaggcctaactatatcaactttgtgtcaggtggttagcaggtctgaaaaatatagtttcgcttgtttacaccgtaggagcaggcttgaaaattaatctcgcgtttacatgcgatcatgacttaatttttctcccttaaggtgtattgtgttctatgggatagctcatccctcataattggagtcattgttggtttatttataggcacaattgggtgcactggaatcgaacaatgtaggatacgtctcctcttgtgtaaacaaaatcttatgcatgcttttctactacaaattgggtctcgtgggtcaggaactgtcgcgcgcttttgctgcaatcgggtctcagttctcagtttgacaaacaagcatgttattgattgctacattcttatggagaagtaggtaacttgttgtttgacttttggggcttgctagagtaaattgcccacgaggtcaccaaacttgtctatagagaccaagttagtcaacatatttttagagaggaaacaaccatttctatcaataggaatataacagagtcttcttacgagtggatgtgacatgattgaggttttacacacgtaaaaattgactagcctctgaagtttctcacccaattagaccccagtaatctgctgaccatatgtcacaaagttcatatagttgggtctcattcggatcagttaaactaaactgcacctaac

SEQ ID NO: 488 - DNA, 2413 bp, Zea mays
  misc_feature (615)..(616): n is a, c, g, or t
cgggtagtacaacttaaatatgtgccgttttttcctagcaagtacaccttatcttgcagcattgtgataccactattttttaaaatgaaaacaaatatgaaaggtgtggaccaatgacatggctgcctagcatggtggcgctgtcctcgtcggcagaatatggcaacgtgccggctccttgttgcttgtgtacgctgcctagcttggatgtcccacacgttccacacgctggacacttgttgtagtcgctgtcacgctcttgcctcgctccttcccggctacattacataacggatcggagtgtgatgatccatcgatggagctgtgagctgagctgagcttaccaccaccacacacgggagatagctatagctagcatagccagtcagcgacttagcagcagctagctagccatgctgccgtccttcgtgtcgccgacggcgagcgccgcggcctcggtgacgcctccgccgcggccgataccaggcagctacgggccaccggtgctgggcccgctacgggaccggctcgactacttctggttccagagccaggacgagttcttccggaagcgcgcggcggcacaccgcagcaccgtgttccgcaccaacatcnnaccgcccaccttccccttcttcgtgggcgtggacccgcgcgtggtcgccatcgtggacgccgccgccttcaccgcgctcttcgacccggacctcgtggacaagcgcgacatcctcatcgggccctacaacccgggcgccggcttcaccggcgggacgcgcgtcggcgtgtacctcgacacgcaggaggaggagcacgcgcgcgtcaagaccttcgccatggacctcctccaccgctccgcccgcacctggtccgccgacttccgcgcgagcgtcggcgccatgctggacgccgtggacgcggagttcggcaaggacgacggcagcgacaagaagccctccgccagctacctcgtccccctgcagcagtgcatcttccggttcctctgcaaggcgttcgtgggcgccgacccgtccgccgactggctggtggacaacttcggcttcaccatcctggacatctggctggcgctgcagatcctgcccacgcagaagatcggcctcgtccagccgctggaggagctgctcatccactcgttcccgctgccctccttcctcatctggccgggctactacgtgctgtaccgcttcatcgagaagcacggcgccgaggccgtggcctacgccgaggcgcagcacggcatcggcaagaaggacgccatcaacaacatgctgttcgtgctcggcttcaacgccttcggcggcttctccgtgttcctgcccttcctcgtggccaaggtcggcggcgccccggcgctgcgcgagcggctgcgggacgaggtgcggcgcgccatggtgggcaaagacggcgagttcgggttcgccaccgtccgcgaggacatgccgctggtgcggtcgacggtgtacgagatgctgcggatgcagccgcccgtgccgctgcagttcgggcgcgcgcgcagggacttcgtgctgcgctcccacggcggcgccgcgtaccaggtgtccgcgggcgaggtgctgtgcgggtaccagccgctggcgatgcgggaccccgaggtgttcgagcggcccgaggagttcgtgccggaacgcttcctcggcgacgagggcgccaggctgctgcagcacctcttctggtccaacgggccggagacggcgcagcccgggcccgggaacaagcagtgcgccgccaaggaggtggtggtggacacggcgtgcatgctgctggccgagctgttccggcgctacgacgacttcgaggtggagggcacctccttcaccaagctcgtcaagcgccaggcgtcgccgagcgtggcgcaggcagcagcagccgccggagcgcagcagtgagtgcgctgtataggatccatcggtggcgtgcgacgtcgccggcgccggcgccggccaagcaataaagtaatgagtaggccctcctcgtcatccacatgctcgtctgtgttcgacttcgatcggtgtctcttcctcccggccggccgctggccgccaaacagccgttgtggtaataaaaaaatcatttgtggaattgcagagtgtaccgtggtcacacacacttgtacagtgaattctttagtgacgctgcaataaaattgaatgaacatgtactcgctcctcgattgtcttgttgcttaattacctccgatcaaactaagaaaaactctgaacccttgacttaatttttcatggcttgtttcatttcttgttacgctaaggatagatcatgaagaaccaacaaaacccaatatttacagataaatcatagaaaccaccaaaatgacaggaagtcacacccaacgttcccgtctcagataaactgaatt

SEQ ID NO: 489 - DNA, 2411 bp, Zea mays
agaatctcggcacgatttttggctaacggacatcgggttgaagacgactctgtcagggtggccccatgtggcggtggctgaaagagcagaggcacgcggcgagggaatctaggcaatgggacccacgcgtcaaagtccccgcgtggtgaagagctagcgcgggtgtgggtaaagtgggccgcgcacaggagaagggatctagacgcgtgtgtggtagtgggctagggggaggaaaagccggtccatgacggtgaatcctgtgttttcttttcgttttctttttcctttctatttcaaatttcaaacactcaaatcaacttcaaatttaaattcctgtttgaactttagcttcagatattaaacacaaaatataatatgaataatgctcctactgcccgtcataatgtgtttgatttattatgattatcttatttaggtaatgaaatttacaccaaatttattacataggatattgtttggggtgtgtaatcaatttaaagatatatcccgaagttcatattcatttattttgattgaaatcattttccagtgtctaatcttcattaagacctgttttgaccaacattattttattataatcattctctttagagagcggtggattctaaagttcaattatttatcaaaggcacttattttgtatagtgtgataaaaaaattacaaagaatttcctcaaatcccaagttaggattttgggtgttacatgaagacgcgaagccaagtgtgcggacgcttacctatgggtctggccatctggggggcagtgtgccattttattttcatgcatcaataatttgcatggacaataacatgtgttcatttccatattctaggcaggtgcaaagggtctcctttttgcagtacacattttcatatcgaatttgtaagtgaggcttctaatgtcgaagtaaaaaccaattctaggtttttgtgctagatgcattaattcttggaatgatcaaaccaagcaccatgccagggaatggtttaggatatgcttgggaatgggtatacatttgtgctttcaaggtaccgaactgagtctcattcctcttttattccttttttttaagaatggtataaaatgcactaaagtgactcagttgctatgcccaaccattttgattgcgctcgacattcctttttgtggttcattccctggaccatctgatggtgtagtagaaagtggacatatttgggtttctctgggtcgtgctgctgaagcagggctgcaactcttaatctgctctcctacaccaatcttcggcaaagaggccatggagttgcatagaggagaatcaggctcgaaggtaattgttgcttgatatccttctacgtacaatggatagagggaagcctctccccaaggagtagctatagtactcctagaatcatcatgatgctggagctcttgctcttgcgcctttcatcacaaacaggaatatttctcatgcttccacctgtaatccagtacctctgacaactcttgcaaaaatatttggtagcttaatgttgtagttgttgtactaacaaaactttgtatctatggattccaatttggaggtcctgagggttatgtgaagatagaggattttctctagctccttcaggaccttcgctccactcgggacataacccgacctacaaattagactctgatatggatatttcatcattgctggttgtttgattttcacactcatcactgaaattgttaaggctagaactatttgcctgaccaccatataattcccgatatgtgcattgcttttcccacagacactcatgtcccctctatcttcacatacaccatgacaaatataagaagactaagtaaaacaaatgtatcatgaaagcaggaaataaaaaaacccggtcgggaaggaaaagaccgccctcccggtattatattaagaagagaccgaaacatgattccagccgagaaaaccctcaaaccctggccccatcactaacgggccgatcaactgcccactctgcaatggcccagccggaggttggcgcgcaggatatcgatctccgagagcaggtggggcacagcaagaggattttttttaatcaagcctgaaattcgcccccgagggggatcgaacccgagacctggaggtgctattcggaagccttaaccattacgctagagaccctttcacgatagcaggaaatatgatttgtaagatgctgtaaaatatgtttatataagaaaaaaggtcaagtaacatacctttagaaatccaaggagtcaagcaagtactcaatgcttatttattctgttataaattaaaattactcttatttattctgttatattaatgacattgttccattataaatggtctccgtctaatttatagagggtggacaagttgtcgcg

SEQ ID NO: 490 - DNA, 2410 bp, Zea mays
cattccaattttaattacaatttgctttatgccagactataaataacattagtttaggcatgctgttttaaaccatttgtagtgctattttgaatgattcttggttatgaacaatagtgcatgttttgaggccactcaaaaaacaaatatgggactcatgatatttatcaaaatacaatttaaccaaggaaaattacattacaattttttattgccaaagtgtaaacatcacttgtttaggcatgttatctcataagatatgtggaaagatttaaatgtttcattgttatggacattaatgtaagttcatagcagttcaaagcccttaatgacgtaatgtttagaacggtagtttttacaaaaatgacccaacaagatttgtcatcattgttttcgcaatacactgattgggagtaaagtgtcatgatttcgtgcatgtttttttgaaaagattgtggcatgaaccctacgaaaactttgtagcttttcgaagccctaaattatttggtagatttacagaatgatccaacatgttgtctcacacgctccaccaacaactaaaattcaacacactcaataacttcagtatgggacccacatgattagatggtcgcatgccgattaaggtttagtgttttaaaggatgaggtaactttagaagtatttgaattgcaatatgcagatttttcaagataaactattttgtagagttacggtgtctattaatggaaaaatagttaatggaagaaaatttatatttatactttcattactcttttctaaatgtcgtactataagacatacttgtttaagcatgttaccttaaaaacatatatagtgctatttgcaatgttcctcagttgtgaatacatcaacccaagtttaaggccgatcaagacatgtgtatgggacaaatgggtattatattcgtacaagtttgctgcatgatatatcgatttctgatgtgtgtcaacttcgaagcattttgaagccctaaatgttgtattgtttagacagacagtttttacagatggacccaacgtgttgtttcgcatgcaccatcattaacccatgttcaagacaaccgtaacatgagtatgcgaccctagattgttgcatgctagcagtagatttggtcatataaaggatgaggtgactctaaaagcgcttgaagcacaacatgtagatttttttttcaaatcatcaatttactacaggcatgagctatgcaacatgttgtttcacatgcttcatcatcaacctaagtgcaagacaacctatagcatgagtttggggcccaagatattggatgttcgaatgctgccactatagtttgtagatatgaagaatgaggtaactttagaaatgtttaaagtgcaacatgtatattttttagatcggtaattttccggagttgagagctatatttatgcaattaagcttttattttgatccatgttttacgattctttgttattattctattacagttatatcaatgatatttataacgaaagaattaatatagaaaaattttcattccaattttaattacaatttgctctatgctagactataaacaacaatagtctaggcatgctatcttaaaccatatgtagtgctattttaaatgattcttggttatggacatacttgtttaggcatgttaccttgtaacatatattgtgctatttgcaacgttccttagttgtgaacagttcaacccaagtttaagatcgatcaaaacatgagtatgggtctaatgggtatgatattcgtacaagtttgttgcatgatatatcgatttctgatgtgcgccaacttcgatgcattttgaagccctaaatgttgtattgtttagacagacagtttttacggatggacccaacgtgttgtttcgcataaaccatcattaacccatgttcaagacaaccataacatgagtatgcaaccctagattgtcgcatgttagcactagatttggtcatatgaaggatgatgtgactctaaaagcgattgaagcacaacatgtagattttttcatatcttcaatttaatataggcgtgagctatgcaacatgttgtttcaattgcttcatcatcaacccaagtgcaagacaacctatagcatgagtttggggcccaagatattggatgttccaatgctggcactagagtttgtagatatgaagaatgaggtaactttagaaatgtttaaagtgcaacatgtatattttttagatcggtaattttccggagttgagagctatatttatgcaattctgcttttatttcgatccatgttttaagattctttgttattattctattacagttatatcagtgatatttataagaaaagaattaaatatagaaaaattttcattccatttaattacaatttgttcta

SEQ ID NO: 491 - DNA, 2408 bp, Zea mays
tcgggagagcaagttccaacaaggggtgcgggatagcgagggctcaccaaggttcgacgacatcgtgaccggggctgtccaaatagtaagacgacgacgtgtgtcatggctgcacagatcgacgatgttgccgtgtgaggtcgacgtcgagacagggaaaactttctcgacgaaaatttttcgagaaaaccgaaaatcgcgtttctcgctagggcccagttatctatggagtttcaagaatgtattttgttttcatatctatgtatcttttgtaggtcaagatgaacaaccagccgctctccgtccaagatcaaaaaatgcagaagaagctctctatcaaaggcttgtacatgcttgagaaggttaagtacatctaaaattatagatgtgttgtctcagtgtttcaaatatttccttttactaattaatttgttgtcttactgttggaaaatatagtgatctaatcttcaagcacaagcacaagaatacggcgtatgcatggactcattcaatggcaagattttgaacatatggctctattgtatcagctctgtttcagtttcaccacaatattgctgatatatttggtttacgtggcctaccaatttttagaattgtgattgatttctatgcattatttgaactatgctaccaaagtactttatttatgtaatatttagtttatttggactgtctcattattctatgttctctatcgatatatattcgcagtcaatttgttattcattttgccatttatagaatcgttacatgtacatagtgacattaggtggtttctaaatgatctatatgttgttctgattaaactgagctgttcattctaaattttgtccgatttttttgagaaaaaacgaaaaatcggtgaggtccggttttttctgctaccggtaaggtaaaccctgacgtcgaccacagcgagtgcgatgaggcggagcacacgttgcaagggagctgtcgtggccgtgacggcgctggtcgccggcgtgtgttgggctgtgcagatccggggcggagcttgctacgatattccgtcgaacacgtcgagggcgcgacacgatggggttttcatgtttactgctgctgcacggccagggcgagcaccacaactggaaggtgtgggagagggcgacgtccacaccatgggaagtgagcagatgagatgcagcgatggggagagaccaatggacgagcagaaaggcatggcaagcttaccatgggtcggccatggcccatgggaggaagagcagggagcagaggaaatcgtccttgctgcaggaagggggccagggaggggcggtcatggcgaactggaggccgacagtggggttgaagccggatagagaaccgatggcgctggggcaatggaggacaagctcggacgtggaggtagcagacagggcacggccggctggtgttccacggaaacaactaggttggggtaacgtggagataagagagagaagcatgagcggtgggtaaaagaaaaaaaatcagatttttcttctcgaaacctttaacaaaagaaaaatatagatattttgggttctgaaatctaggtctaaaagaggtataaacaggtcgaatcaaacaaaactagcgacaaaatttgaaccagatttgattcgatttaatttgaaacctattcatccgcagtctaaacagggaaacatattaattacgaatactcaatatcggctctaattatctcggtccgatttaattctgcatcaatattgttgtcatcgagttctaataatatttacttgggtcaataatcacaagagtgggtcgaggttccaaattcttattcacttaatcaataaactttaatcagacacaagactcgacatttcgcgaaatacatacgcgagatcgatgtggcatcgaaattgtgatcctttcggaagcgacgtcacgcatcgttcacgtgggcaagagactgtgcgctatccagacaccggttagcacctgccacgcaccacgctgccagtccgcagatagacatgtgcaacgcaaacttgaaagaatttcaaacgaggtttatcagatccgatttcaaggattagagtttgggcaagacgtcgatggctcaacccaaacgatattggattcgatgtttcgaaagattactaaagtccgaattttgcaaaaaataaattagcgataatttagacagatggagacagacacgatatcaaaatcgtgatagacgaagatgattaaaatttagtgtccattttattcaccgctatcacgtgttaaagtccgcactcgtggtcgagcagacgataaacacctagggtgttacaagttatagggttcttcgtggagaagaagactctctgcgatatcgtggaccgtccggaagtctgcagaggaggagccgc

SEQ ID NO: 492 - DNA, 2407 bp, Zea mays
  misc_feature (662)..(663): n is a, c, g, or t
gaatggtcagattcgtcctcctctctgcgcggcgtcgacggcaacggccgccgcaattctcgcggagggaaacaaccacgcggacttcgtccctcccgtctatttaaacccgggttgctgaccaccgcattaaaccctgcaccgtgtgtgtgaacctcatcgacgaagaggggtttaggaagaagtgaaacttgccgccgtccttgaacctcccaggtgtggggcgattctggctctgactggtggtctggaagcatcgcaagaccgggtggaacttgtgcgtgtgcaggggtgggcacattgccccttcggagctcgtgaatcgctcactggagttgtgacctcgccgtggatccgccttctccgtgggctggcgttcctcgcgacctaatcctccagtaagacgccaccactagcttcaccattctaggtctgttacatagcactaaatttcgtaggaggttagtaccaggagacaacgattgggggtgcgctggcgatgctccgccgtatggcgctcacgccgtcgtgcttggccctagattgaagaagttaaccctaggcgttgatctcttaataaacgatctagattagaagacatagtgtatcctttcgtttggatcacgacccttggatccagtttcaggcgggtgaatgtggtnnaccgctccagtgaaacctagatctaatcctggccctcagggcataatccaacggttgcggtaagaaataaatcaccctggaggctagacataatgtaacagagagcaaaaaattgtatgggtcctgcttgaagtctagctaattgtgagcagccatcttctctataataggtggtgcttgccatacaatcaaggctccagtctcctcgatatgaccacatgttgagtcatgacaatagtaaaatgaactaagaagagcctatactccaaaaagaaaattgtaatcctagttgcacattcattatttattctaaatattgtccttatttattctagatatttgtccttctaaacatcaaggtttgtatgtcaactttagtacactacttattggaaaacactaaaataaacaattgtataccatttgcttaaatttttgttagaaatttatttgctaaattttattgtaaacattatttaatcgtggtatgccacgaactgaaattcacatgttttccgtgaagtaaatcatatttcgtcgtgtaaaaaactataccgattaaagacacaaaaattcacataaagaaacaataaggattcaggagatatgaaacagaggtaatatgtaaaaagcttgtttctcaaatagttgttagcatgctggttctacataatagcttttctaacaaaaataatgcagtgtactgaggactgcaacttgtaaatatgaaaggaaaataatgctgttttgacaatgcaacgataaacatgtttctgtcaatgtaacaatataggtgcacgattgagtacaattgactggcatgtttatcattttcccatttttaagaaaggcagaaagctgtgtaagctaatgtcagaaaggtaactgcatttatcgttgagtcgtccttatcgtcgactaattagatgattgggacgaccaggctccctaatcgagtcatctggctaatcaactgttaacaggcgaccaacctgactaatctcgattatcgtgattagttggacgaccttcaatcattgtttaggaatacatgtaatagagacatagagtcatccaacaatttaggacaagtaacaaggaccaaacatataagtgaggaacttatgatcaagtgaaatgggtctactttggaagctccactaccattaggacatgattcatggcatttcaggaatacaggtaaccaagacatagagtcgtccttggaagctatattcagcacctgcaactttcattcaaccatttagaaacgtgtggatttgtcatcctgagtgagcattatgtaagcactaagtaagcaccagaacacccaatttcaccagaaagattcaacagccttacatagggaagctttcaatgtttaggtacattggcttcacaaggtccggaactgattccaatgtggcaccatctcctataaaatgaaatggcaatagcaacatacagttacaatagaatttatgtgtagagaaatatgaagagctatagagcagcaatatgccccaaacatgtcactgttacctcccagatactgacaattaggtaaaaaaatacaccaaaatcacatagcaccgatctatatatcacatagttggttcgcctctactgtaaccctaaacttgaaatagcagtagtttaaccgacactgattaaagcattacagaaactgacagtgatgtaaccctaacaacctaacaaaaaacagcagcacaaatgcatggtt

SEQ ID NO: 493 - DNA, 2402 bp, Zea mays
atacgtttaacagcgagtacggacttaagcatggtatgtcagtgagaataacaatattcatatcctaatcatcttcgcctatcacaatttcgatattctatctatctttgtctctttgaactgtccaaaattctcgtaaaatttggagttaaataatcatctagaatgtcgacatagtcttatgtctgctaaaaattaattgattatacgagtacgaattagtaagccctcgacgtttataaactggaccacgcttgctacccgagcgtgcgtagagtaaaaattgggattttattttttcagcatgttattcaaggcaaagaaatcaaattcttgtctgatttcaactaaattaaactttatctaaaatatatttgacccataacattttgatctgatccatgtagatcctgccctaaaccatagttctaaaatggaggaatataattatgtcattacttttctaaaaacgagtagtaaaaaatctcttcccatccctatcccctgtcgccgccctcttctgatcttttcttcaccacgcgtgtgcggcctgatatttctagccgtcgttatctctctctccatcagctcacggcactccctcccctacttcccatggcggcagtgctccctctgccggcgccaccccttgctcctccaagccggcgtcctctactacatcttcttccccagccgcgtgccttggcgtctgcgcgccgtcgagctcctgcgcgcgcgttctcccgcgcccagccccattgccgcggtcgcccagctcgccatggccgccgagcttcgccctacccagctccctctgcccggccggagctccgctctctcatggcgcccaggatcttcctgctcggaccgcgccttactccagctcgccgaatccatctctcctccatggcgctcgtccagccgccggtgacgagccgctcgtcccatctccctatgtgccgagctcctccctcgcctccatggccgcgcttcctccctcctcggctctctggtgtttggcctccagctccagctcaccgaggtccctcctatggtcgtctccctcaagccgcagtgtgcccagccccagcctggaccacgcccctgcgttcaaccactccctgctcctctcggccagctgcttgcgcgtgctgcgcgacatcgggtccttgacgcgtgcgcgatggacgcgctgcgtgtgcttgtgtccgagcggccgcaacctcgctttgctcctcgcgtcgccgctcgccgagcccttccccagtccgagctcactccctgcccgctgtcgcgtcgttcgccgtcaagcctcgttgcccatcctggagttccctagtgtcagcctccacgcccgtcctaggccgtcgttgccagttcgcctccgtctcgtggtggtgttgcgctgccgtcgagtcccgatgtcgatctggtggccgttgatttgaagctctgcacggattcggccacgtccagcactatctaggtcattgttgttcgccttgcgctgtgtgcgacagcatcgtcgtttcctttcatgtgctcatcctcaatctccgcctcgccatcaccctctgtcgcagcaccgtgttgacgacttgctatcctcgccctcgcgctgacgcttcgtcgaatgccactccagtactcgccaagagaagatcttcagcaattgattactgaagaaaagaaggcccctgggtgacgtctacctagtactcaacgaaaggtctgaagtagaatttgtcaccgtgtccgtggaagtggagcgacttgatattggtaagcgaactcgttacttcggatagttggtatgataattggattggctagatttattaatcgtaataatcctcgtgtttagcgcaggcgcgttggggtcgtgtttgttaaatatatgtgaagtacgattgagttagtaatgcgaaaggtagattattttttgtgatatttgggcgagccgaccacgtaaaagatagatttagtatttcgtacaattatccgataaattttgtcattgtcgattatgctaaatatatttgtttagtgaagtcgaaatataagaaccccgtgcagaagaaacgttataggtctttagatttaaaaaattatggtctggtggtagtctttgatgtctgataaggttctgcttgctaaagcgaatgatgtgatgccatgttaattattgtgctaaacaagttaacctagagaattagtttaaaaagttaattaaacaatttctatgcttatcccaagtttgaatatcgagaggtaggttttaggagagtaaaatgcttatacctaatttactattgtgtgctgttagaattaaattcgattaagttagaatgccatagctatagttttaatgtgatatcgatatctagtattttcgtactaga

SEQ ID NO: 494 - DNA, 2401 bp, Zea mays
gtcgcgagtataaccatattacagcatatacccgcacacctcaatcaaatatcttacgccatcactactataatacaccacggcacacacatacgtgtccccatattacgcacaagacatcaacatcacaagtgactccaacaggattaatcatactcctcatctgcatcgactatcacaatcaccgatcacatgcataaaacaaatacacttttcacataaacacctatcgatgcatttcccaaaacataatccgcatttttaacttagttttcgcatcaaacaacgcatcgcatattttcctatcaaaatataaaaagatctgagttcttttctactttattttcttctctacacgattccattcatacaattatttttcccacacatattcacacatgcacatcatcgaccaaatacgtaaataaaacaaatcgcggatcactgaaggcgaacaacctggctgaaaccctattgaagttgagcatgcgtccacggtttaggtgcttcaccgaatcatgcgttgcgcgaggcgtagcagcaacatctagctgcgattaacaacacctagtggttcaaacattttttaagcacctgagatccaaaaatagtggggtactagcggagaggctcaccaaaggtttcgacgatgatgcgcagcagctgcgcagatccagcgaagcacgcgatgcagaggggattcgggccttgctgctgcttgcaaggtctcggctcggggagcagcgcgagtacaaggccgtcacggggggtcaatgctgtcgcggacgggctgcgcacacccggttcgagctcgacgacgagtgcgacgaagcaaaactcgcagcatgtagaccatgggggcagcagcgccatgggatgctatcgatggatgatgagggcgccagcgaggtgcttcagaagggggagtgcactgctcctacagaaggctgggcgccgagttccaaggagcaggtgtcggggaaggatcgctgcctaggtgagccgaagacctagactctggtgctgtccagcggggagggatggctcggcgtacatccaccatggctaggcgctgaagcgtcgagcatgtccctgtactctctactatagagaggaggccgagaggagatgtagcagggagtgggggcaccatgaggaggagccatggtgcgccatggaagggagcagggaggggcgccgagctagagggggcaggtccggccatggcaggactcctgccagcaatcccgcgcatgagaagagagggtcgcggcgcgctgctgaggtaggggcagggctcaccgactagccagctgagggagggcactggcattggggaagagcggtgctgcggaggagggctaggagaacgacgaccgactgtggggaagaaagcccctcctctacgggttcgagttgaggaagaaggggggtttctgatttccatgagagaggaggaatcccgctggggattgtggggaggggtcgctggacctggggcaacaccgaagagcagcaccatggggaagtggccttccctgctgctggcgaggtacgccagggaggcagccatgggaggcccttgctcctgcgctgagaagggggaaaacgcgaggagatgtttctatgctaaggaacagaggggagaagggagtgtcggctgaaggtgaggggcgccacctgctagctttatcggtgtgacggctataaccattggtcgggattgggtggcagccaacattggacgagcatggaggtggctgggaactggcgagcaagggcagcgagcaagccacgtgaccatgtctaccctgcgtcaaggaacagagagaaaggtgcaaagcagtgggaattaaaagagaaggatgctggttgatttaacgagacgtagcaggcaatctatttgccaccacgggcagcagccatctattggccagaggctggcagtgatatactatgccaggaatagggttaagaagagatggcgtgtgcgggaaaacggagagagagtggttgtaattgaagaggggctgattacttaggagctaagtaatctttattttatttctctgagacaagtgctcccgtatgagttgtctattaagacggtggtaatttattggttggagaggagtggtcatcttttagccgatttgcacagcgctcactcattggctgagaccaacactaggaacggagcgagctgacgtccggacgaattgagaggccacagaataaaatgaaccgaaacattttatttgggtgtcgctaggaaattaaattctcacgcaaaagtagagataaaatgaatttagatcgatcggcttcagattcgtcatcgaattaaagcgagtcggattaataaaaatcattgccgatgttgatttttgaattcggatcg

SEQ ID NO: 495 - DNA, 2401 bp, Zea mays
cacatgagcactaatacttttctttcgcgaccataatcatacgcatttagactacaacaagcaaatcatcgtgattacgagcttaaccaaaccatctaacaattcggctaactagagcaacgacatagaccgctaataacatacacgtcggcttgcctattatgatcgcagactgagacacaacctacactacatcgtttttataaacatacatatttatcatgtgaacagagcattttaataatcatcccaaaacaactaactccagtacacaacttgtattacgatccttcttgaccacccgatgtgactactagaatccgcgagcacaaccatacactatatgcgaagcataatttaacaaacacataatgcgcatcgactcgactcaacttataaacatagagaaaatgatgactaccttggcatgtcaccacccctccatttaagccgagacaatttctaccatcgactaagagttctaagtattaacacattattactttccgtgcacaaataatcttcaacttaacacatgtgacaccgatggatttttactaaactcgtcatgcacaaaccctgtctcgcatacaaccatattgtggcttgcacttgagacacttcaatcatcgtagcgtaacactaatatatgaactccgacactcatgtcttaataattcatcctctacgcaactagcattttctaaattacccgttgcatcgacaaatatactcctgatataatcacgaatcccatcacattgcataaaacaattacacttttcacacaaacacatatcaatgcattttccaaaacataatccgcattttgtaacttagttttcgcatcaaacaacgcatcgcacatttcctatcaaaataaaaattctcgagttctttttccacttcatttccttctctacacgcgtccattcatacaaatatattttcacacgcatataaacacgcaggcacatcatcgaccgaatatgcaaataaaacaaatcgcaatcattcaaggcgaacaacctggccgactcgtgtcgcgcatgcatgccattagtttgggctctttgccgacgcgcgatgcatgaggcatgacgtcgacaagggctgcgattaaacgacatacacaatcattacacaatttattatgtgattcattggtgcggctttttaatcgaacacgaaaagcacaggatagcagggagctcaccgtgggtttcgacgacgacgcgtaggcgctgcgcagatcgacggcatcacgcaagcgctgcgcagaacaccagcatgaccacatgcagccggttgtgcatatcgtcgagcaggtagtacgcgcggtggagcaatggttagggtgtcttgacaacgagctggcgaggccaagctgagcagcgagaacatcaggacgcggtggtggcttgctgttttccatgggagatgtagggggcgctagaaacttgctgttttggggagggcaccggcatccacggccaatagggaaaaaggggcgctaggcagaggaggtcaggagaaagtgtagcagggagtgggggctccatgagcgacggcgagctcactgctcgagctcggatcagaggatgtgccgcaccatggctggaacagaggggaggaagggcgccgtgcacagggatggatggcaggcgcgctgggcacgtcacagaggtgcgacggagaagctcgacgccatggggaggagatagcaggggcgctgcgccatggctgaaggcgcagggaacttggactggagctggacggcatcaatttcctggccatggggggccctggagcatcgagtttcatccttgagcagggcgctgggaaaagcagaggccgatggtctgggcgagtcttgcgtgtccggtgccctggccccgtcgctgctggaggggagggcatccatggtgaggaggggctgcatccatggaggagggcgcgccagcacaccttctcgagctcggacgctggaagggagccccgagggagccatagccgagggggaggggtggcgccatggaggccctgctggaatttctgggcgcctgttggtttgaggaagaagaagggggaggaggggtgcgcgcccagggaaggctgggggagctgctgctcggccacaccattggagccgaggaggaagggtgccatgggagcttggagcttggctccctgcctgctgccgtgtgggaggactgctgccagagggagaagaagacagggaggagaggttgtggcggctggaaaaaaaaggagggtgggaatgcaaaatagcccaagtacaagggtgacttgaagtcgcggccgcactgaccctatagtgagtcgtattaatttaaatcataccaacatggtcaaataaaacgaaaggctcagtcgaaag

SEQ ID NO: 496 - DNA, 2395 bp, Zea mays
acgacgacgagcgcgcaaactaatccgccgcatccataagtgattaatgatgatcctactttgataccactccaagattttacggatgctttgaatatagatggtaattgaactggacatgtcctaggggaggtagtaatggaggggtctctcgaaaaagaacatggtttggtttataggtggaggcttactgaaatagaccctgttgtttctgatgtaggagttggggatagaatgattgattcaagctctggtggtactaatcatgtctctgggagtaaaccaactggagcggcaaggaaacatgcagtactggagaggggatctcatagcaatactgattcaagtaatttcagagttaccagagatgcaattggtttcgaaatatgtattaaaaatggtaaactaatactgactattctctgtggatatctggttggacaccaagcatttttacccccatttgaatgcagagtcagagtatagacagctcaacaatgttgtcatatatttttataccaaattagagtgcacaatcgtttttctatttatgttcccagaaattcagttcactagggaacaccttacaggttggtcatgggtcaggattggatagcaagagttgtccgaagccggcagtaggtaaaaggaaaagctctataaaagcgaagaaatgaaatcgaaggatactagcacttctttctatacttgtaggctttctttcttatattcaacttcatgaattcgctatgctaggttcattccatccatctatcaggtttgagtaggtaggctctatccttaagaaaatgcacataaataagtgaatccgaaaagaccaagacttgaatgaagcccatttcccaggctagttgttgcccatgtagaataaccaaaagtgaagtgcataaagtgctattgtagccaatctttttctataaatggcaccacccgtctcgctaacttcacgtagaagcttcctttcccaggttatagagcaagtccttgttctaaagcttaatctacccctatgctatgaatgaacagatccacgagctgagaatcccaatccgccatatcagccttattgaacaacttaataatccggagagaagatgcttctcggaagacgatgaaaatgaggaacgaagttatcctaagtcgtgttttaaattggtgcccttagttttggtggtgtgctcacctatacccttagtcgtgttgagcacaccaccaaaactaatgcacgggctcaggttacgtacggattttatgcaacaaatacgatacataaggtgtagaatactttattgctactggcttttgcctttaacggatctcgctgcgcgcctcaatcgtatcttgtcttgcgcggagctagaagatcatcgactctttctttcgcatatgaataatactgggctacgcctatctgagtttatgcttaaccaaagaccaagcacttggaaaggacagaaaaggtcgttcctttactctattcctgacgttaggacagatacttaactagtgggaggccttacgagttgctcaaatcatctcttgatccggaatcacgggatcggtagatgtcacataacttgattagttagaaaatgattatgctatcggcttgatagaatacaaaatatgaataatacaagtgccggtcagctaatagcacctttggtgacatgttgttccccactagtcttcttcgtacatgcccatggggtcatccctaaggcctattcaacactgcacactgggtagcacgtaactagtggtcatgcttacttcagatgttctcagcctagctcagtctatcacttagacttctgatttcgtgctgtgttcaacaagctaggaacacaaaagaacgcttatcctcttagggtaggggccacattcttgcatactcttttggatctgacaacgtgagcatagagcaaatatctcttgataaaagagaaatagcaaagggaaatgtgctagctgataactcctactatttcgcttcgcgcctctgcctcgtttttagtgagatatgcccataatagggaatccaggactcctcacttgccttgccgcttcgcgcctacctcgttgactgatctcgtacaatcacttgcattttcctatgtggaaaacttagcaactactctacccttcccttagagtggaactcacagtgtacgtagcgagccacccataatcggcttggaagtgttgcagctcgcatccatcagacctggaaatacgctctctttctggaagtcactggccaagtatgacatagagaagatggatgaaattcgataaaaggccaaaggcgcgcctcaaagcaactgtctactactagtttatatgactagctcttatactatacgagttcctg

SEQ ID NO: 497 - DNA, 2394 bp, Zea mays
cagaagcatcaacaaaaaataaattagactacatactccacaaactccatacaaatagagatcctaacttaatatacaacagccacaattccacgaactctgtctaattatccttgctatagtttacaaagaagaaagaatacacaactctgtctgtttttgaattagcagaatgtttatgttgctacatcttggactattcccgcagttagtttgaataagggaaatgcagcatgtgtattctcactgcgtcaggcccaggtcggcatatgcgcaacgcacaatggcatcgagagagagagagaggaggggccagccccgtccgctagcccgaaatacatcagtcgcaatgacaagaccctcggtgcggtgcccgagcggcgtgcaacagatgcgtcggacctgtcatcatggcggtacgagcgatgcgaccaacagagccgccgacattgtgctgcagcgcgcatgcaagcaggagacttggcgcgccggattatgacctggccacgcacacgacgtgcacacacgcactagctagacgacctccttgcagcatcggcgctaaacaaactcacgtaaataaaaacaaccagcggctgcatgcacacagatggagcatgcatgcagtcgacgcagtcgacagtcgccaccgacatgcacttcccccgcgagcgatctcaagacttgatggatcgttgttgtttgcttggataagaactgaacaaattagggacagaaagcagagtggcgtacgtgtgccatgcatattgccactggcggcttctattaatatacttcccttgcatgcacacagatggagcatgcatgcagtcgacgcactcgccagtcgccagcgaggcgcgcttcccccgcgcgagcgatctcaagactcgatcgatcattattgttcgcttggataagaatggaacaaattagggagaggaagcggagtggcgtatgtgtgccatgcatattgccaccaggggcttctattaatatacttcccatggccttcagcgcgatagatctaaaaagaatccctgttgttatagcttattatcattgcgcttaagtttgcttccagacagtcacacctcagtcgtgaccagcagttttatgtgagttttcttacgtacgtacccctctcttaccagtaaatgtgctagcttatatgtctatgtatatgtttttttgtgatttctttcatttttttcttgtagatggaaaatatgacccaagatgagggtaggttctgctggtatccggatatagacactgtgttcttcaggggctgcatcgacttccttgacggcggcatcataaagtagaggcaatccaccttggatgatatctggaatatttgtcggaaaaactttataaggtgacaacaataacaatttcaaataaaacactcataaagagatggaaccgtatgaaacagttgtatgatgaccatgttctgcatcgtatccactcttcaaacatgggggagacgaaaagccgcaagatgcatattaaaaaaacaagggtattctctgtctctctttgattgaatctagattatatatattctaattatacatttgtttcatttttagaaatgtggcaatgatttcaagcatatgataaatgaaccacctaagaatttggatctacttgagagattgtttcacgaacaagatgaagcgacaccgccacgacatgctccattacagccaccgccgacgcccccaacacgtgtgccatcaaggacaccatcgccgtccccgccagcgtcgccgtggcatgacatgtctccctccaaggtagacgttatgtcatcaacaaacaaccaaacgctttgggcaaaaggatggatgccctgaaagtcaaaatcttctcagtgtcgtgacagatgagtttttgatatattgggctgtttgcagccgagtagtggaatcaataattattcacttttgtgtgttcagattatccattaataaattttgtcatcgatcaccatgatatataggttcaaggaactttttcagtgttgtttcttatgattcctttatgtgtctagcttgcatcttttttacaatcggccatgataatagagatagagaaaggggcaaaaaaagaaataaaagagggaagtggaataagaataaaaaaggagaaaataatgagtaaggaggaggaagaaaaaattaagcggtagaaatggagaaaggaggaagaagccacaggcctccgcctgcgcagcccctctcggagccgatgatgccggtgatcgtgcattgcgtaacacctcctgacctcaggcaccgacgatgatggtgatcccggtgtttgtggccggatcaggtgcatccgccagtgccatgtccgtgtgcgtacgtggtggccgagtta

SEQ ID NO: 498 - DNA, 2393 bp, Zea mays
gcagacgccacctggctcgctgtcgtcgcccccagcccccacctcttcaatggtgattcctccgcctagttactgcaatcggggctcccctaccatcattctctccctcctctaatgtctccttcccctagacagagaggtggcaccagtaccggtacgggtgctaccggcgaggtggagcctgatcgcatcccatggtgggaccaccctccaatggatccaggatgtgaggcaccaaaccaatcgaggtaagtggcatcggatctggcagtttccatgatgtcccccctctcggctcaccgccgtgctcccccaccttttctagggtcgttcctccacctagctaccacaaccacgactcatttttcatcattctctccctcctctactgtcttcttttcccttcactgctgctagagagagagaggtggcgcaggtgctaccagcaaggtggagcccggtcgcatcccatggaggacaacctttcaatggatataggatgtgaggtaccaattcagtggagaggtaagtcatgcagaatctagcagtttctaggttatcgccgctcccccggcacgtagacacattctcctgcaagcatcatcgagctcagttttcaggatgtcctgtaactaatactagtaggcaacatactaggtttagtcagacgacaataggtgattactaatggagatatttgccatgtgcattactgagtatatgatatatttccagacacgatatgaattgtgattaccacatttcagttttctgccttgaatatcttcatattttattgatgattcatgtggttttccttaagttagtaactcattatggaataattagatcaaaaactctagaagtttgtgtcacacaaaaatagtttcatcttcagaatgttactaacaagtacaatttcatggtccacgtgctacaaatatttggaaaaatacttttgctctgtgcttgatgtaattccacattgtattttccttttatttactcatgatttattgaagtattatttcttctaaaacaatattttgtgctaatttattttcagagcgtgtctacttcttgattggattgtttcctttactaagggtccagagaacttggttgcatatgctagaatgctagatggtatttgtgctcactaatagtccaaggttttcttaggtaaattagttattgttttcctttataaattttgtcccaaaatgattcaagactggtatttggttggtttaatttatatcttatacattctctgtgaggggtacaactaagaacctccaaaagaaaagcgaacaagtaattggtcatccattacgttgttagtattgtatgcttagttaactactcattttccatctatagaaaaaagttatttaataggtagctaaccctcttactttgttgcaaggctttttcaatatttgacaagttcagtaaattagatgtttttattttggagtctgtaggtacataaatcttatgtactgttttagttaactagtgataaaagttttaactgatattaacatagacaatacatgggcgatagatgaggctaagcatctaatttttgttcctgtcaaagtttttagtaattatcatcatttcatattctttctgtcttagtatatccaacatgatatactgggaaagaaaatagttttaaacccttgtcaattctagccactttttacattctctgaaaattctactacatgcattacttttgcactctctgtcttgtttgcagtttggtgttttattcttcggtatgtatacaagagagccccaaatcatcttctaacaaaaaggggtttaatattaggtgcatcttggtagatatgaaatatactactatacaagagagccacatgttataagacaaatgggttatagctacaagttggttatgttttctactagcttcgttatatgttctgacatgagttgcttttgtgttatgcaaaaacacaagaatcctgactgcaatggcaaatggaaggtgaaagcccttttgatcgacaacttaggtaaatttactgtttcattacacaccttgcgcaggtaactataagcctacttcctttctatgatgcttatccatttttagtactgatagttgccttcctagcattacctatttattaaaaaattgtagcaccctttcagattcacatgataataaaaatagtatcaaggaactgaataatgtgtcaaactgttagcaaaatatgcctgatcactggagaacttgtctcgagatatagtgaggcaaagtttcaatcatgatattggtgtagctattgctcatttcttgaactatttcattgggaacatttcatggaaagtttggatcatgatattggtcaacc

SEQ ID NO: 499 - DNA, 2393 bp, Zea mays
tgattttagaactattactaaaacattcaaagagaaatttccaatcaaactcacttctagacagtcaaaaagtgtctcattttttttggacagagagagcatgaaaaaagtactttgctctaccaacctgtttcatcttcccatggtaagcaattattggagaacctttaagcgagttaattagtggaagaacaacaacccaataatctacacaagcacatgttgcaaaatatctgcaattaatcacgataggaaggctcaaagttagcgcaatgctacataaaatatgccataagctaagcatactcagatagtaaaacagtggcaggtgttcccctttcatctattgatccatgtagcttgttttgaacttttgaagcttttagttgtttctaataataaaactatgtatattatgcgacaacatagaacataaatttactttttgcaaaacaagaatgaccgtatcagaaaagtttggtatccaaggctcttgttcaatcaatttggtggaaagcagaaagcacaagacctatcacccgtgtggctcatggaggcacaaacaggatggagtctggaggttgcgcagtgttactgtgcgtgggtttggcagaagcacggcgttgggaggttccgtcacattggacgcgacctacctggactcggatcgaacgcgtgctggtccctgctcacgtccgtgggtggctccctgctgtctctgctcccgtgttgcccatgcggctctgccgagcacacgacacaacagctagctagctatcgtcgggacgtgacttgtaaagacgcaaaatgatcacgcaatatgtccttttttttcgaatacaagaaaatttcctattttctgtgttttttcctgctaaaataaactaatttgacaatttctttgcattccaaaggggccttatatctggaagaaatccagccggtccaccaaaataaagggagcgcatctaacctagacgtcgttttcttgctgttccagctcgatcgcccatgtcgccgtcgactgggatgtttcaactacatggaaatgcagagttcatttcaacgagaaggcatcgttgcaacatagagaaaacaactatattgaggaaaataccacagcccgaaatagacagttcagcctatcagttttctgttttatgatgtttttaatgtaaaatagacatttcagacttatgtaatcctgaggtttgcagctcctttatgtagaacatttgatagaagagatgtgtcagttttatgatgttctaactcttgattttcaacacagacaaggtaagggataggctgacagaagaacactcaagaggtttgaagctcctttctgtagctgaatctaggaataaagaaattgctgcatgaagttcttgaaaaggtagcacaaaaagaaggcgaagttacagacttgacagagaaactggctttgttagaacctgagaatagatgactggttcgaacgaagcattaaaaaagaaagtggatgctatgctggtcatgtttgatgagctacaggaacggtttggttttactcatcaagctgagaaggaagaaactgcagagaagctagcagttcatgagaggataatctcacacctgacagaggtacacacaagaaccttggagctccattctctagctaaatcaaagaatgaagaaattgaaactcagttccgtgaggctcttcaaataatataacagaaagaaggtgaagttaaagaattgtgtaagaagctagatgcccttgaaattgagttgggaattgggatattatgaggagcaggcaacggaagccactgccgctgaaaagaatcacaaggttaaatttgatgtagcacttatgttatatctgcagcacatattgttagaagtgaaggctaccttgagattgtgataggcctctgaacccatctgcattgcttattcaaagtttatagcaccagcaaggaacgatcatagtttcctacaaataagaaatgtttatagttactacagaactacaactaaacatgttgatatggtggatatagatgaacaactaactgtcttaatatgtttctatttaggcaaaaggtgactcaagtgggccaaaaaagggaatggtgccttcaacttctcagattctgaaggtttggaggaatacttgaatgggaagaccatttccagcatgctttcaaccattaattattgtaattgcttacttatagagtggaacctacatagcaacaagcatccaatgttccgagaataagaattatgtgtgctggcatgacacatttatcaaattaagacgattttagaagaaaagcagcaccagctttgcaagctgcaattaacactatcagcatggcattggctccaagctcggcctgcat

SEQ ID NO: 500 - DNA, 2392 bp, Zea mays
gagtcaatgcactgttcaggactcgtcgcttttcctaaacacatgctcagactatattttgtgcgtcacaacttccacatcccattataaaagaatttccccatgacacttggtcttgtttgagctgtccattcacactcccacttttccatagaacatcacatttgtcacgatatctctcgaagcactttctaacctcatcttctcctctgacgccagattcccaaactacaatcatggttgcctctcattcgcatgaatttgaggtcgccataattaagtccaaggcccttaaatctttggtcatgattgaattacttcaagagaaaatataatccagtggaaaattacaggtaaagaaacctatcccatgactaatgctgacgagatcaccatcttttcttccttcttgatgcaaggatttagtctccctcttctcaattcttctgggatttgctccattattatcaaatcgagcttgttcatctcaaccctattctattctgcacatcaccatcttcgcgcacctttgtgaggcatatttggaaattccttctgtctttcccccttttagtatcttttctttcgctggccttgtcccagcaaagaacatctagctatagttgggattaagcttcgtgctaacaactaatacctcaactgtcctttgaaacctcccataaatactagcacaaacttttgttttatgttgaaaatcacgcccccaaaccacccgagttccttggaaaacaccctattccttgacttgagtagatgagtgacccactatccaagcacatcgatgccatctctgctacgatgagcaaaccaggagttgagagccctcgtcctctcgatggtgcatgtggtagggagctggacctagcgatgagcccccctccatgagaaagcaaactttgcatgtgaatatgatagagagactaatccctatcaatcaagagttcaaaccatcattatgccaaaggcggaggactagcttcaccagggattctcacccatcgaagactgaccaaaaggttgattgacaaaggcatattctatacttaagccatgacccaaggtactttaaggactatgccacttatcatttttttctgatcttgtttaactctgtcataatcattcctcacacttttaaatgctaaaacattatttgcttttacataaatttacttgggcaccaatagatgatgaggaacctgactcgagccacttacccaagtagcttgctgagcgagcccccatgagtcctcatgccgctaagaagtcgagtactcctcgtccatagaagaacgaggaaatagtctgagtcaatgactcagacaatgatgataatgacgattctcttcaaccctggctccaagtccatgatgctccaagaatcctatatttggcatttagatcaggaccctctcggtgacttagaaccggtgacagcgatgacccacataacccttcagccataggtgtcgccgagccagaggtctatgatgaatcgacctctaagaccgagacccaaaggtgctcctctactccaccaaaaaaatttcaaagaaattgcatgactaagattgtgaagcttcccacaaacggctgatgcaagactatttcaacgacccatgtgtctatcccctactctactttcgtcaaaggcaccacatgcgaaggagtctttttttcttcaaattttaaagaggttgggtaagcattccccctattttactatttgggtcatgtcactcaaccgcaatggtttgtcccctcacaaaaaatgcactgcttccctccacatgcttgcctatggtagcattgctgactacattgatgagtatatcaaaatagggaaaagctctcccttaaactaccttgaatatttctataagggtgtcatttcatgttttggtgaggagcatagttgttgtcatactactgatgatcttaggcgtattttagttaaaggagaagagagctaatttcctagtatgatagagagtatatattacttgcaagaaattggaggaactgtcccattgaatgaaaaagggtagtttactacgagaaattggatctccaaccatcatgctcgaatattgactccaacaaacctacaagcgatctgcaatcatcgcgtgaactacacagataggcgaatcattagggaagcgaggccatatcgaccgaactagcaaagtttgcgatcgagaactcaggttgaaaaggaggatctagggcttcagcatgagcttggatgaatctcgattgtatggagccccacggtgcctgcagatgaagctcgcacacaatgacatcgtcggtgaggaggacagaccgtggacgaggctttttgatccttcgctgtctcttatacaca

SEQ ID NO: 501 - DNA, 2391 bp, Zea mays
tgccaattatatcagcgctgattcaagacataaagcaggggttccataggcgaggttcaatcagcatatccaagatcggcagggatcaaaataagatagctcattgtgtccttttgtttaggtaaacatgcatgactgggttagaatctagagtggtaaaatatagacttttagtaaaatcgtaggttgtagccaggtaaatcataggtccagggttggtaaaatccggagtggtaaaatctgggctctgtgtcgaaacggactagctcctcaccagtcaaaatggaccaactctgtgtcagtcaaaacggaccagttttgtgccagccaaaacggaccagcactgctctccaacgctgccatgttgaaggttggtaaaatcttaggttatagatggtaatatcgtatgttcttgatggtaaaatcttatgttccactacgaggtaaaatcgttggttcgggatggtaaaatctcagggttggtataatacagaggggtaaaaatattttacataaaaccgcaaaatattttacataaaaccgcaggttgtacacttgtacctcaacatcctgccagtaaggtattttgatagggtttgcatgattcatggcctcaaaaagcttaaactatcctatgtgtattgatacgaaggtatagtgtgcctctgtactggcacaacaccatgaatccttgtcttaaaaacatatacggttcctagttccctttatagttagtgatgtggggatccagcaacccgatatatgtaaacacgtatatgcatcttagggcccgacatgattgaaagatatatacgactcctggaccccgatctactttaaacacatatacgcaatctggtacccgatacattctggacatatattaggttccagataaccggtgcattgctgtgtggcccaggattaataggtatcttgcatgcctatatgtatgagaaaaatacataaatcatatctgcaagttaattgaagaactcttttttttttatgtttctcaatgtgttgcaagtccacagttgcaaaccagaaaatacaattagatttgactatccatctaaagacaaatgtcaaattttaagacgcgcaggcaatgaggataatggactaaccacagtagctaatggacagtcacatagcagcataaagccccaacatcacgttaatccagtcatgcatgtttacctaaacaaaaggacacaatagcatttcatccattcagtaatgcacgtacttgcagacacgtagaatcacagctgcaaccactataacacaattcataactacggtaacaacttcagaggttctgcttatgctccccagtacagtaacatgttacagatagtaacattgtatcgaattcaatctgtccagctcaacgtctatttttttttgtttttttactaccgaagatgtcacttggcagttcagcagtatttttgggatggcaaagaaggtacaccaggtttaaatccttgtaatttagaccaaagcactgcaaattgaaataaaaaggagataatgcaggttatgttatgcacaatagtacgaagttggaaacatgaatttaaagggaatatagactaacctttttgttaaacctgtcggttccattgtactgctcaaggaaaaacatgcattgaccttgggctcggcatcgaattcaacacgtgccaaccgtatctgcttggtggtagaaattggatactcgtaatcgcaatcctttagaacctcttcaaattgctccaaaaatgttatagtgtagtttttaacctgatcctttattttggttttgttggaatgtatgatcgatacctggcttattgtatgaacatcaacaaaaattataaaccattcttcattggtatatatagaacaaactacttgcaaaagttgagtgcattatcactgagtttattaccataagagagtgcattatcactgagtttattatcagaagaatattgcagcacttacaaatttctgctttatctttttttttcttcctttgcttcctttgtcttcaagctccttctgctttatcttcttttttcctttgcttcgtttgtcttcaagctccttcacaatcgcttgcctaagattgtgttgtaggtctgcactccaaacttgattcttaatttgtcatattttttatttcgatcatcaaacttgaggcattcaacgaaggcattcataattactttcgtggcagtgccaccttcctcgaagcactttacaagatcaccacatgtcatggtggccccatccacattgaacagtggacaagttgtcgcggccgcttctatagtgtcacctaaatactagtgactccagcgtaactggactggccacagttaggccgcaaatgtaatc

SEQ ID NO: 502 - DNA, 2390 bp, Zea mays
aacagaacgaaggcaagttacattcgaacgaaagtaaattgcatcacagcaagtaaaccttcaagtgtttttctgtctcacactacaaatattacaattatatcgaatgtttttcacacatcaaatgtatatggaccaaacttggcttcgttataaatttgttcgcggattctccagactatgtcgtctgcagccttctttgcttgtgccgcggccacaacttcggcttggatggcgacgtcttcagcctcggcttcagtatgttttacttcaattatcacctgcgaagtagagacttccaaccaaaatttagaaagggggcccacaatatatgtacaaatgtggtccataaaagaaacaagggaaaaaagcaccttcagcctttttctgctgtagactctttctaatgctagcagcattttcagtcgccttccgaagctgcaaaagaattggtttgaattttttttagaaaaaagaacatacacccttcagaccagtaaaataaaaataataacagaggaaagtagccgtatacaaaccttttcactgttttttattgcttcttcaatactgacttctttgccacccttagaccaaatgtcagataagaattttttgccccattctaaagcctcggtagtcgatcttcgaacactttcagccgagacttcgaagtcaggcttcgagcaagcttttatatgacggcagccaacttttaataaaatcgaagcagtgcttcgggcgcctatccaagcacagtaatcttcgcgagtagagaggacccctttatatgcgtggatttcgtttcgaatccatcgcatcaggccttccaaatcaccttcggcacatttttctcgacatgttgcacctgccgaagtgaaggtcttctctaactccctttgacacctattgcctaaagtgtaagaattgctcatcaaaattttatagttttccttcagctgcatcaagtgatcaatttcatccttgagatcccctatcttcacctggctagtcgtggctgcttcggtagttgccagcttcagcttcctactctcatcttcaaatttgtctcctgcttctctcagctcagcttcgagcgagctagtgcgcttgtcctttttgacatttgaagctttgaaccctgaagattccctttccaaggcttccttgagcttattcttctcttcagtgagagtctgaacttcagttcgactcttaagaaagtcactctccaaaaccttgaaagattttttttcatcgcttttgttccgaagcctagatacttcagaccttagattcaaaatttctttttgggcagcttcgccattaatatttttcctattctttagagctttactcaaaaacaagccctgcagagttagaaaaaatggtgataatcacgctgcgtaacaaacaagtccgaacagtaaggtaaaacaatgtaaagtatacctttaaatgcgtgtagctgaggcagtcagaaaattcatcgaagggcatcaatgatagcccagcttcaagtttcgggaaaccaatgttatcgccatgtagaggcacacatcggtctcaaaattatctaggtagcatagcaaataatcatctagcccacctctgaagattgttgcccccgaggggtaccctagctgttcagcaaaaccgatggcttcggccagctgtttagcacccatgacctttcctgccgcttggtggaccctgtactttcggcctccaagttcttggtcgaagggcccttcgccaagtggtgcgtcgtcttcaatagcctttttggcatcttccagctctgcgggcttttttcccttgtcttccgccattataggcttcgaagaaccaacattctcttcggccaccacggtcgccaaaggtgtcgctaccagcgtcgccggttcaaccatcaggctatctggcctcgacgcattcacaacagaaggtgtctcaacctttgttgcaaagatcttcacagtgctgtcctcatcatcttcatcatcaaaaagagagctcatcacaggagctatgcgtacaccatcttcttcctcgctgtctagcaaggaatcattaatttcgagctccagtctaactatttttccggccttcgtctcctcggtttccgaagcaacatcttcccagtcttccaaggtcatgtcaaccaaggaagtctcttcaacggtaggcaggcttgtaccttcgggtatagcctgcataataaaaaaacaaaacacaacaactaagcacaatagatttaagccaaaaaaatagcataactcaaaaactcttttgtaccggcaaagccgaccccaaagctccagagggcgtcgccccgtgccttatcttcggcaccttactccgcttggttttcatcttcttctgcctct

SEQ ID NO: 503 - DNA, 2282 bp, Zea mays
ttatcttgaacaaattaatttgaactcgaagactaaaatgttcagggcaaaataatctgaatcgcgtattgtatgagaaaaatcatgcgcgagattgctaaccaaggaattataattgagatttgattctccaataaatcatcaatggcagagtgattaggtgttcgagtggcagacgaagttatatggtttcaagtcgtatcaaatatagtttaaaatatcagtctcaatctcgtttgggttcattctatgtgcatcctacccgaacccgatattatccgagacaaagagattaccgtttgattttatagcagataatattgggtccgaaagaatactcctgatcgcttgcgttaccaagaaaccgtgcacaagattaacaattgggattattcattagtgtgctattctaggtagagaaatcaaatcgattaggaaaacagataaatttttatctgagttcaactaaattaatagagtctcaagtaccgtatccggatagtgttttggtccttgtgtttcccggctagatccaaaacttcggatataaataacgggtgaaaattcatctaattccgagagtattcaccaaatcaaatcctatctaaatattgttgtcagtctcatttttgtttgatccttttgtatattttttagactctaatttcataccctaaaatatgtgtattttgttgtttttaaaaaaagaaggaaaaacagggaaaatccttctctaaatatttccaccgttccttggtatgattttcaacgtaattggatttttcactatagaaaatatctctctatcgttgttttcttctcaagtacgtaaacttcctagaatatcattggtcgtcatcgatattttctttgctagcaatcgtattcgatgcattttttccttgtctctgtcgccgcttaagtgggtaaccggtagaatatcttcttctacatgtgcatactctcccagccttatcttcttctacagatttttttccttagcattatctctcctctccacacggcaacaggcgcttgttctcacatcttcctcctgcagctgcgccctggtcccggacatcccagcgtcgtcccatctcctccctcccagtcgactttctgctcttccatggctgcttgctccactgtgcagccgctcagctccttgacctcccctcaactttctccagccgccagtgctcgccaagtcgatctcccatggcagctagtcagccctgctctccagtgcaagccgcgctcctccatcgcttcattcctccgctcgcctaactcgtccatggctgtcgtgccgagttcgccctgcgcgcagccaacgtttctccctaacgcgctcgcacagccatctcccatggcacgcgtctcccctgcgcgtacgtctccctgtccaccttcctgttgcgcctctctccgtcgaagctccctgctgctcgccatggcgtcttccagtctctagctcgccctactccttgttgctgcgagctccagctcggattcagcccagctcggatcttttccatggtcgttgcgcactggccctgctcggattctcgtcgtgcgtacttgggcactgccccagtggccacctgctccaatcgccgcgcccaatcgagtacacccctgcgcgcaaccgtgggtttcgctgcgcagcgttcctgctccctggcctccgtcgtgctcggtagcaagtaattcatgtcgaagcagcagctgcgatcccttgcgtcatgctcgccagatcgagtctcgcatcgtcgatctgcacagttcctgttcggctatcggttccgcctacgtcgatctcctaattgccatggatcgtgtatcgacgtcccattacaacagcccgtcgtaaaactctagtgcttgtctttgatatccggtcgtctccaacctttgtcttgtcgtcgtcgtttggtcacccgtctcgatgtcggtccctacgtgatgccgctgagttggagtcgtgctgacaaatgaagccccaagagaagactaagaagcagtttctcattcatgtgtataggtagatttgcatgctatggctcttgtgatggctaaggagacttgttatgttgcttgcttgatgattttggtgtttcactacaggtgtatcgcacgcatgatccattcaatcatgagcttatagtattcattagtgttgatgtttattacacttccacacatgtttagggtattaagatttctcttggtaatgtaccttcaatggctgattactgattaatggggtcgggaaaacacct

SEQ ID NO: 504 - DNA, 2288 bp, Zea mays
caaaggttagcaataagccaacaggacaaagctataacaaaacaaaggtaaattatatcacagcgcaacaaccttctaaatgtttctctaccaggcactacaaatattacaaatatatcgaatgtttttcatacatcaaatttatatggcctaaactttgcttcctcataaagttgctcacatatcttccagattatatcatctgcagccttctttgcctgtgccacggccacaacttcggcttggagcgcagcgtcttcagcttcgtcctcaatacgttttacttcaattattacctgcaaagtagaaacttccgactaaattttagaaagcggatccacaatacatgcataaacaacgttgataaaagaaacaagggaaaaaagcaccttcggcctttttctgctgaagactcctcctgatgctggcagccttttccgccgctttccgaagctgcaaaagagtcgaactcacacacatttgactaatataatggaaataatcagaaaaggaaggtagccgctcaaaaaccttttcaccgttcttggccatttcttcagtgctaatatctttgccgcccttggaccatatatcagataggaattttttgccccactccgatgcctcagctatagattttcgaacgcttttagccgagacctcgaagttaggttttgaacaagcctgcatgtgttggcagccagatttcaacagaaccgaagcagtgcttcgggcgcctatccatgcgcagtaatcctcgcggctagagagtatccctttgtacgcacggatttcgttgaggatccaccgcatcaagccttccaattcaccttcggcgcatttgtctcgagatattgcaccaaccgaggtgaaggccttctctaactccctttggcatctattgcccaaagtatagcaattactcattaaaattttatagttttcttttagctgcatcaggtgattgatttcttctttaagatcatctatttttatttggctagccatggccgcttcagcagctgctaatttcagcttctctctctcagtttcgaatttgtttcccgcctctctcagctcagcctcgagcgaggcaatgcgcttgtgcttctccgcagtcgaagtatcgagctccaaagacttcgtatccaaggcctccttgagcttgtccttttctttagtaagactctgagcttcggttcggctctcaaggaggtcgctcttcaaaactaaagattcttctttttcattgcactcattccgaagcctggacacttcggacctcagtttcaaaatttctttttgggcagcttcgccctcaatgttctttctattttttagagttttgctcaaaatcaagccctgcaaagttggaaaagatagtgaaaatcatattgcataacagacaaacccgaccagcaaaaaaaacaatgcaaattatacctttaaatgtgtgtatgcaaggcagtcagaaaaatcgtcaaagggcatcagcgatagcccagcctcaagtttagggaaaccaatgtccgccatgtagcgacacacatcagtctccaaattatcagggcagcacaacagatagttgtcttgccctccaccgaagatcgtggcccccggagggtacccaagttcttcagcaaagccatacgcttcggccagttgcttagcgcccatagtttttccggccgcctggtgaatcctatattttcgacctccaaactcttggtcgaatggcccttcgtagagtggtgtgtcgtcttctatggcctttttggcctcctcaatctctgcaggacctttccccttgtcctcgacaatcgcaggcttcgaagaaccaatcttctcttcggccaccgctatgactgaaggtgtcacagctggcaagggtgattgggccatcgggctttctggccttggcgcattcgcgccatgagatgcttcggtctctgtagcaaaaaccttcgcaacactatcctcatcatcttcgtcttcaaaaagagagctcatcacaggagctatgcgcacaatgtcctcttcatcgctgtccgacaaagaatcattaatctcaagctccattccagccacattcctcgccttcgtctcctcggattctgaagcgaagtcttcccagtcttccgatgtcatggcaaccacgacagttccttcagcggtgggcaggcttgtaccttcgggcacagcctaaaaaagaaaaaaaacttagcacaatacatttaaacaaaatatatataacataacttggaaaactttttcataccgacagagcc

SEQ ID NO: 505 - DNA, 2388 bp, Zea mays
gcctatcctacgtcatgtaagtgagaaaaaaacaaatagaaaggcgaaaggaacagaaaccctcgtgtagcagcctacgagcgcaggctttggcctctgcgtatcttgcgcgggttggccaccgttgggcatggccaacggacagccgccgccacgctgcccaatgtgcggtgcgagccactcgccgcacagccagcctcgcctttgaagctccatgcattgccttgctccatttcttttcattcgaacgaaggagcacctgcagtatgcagcccgaccttcttctacctctagccttccccagtagagctccttggaacatggaattttccacctctactgcaccttccctggctacgcacttggcctcacctccccgccatctccctcaaccagcagccaccatctccctgtatttccaagccgtggagcccaggatgccgaccagggacaccagcaaccggcgtccccagctcgagcaggtgctctccccatggcgacccctctcctccccacatagtcggcgcaggcaccttctcccatggcgctcagccccgcgctccctgcgtgggtctccagccggctccccctgccagctccctgccccacgcgccctcagccatggtgcgggaccttctctggtccgagctcaagcagcgcctggactgcgctcgccgagctcctcctcacgtgctcctccaccggtccgcgcccccgcacttgcagcagcggccatggattccctctgcgtcgcgccttcggcatgctcgacgtaatgccgcagcaagcagcagcagcgacgccctccactgcgtcgctctcgccaggtcgggcctcacgccgtcgatctgcgcagcgcttgcgcgttgtcgtcgagatccttgtgagcccctcgctagtatcccattgttttttagatctcaagtgcttgataaaaatgtttgaaccactaggtgttgttaatcgcagcaagatgttgttgttaatcgcagcaagatgttgccgctgcgcctcgcgcgacacatgattgggtgaagcagctaaaccgtggatgcatgcgcaactccactcgggtttcggccaggttgttcgctttagagaaaattgtgattttgtttatttacgattcagtcgatggcgtgaatatgtgtgtgaaaatatatttgtatgaatgaaagcgtgtagagaagaaaatgaagtaaaaaagaactcggatgtttttatgtttttggtaggaatgtattggatgtgtggtttgctgtgaggattaatcttaaaatgcaggttatgttgtggggaatgcatcaatggtgtttacgacttacgagacaagtgctccatttcttttcattcgaacgaaggagcacctgcagcatgcagcccgaccttcttctacctctagccttcccctgtagagctccttggaacatggaattttccacctctgctgcacctcccctgggctacgcacttggcctcacctccccgccatctccctcaaccagcagccaccatcttcctgtatttccaagccgtggagcccaggatgccgaccagggacaccagcaaccggcgtccccagctcgagcaggtgctctccccatggtgacccctctcctccccacatagtcggcgcaggcaccttctcccatggcgctcagccccgtgctccctgcgtgggtctccagccggctcccccctgcgagctccctgccccacgcgccctcagccatggcgcgggaccttctctggtccgagctcaagcagtgcctggactgcgctcgccgatgtcctcctcacgtgctcctccactggtctgtgcccccgcacttgcagcagcggccatggatcccctctgcgtcgcgccctcggcgtgctcgacgtaatgccgcagcaagcagcagcagcgacgccctccgctgcgtcgctctcgccaggtcggtcctcacgccgtcgatctacgcagcgcttgcgcgttgtcgtcgagatccttggtgagcccctcgctagtatcccattgttttttggatctcaagtgcttgataaaaatgtttgaaccactaggtgttattaatcgcagcaagatgttgccgctgcgcctcgcgcaacacatgattcggtgaagcacctaaaccgtggacgcatgcgtaactccactcgggttttggccaagttgtttgctttagagaaaattgtgattttgttttatttacgatttagtcgatggcgtgaaaatgtgcgtgaaagtataattgtatgaatggacgcgtgtacagaagaaaatgaagtagaaaaggactcagatgtttttatattttgataggaaaaaatatgcgatacgttgtttgatgcgaagactaagttaaaaaatgcggattatgttttggg

SEQ ID NO: 506 - DNA, 2284 bp, Zea mays
ctctttataaaaaaaggagagaaaaagaaaaaaatctggaaaatatcttttatccctatatatgcgccgatctttctccctatctgatattttccaccgccctcaccgatttttttgtttctggccgattcttatctgcggactgccgctggcgtcggcttcctgggtattgttttttctctctcccgcatcttcttccccgcacggctcttcctcgtctcctctacaggttccgcgcccctcaagctcatctccctgtgcgcgccgcgcccctggctgggacctcggctcggccttctccccagcgcccggccagagctccctggcttgcccctccgcgcgcccctggccccagctcggactgctccctggacgagctccacgccatggcatctcccaggctcccagcccctcttctccctggcgagctctccctgccccctgtacggcgctcctcccctgctcctccagcgccgcaacttcctgctcggctccaagaactggtccacgtcctcggctcctcggctcggcatcccccgtgcgcgcgcgccctggttcctgcttctctctcttccttcatctctcctccatggcgctcggctttctcccatctcccatgccgcccggtcctccctgcgtcagctcggctaggcgggacatcgctccctgctgcagcttgctcggcgtccagtctccaactcggcgtcccaactttggtcgcacctggtccctactcgagctcggccctgccctctgctccagctcgcccctctctgcttgttctcactgttgggccggtccgcagattgccgtcgaccatggcacgctgcggccgtgtggaactgtggcggatcggggaccgggtgggctggtaggtgcgcttctccaagcgctgctcggggctcttcaagaaagcctacgagttctcccgactctgcaatgccgaggtcgccctcattgtcttcttccccaccggcaagctctgggagcgccaccacgtgtctttggtgctcgcttcccttcctaagccctttttgtacccgccgatagtctccagctcactctggccgcgggtaccgttgagcccgtcgttctcctcgtccagtgctcgcgcggtctcgcccgatccgcgctgtcgtcttccagccgttagcctttgcgtcaacgttggtgagctcgcttcgagctccatccatggctgccttctccgctgcttcagctctggtcgcgctcgcttagctactcgccatcggacgccgcacagcaacctcgccgttctttggtgccggacgcgcgttccctgtgcgtgccatcgacctcagtggctccatcgtccgaggctcaaccccaagtcttgctacgccatcggctcccctgtccgacgcgccgtcagccaactcgctggccgacctcgctgtggtctggctcggtgcgccatcgccccgctgctctccccaacgtcagtgttgtccctacgtgtttgcccccatatgccgcgggacactctccgacctcgccgtgtacaacacttggacacctcgtcgtcacttggccacgttttcgctcgtcaccatgccatcttcagtatcatggttctgtaagacttcgcgcattcgtcaacacccggctgtcgatctccaccacgcagcgtattttcggacctctggcctcgtcctactcttctccaacttgcgtctaagccttgggtcgagttcatacgccactgctcggtaaaataaagtgaaccggtgagcgccattgtttttgtgaattttgagctgaattactagctattattgatactatgtggtggttgcaagcgctcaaaatagaagaatggatttagataaagaaggaagcgaagccgcaccacgcccgtctgatgttcgacgacaagctcgaaccaggatttatcagcattcttacgagtattgagtcacgtttgaagctggtgagctgatttataattcttgtaagtttatttgatgattggattagctagacttattagtcgtaataattctcgtgtttagcaggcgcgtcgtgtttgtgttagatgtttgctaaaatacctcagcacctccggtaacgtaatcgtgtgaaataattgtgtaataaggtacaccttaggtctaaaatgcaggatttacgaagaatgttttagagaatgaataagttaagtatgcataaattggttcgtcgtttgtgaaaatggtcaagttaataatgtagattatctatcttatgctctttatactcgtgctcatacatgtgcatcgtgcat

SEQ ID NO: 507 - DNA, 2450 bp, Zea mays
agagttatgacctctattaatggaaaaatagttaatggaagaaaatttatatttgcactttcattactcttttctaaatgtcgtactgtaagacatacttctttaggcatgttaccttaaaaacatatatagtgttattggcaatgttcctcagttgtgaacacatcaacccaagtttaagaacaatcaaaacatgagtatgagactaatgattattaatttcatataagttgactacatgatatattgatttctggtgtgcgtcaacttcgatgtattttgaagccctaaatgttgtattgtttagatagatagtttttatggatggacccaacttattgtattgtttcgcatgcaccatcattaaccaatgttcaagacaaccataacatgagtatgtgaccctagattgcagcatgcttgcactagatttggtcatatgaaggatgaggtgactctagaagcgcttaaagcataacacgtagattttttttcagatcatcactttactatagacgtgagctatccaacatgttgtttcacaagcttcatcaccaacccaagtgcaagacaacctatagaataagtttgggcccaagatattagatgttcgaatgctggcactagagtttatagatatgaagaatgagttatctttagaaatgtttaaagtgcaacatgtatatttttcagatcggtaattttccggagttgagagctatatttatgcaattctgcttttattttaaatatagaaaaattttcattccaattttaattacaatttcctctatgcgagactataaacaatactagtttaggcatgctatcttaaaccatatgtagtgctattttatatatttcttggttatggacaacagtgcatgttttgaggccactcaaaaaacaagtatgggactcatgatatttattacaaaacaatttaaccaaggaaaattacattaccatttgctctttgccaaactgtaaacattacttgtttgggcatgttatcttataagatatgtggaaagatttcaattgttttttggttatggacattaatgtaagtttgaaggggttcaaagccctaaatgatgtaatgtttagaatgaaagtttttacaaaaacgagccaacaaggtttgtcatcaaagttttcgcaatacaatgattttggagtaaagggtcatgatttcgtgcatgttttcttgaaaagattgtggcatgaaccatgtgaaaactttgaagcttttcgaagccctaaattatctggtagatttatagaatgatccaacatgttgtttcacacgctccactagcaactaaaattcaacacaatcaaaacttgagtgtgggacccacataattagatggccccatgccgattaaagttcattgttttaaaaaacgaggtaactttaaaagtatttgaattgtaatttgcagatttttcaagataaacgattttgcaaagttacgacctctattaaaggaaaaatagttaatggaagaaaaattatatttccactttcattactcttttccaaatgtcgtactataagatatacttgtttaggcatgttaccttaaaacatatatagtgttatttgcaatgttccttagttgtgaacacatctatccaagtttagggaagatcaaaacatgagtatgggactaatgggtattaattttgtgcaagtttaatgcgtgatatatcgatttctcatgtgcgtcaacttcgatgcattttgatgccctaaatattgtattgtttagacagacagttttacggatggacccaacttgttgtttcgcatgcaccataattaacccatgttcaagacaaccataacatgagtatgcgaccctagattgtcgcatgctagcactagatttggtcatatgaaggatgaggtcactctagaagcacttgaagcataacatgtagattttttttcagatcatcaatttacttgcgtgagctatccaacatgttgtttcacatgcttcatgatcaacccaattggaagacaacctatagcatgagtttgggggccaagatattagatgttcgaatcctggcactagagtttctatatatgaagaatgagctaactttggaaatgtttaaagtgcaacatgtatattttttagatcagtaattttctggagttgagagctatatttatgcaattatacttttatttcggtcctttttttaagatactttgttattattctattaaagttatatcaatgatatttataacaaaagaattaaatatagaaaaaatttcattccaattttaattacaatttgctttatgcgagactataaacaatactagtttaggcatgctatattaaaccatatgtagtgctattttaaatgattcttggttatggacaacaatgcatgttttgagaccactcaagaaacaagtatag

SEQ ID NO: 508 - DNA, 2384 bp, Zea mays
  misc_feature (1143)..(1143): n is a, c, g, or t
  misc_feature (1900)..(1900): n is a, c, g, or t
tccaatagctgactcgaatccgtgagatcgataatgattctccgatttaggcaatttgtcgagcgcttggcagatactatccgaacttcacacaccccaccatccaacctttggacatcttctcttggggcttcttttgtcagcacgactccaactcggaggtatcacgtatgtaccgacatcgagacggggtgaccgaacgacgacggcaaggcaaaggttggagatgaccggatatcaacgacaagcactagagttttacgacgggttgttgtaatgggacgtcgatacacgatccatggcaattaggacatcgacgtaggcggaaccgatagccaaacaggaactgcgcagatcgacgacgcgagactcgatctggcgagcacgacgcaagggatcgcagctgctgcttcgacatgaattacttgctgccgagcacgacggaggctggggagcaggaacgctgcgcagcgaaacccacggttgcacgtaggggtaaactcggctgggcgcggtgattggagtaggcggccactggggcagcgcccaggcgcgcacgacgagaatccgagcagggccagtgcgcagcgaccatggaaaagatccgagctgggttgaatctgagctagagctcgcggcaacagggagcagggcaagcctgagactggaagacaccatggcgagcagcaggtagcttcgacggagagaggcacgacaggaaggtggagcagggagacggacgcacaggggaagcgcgcgccatgggagatggctgtgcgagcgcgttagggagaaacgccagctgcgcggagggcgaactcggtatgacaaccatggacgaggtgggcgagcggaggaacgacacgatggaggagcgcgtcttgcgatggagagcagggctgaccagctgccatgggagatcaacatggcgagcaccgacggctggggaacgtcgaggggaggtcgaggagctgagcggctgcgcagtggagcaagcaaccatggaagagcagagagttgactgggagggaggagatgggacgacgctaggatgtccgggaccagggcgcgactgcaagaggaagatgtgagaacgagcgcctgctgccgtgtggagaggagagataatgctgaggaaaaaantctgcagaagaagataaggctgggagaggatgcacacgtagaagaagatattctaccggttacccacttaagcggcgacagagacaaggaaaaattgcatcgaatacgattgctggcaaagaaaatatcgatgacgaccaatgatattctaggaagtttacgtacatgagaagaaaacaacgatagagagatattttctatagtgaaaaatccaaatacgttgaaaatcataccaaacaacggtggaaatatttagagaaggattttccctattttccttctttttttaaaacaacaaaatacacatattttagggtatgaaattagagtctaaaaaatatacaaaaggatcaaacaaaaatgagaccgacaacaatatttagataggatttgatttggtgaatactctcggaattagatgaatcttcacccgttatttatatccgaagttttggatctggccgagaaacacaaggaccaaaacactatcgggatacggtacttgagactattaatttagttgaactcagataaaaatttatctgttttccgaatcgatttgatttctctacctagaatagcacactaatgaataatcccaattgttaatcttgtgcacggtttcttcgtaacgcaagcgatccggagtattctttcggtcccagtattatctgctataaaatcaaacattaatctctttgtctcggataatatcgggttcggataggatgcaaatagaatgaacccaaacgagatngagactgatattttaaactatatttgatatgacttgaaatcagataacttcgtctgccactcgaacacctgatcactctgccatagatgatttattggagaatcaaatctcaattataattccttggttagcaatctcgcgcatgatttttcttagacaatgcgcgattcatattattttgcctcgaacattttagtcgtctgagtgggtcgagcttccaattcgtattcgcgcgagcgatgagttttaaataatcaccagacgcacctattttcggaacaactatgttccgaacatcacgaaaatttaggaagagcccggatagataaaaacgatgtcgaactcgcgacagacgaaacagatgcgatattaaaatcgcgataggcgaagatgtttaaaatttagcatccgttttatccacttatattacgtgcttaattccatactcgttgtcgagcagaatataaacaccaggggtgttaca

SEQ ID NO: 509 - DNA, 2275 bp, Zea mays
gatccgagggtcttccagccgatcttgggctaacattcgaaaggttaaaggcaaatgacatcaagttaaaccccaaaaagtggggctgaaaagggaaggcgccagacagctagccaggcttctcaaaaaactttttacgtccattacgttcttcgcatccttctaacgtgtgtggctacactaatatctttcccgttttgtctcctagattaacataggtcctcgaaagagctgaaggaaacaaaaacaaacctgggcacccttcagaatgcccctgctcgaggaaccaaacaaacattgatcaaacactgaggtcttccatcctggtaagatctcaaacatgttcaattccttacacagggaccaaaaaactcacaataggattgtcatgaactctagagttcaaaaggctggtttgcgaagggctcgtggtcgctcaaacgaaaaacagagcgagggacagccggtgacggacacactagcgaccgataccctgatgcgtggagcgttaagggtgtcaccagctcgtgttcgagtcctaggaaggtctaactcacggttcaacgcggagagaggcagtgagccgtcggttccggttgaacggagtcaataactatatgacttggtgctcgggagtttgaagacggtccccagcagaccacgcgcttggatccagtggaaggaaccaaggcttcgcttggcccgtttgtaactcaccgagcaccattgctatcccatcgaggaaagtgtggtacgactcacctcccctcatcctcgcgaaggggatgcacagagagagtaaaacaataggaggggatgaccccccagacggatctctacactgagtagatactagaggctcgccccgcacgagtatggcagacgggagaaagccacatggaaagcgcccccaagcaagggaaatcctaagaccagccaggatctaggggacccgaaacccatacatgttgacggttgggccacggaatagagctatggaagatcatggattattttttccactgacactaccccgagtacagtgttcgtggcagcatcaaagtcacctgttagaaggtctaagtctaccattgtcgatccatcaggcaggccaatggcatcacagaggttaccactgaagtgtagtcatgtaatggcgagagccactgctgcgccccagtggaccccaaactccatgacctcgcaaacacgatctgggatgtcaaggaggcgtagattgcaatgcctcccccatgcacaaatgaatcatgtggcatggttcatgcacaggtaaaggctcaatgcttcaatatccagctctgcaaggagtctgcagaaaatcaggaatctaagaaattgagaccccataaactgaaccatgaaagcctacctgtcctaaatcattaagagatgctagctgcgaccaaagatgtcagacttcagcattagccacctccaaactgcgcaagccatgcccaagtccctttggaggccatccaccgaccgcctagagggaccgatgaggtaggcggctggggcataggaccacagtgcctttgcaccttggaagggcaaccgccaccctaagggaaatcgagaaataaccagggaaggtaaaagggataacgaaaaccttgagataagggtggggtagttgtatcacttcctcggacgacttcccctaggggtctgccctgatccataggtgaagggagacattggctaataaggaagcccgcaaggaataaaaagagaacgaggtcactcaagccccttcccccatcttgctttttaaaggggcagctctcgttaaaacatgcgaagaaaagaccctaggaccttacaacccaaaaaaatcaaagagcaaatattacttcattatttctccagggaaaacgacgtcatgtgctgacaccctaagcacgacacgactgcccgcctcattgaaaccttccagcatgtcttccacccctacacccgaaagggacgaaggagggccgacgacatcctagaaactgcaaacgaagcagagcttccccatgaggagcgctaccacaactctccgatgaacgtcgaaatcaatagtgtcctggacatggcacgaagcattgtctaggcactctactagggaagcaccgcgagccccaacgttatccagaagctaacccaggcggtggcacaacttctctagttcggctcctaaggctgtcagaagaagcaaacatggtaagggaaggggtgagaaagctggagagtggttggagggcaactgcca

SEQ ID NO: 510 - DNA, 2383 bp, Zea mays
ccgaatcatgtactcctatatattcttcctagaggctcaatgcaatacatcccacacattatatgcattctctcctttctttcatggtatcacgagtttaggttttagatccaacaggtgtcttctgctgccaccgccgcgccacccttggggagatcgtcctccgtcgggggcaacaccctcgtaggatgcgcgaccggtcccgctgatctgctgtgcccatcgtcgtcatcgcgtcaagtcgaagtagcgacagatcgaaaaactcaccgtcgatgctccttggatcgccccccgtcgacctgcactggctagatccggcacctccacacgccgtcatggtgacggttgtggtcgggtcgaatccacccgccggctgggtcgtgcgccgccatggtggaagctccgactctcgctgccagctgcgccagagccgcacgccaggcttgcacgctggcacgggagtcgcgtgcctgcgccggggacgttgtgcccacgtcgtggctgcaacctcgcctggccgcgtcgtgctgtggccacgcccgcttgctgccggggctagggctgccacgcccgagctgagccgccagggttgcgccaacgagccgggtccgtgtggtcgcgccgtcgggccgcacgcccgcaggggacgcgcttaggtactgccagtgaattcccaggtctgttgttgttgcgtcttttttttgttttcccagtcattgatcgggtttgcatctccatcacccaccgccagtcgactcgcgcaccctcgacatcggcttcaacaacaccggcttcttcatcttcttcgacggtgcaactggcatggcatgcagcgtaatcggaacgcctgcctatgttgcgcctctttgtctgcacgtccatctatgccggctcatcgtcgccaccaccgatcgggaggctccaccatcgacatcaccatcatcgtttccgactcgcacgccatcggcctgatcaaccgatcgcgggcgaaccatcctcccgagacgtttgtcgtccatcgcgcgatgcttcgccaagcaagaagatcgtcgatgtgtcgcctcctcgaaaacaccatcgtcgtctgtcgtcaaccaacaccattgcatctacatcgctgtcaacttcgtcggcgcgtctcatgcgaatgaacaagttgttcgacacatttgagttgcgtcgacacaaccgttgtctgcgttgcgggtcctcctacatgctacgtcaacaccttgcgctggtgttgtgcctatcctaggcgtgctagccaccgtcgctggtctgcaccgcatttgtcatcgagtttttcgccgacaaacactgccatcgtgctccactggcaccattgaggctcgtttcctatgtgtcgtggctctcgctgtcgtgactctaggaacctcgatgtgtcgccacgcctatctcttctactttgtgtcaccacgcctatctcttcgcttcgtccagcacaacctcgttgccagcatcatcgtcttgtcctcaactaattcgtctactccgctttaacaaccatgcgttgggccggcactcccgtcgtgctgcatcacaaccatcgcgaaggccttctctgctggtcccttgagatgcaggcacatatggttggggccctctacctagtacattcggtactggcaccaccggcacatgcattcatccacgacacgtttctaggcttggcaaacctggaacatccatcgtccatggttgcttgacgcgtcgctcccggcatcgacaccctcatctacctcgacgcattgtgccttcgtctacggctgcttcacagcaccaccatcagcacgacgtcctctggcgcgatttggaccttcccgcgtgccgcagcaacgcccgcaacttgtgcggcatgtcttctatgacgtcctcgacagcttcctcgaccacggctacctacgcacggcacttcgacaacggctccacgtcctcttccttggctatctcaacattatcatcacacagggctatcatctgcatgggctactctagtcgcagcattcgcaccgcattccgactgtggggggtatatctccattattcttcagtctgtccgttcgtgttgctaacgctacgactatgggggtatatccccattattcttcagtctgtccgttcatgttgctaacgctacgactgaggggatgttagagtatattaggcatgttagagtatattaggcaactcctgatatggttggtttaagattgatagtaatcccgggataccttatatctaggataacattccttatccctaggataggcttcttaccctccaagtcatgtactcctatatattctccctagaggctcaatgcattacatcccacacattatatgcaatctctcct

SEQ ID NO: 511 - DNA, 2381 bp, Zea mays
gtctccacaccaatggttttgctctgctcagcggctatggcactctgcggtaggataattattgttgcggggtgcagaggttggggatttatattccagggctgagaacttcaacaaatcacggcaagatctgttagaccttgttcgtttgtgttggattgatggtctctaattttaattagattccgggtccaatcccacaggcctggcctgatccgagcgggtccgccggctgaccccgacagatgcgcgcgcgcgggtgagcagtacccaagaaatatggctgaccccgacagatgcgcgcgcgcgggttagtattcttctgcatggagtgcgatgaacttcttgtggactacaagcagtggtgtttgtgttacctactggttaaatatacttcaggtgccattagtttgattatgatggacgatcaattaatgaacgtatttatgttatttttgtcatgacatggaaggatactaaaactaaccgtggaacattgtcctttggaaaatgctagaacattgaatctgccggacctttccttccaacacttaaccctcctcgtgttcccgatcatgtattgctaaaatggcacactagccacccgattccttccatgcatggctgctgcaagggctactcttgagctcaatagcatacaagggaagagctactcttgagatcaaactgaaattagtttaggctgggaaagcagtaactttagggttgcttggcaagaaatgtgaccttttggtgaacccgaagcccatgatcgtcccatcatggactgaggccggcgtacgatatatggtggcaaaaaatctaggcaaattcataaccattggtaacttcaggtgaggctgcttcaattctatgaactcgatcgtatatatactacaaattaaaatccctgagaatgcatgattctcactcacgtcagtcttctctcttctgcacagcatgctcgaagatgggggcacttctcttagttttggcaaaatatgttttgcatgaagtcttaaggagaaacactatatcaaaagctcgtaaaaatatctctgcacactatgacctggtcagtggatttagttatttattttttgtctgaaaaaaaaaatattattgacatctctggttggaattttctgttactattctacttatgtgatggaatcaatatcataaatatctctaaatttgttctgtccgtccacatgctacaattaaatcagttgtacacgtttctagtgtaaatgaacaaagtactgtcttattttgaaacataactagtatttgtaatgatttctttgctctttttctggatccgacgatgacttactcttgtggtattttcaagctaaggtatggaattaattattgtggcgtagtatgttatgtagctagctcttcactcatgaacgtacatgtacatccctaaacatataccacgtgattggttactaggccgcccacgtctaggccgctcgcgcgcgcgttgactacgctccagtgtattgattgtatagtatatcctcacggagacaatataattattttttacatcacctagctgcatccacagagaagtgagcggagcgcgtttctacagatccagggtgtcgtttggttcacatatttgtaacacaatgggtaactgataacgttaaatcatgtttgttttagtccaaccgtaatcagatactatactaaaaattgataataccatagtaatcgatagtaaaccgttaccattaccatttgcgttacattttttgaaccaaacagcaccaggttccccgcgagccttgctcttcaggagccagcaaccaatcacgtagataccgtttgatatttgtaggcggaagatgagagtttagaagcagcgcagctacgtaaacttgacaatctaattaattagtaaggtaaattcatcgtaatatataatatgcatgggttgaactctgccatcataatttgctgatttattagataatttccatattaaccactgtgttgaaggctaaggtggatccccggattccggggcatcatgtccttgacattggctgtgaagagaactggctgcaagtgcacaggaattacattattatcggaggagcaactgaaatatggaaagagaaaggtgaaagaatttggattagaggtcagttaattacatttattccctaaatattaggtagcattaattaattggaaaagcaaacaccatcacatgtacgcacgtaagagaaaggtgaaagaatttttagtgggatgcagtactaataagctagctaggcctccgccatgatttatcagttatttattgagtactcgatcctctgcactgcagctgtctcttatacacatctgacgctgcc

SEQ ID NO: 512 - DNA, 2379 bp, Zea mays
ccgaatcatgtactcctatatattcttcctagaggctcaatgcaatacatcccacacattatatgcattctctacttcctttcatggtatcacgagtttaggttttagatccaacaggtgtcttctgctgccaccgtcgcgccacccttggggagatcgtcctccgtcaggggcaacaccctcgtaggatgcgcgaccggtccccctgatctgttgtgcccatcgtcgtcatcgcgtcaagtcgaagtaacggcagatctaaaaactcaccgtcggtgctccttggatcaccccccgtcgacctgcactggctagatccggcacctccacacgccgtcatggtgacggttgtggccgggtcgaatccacctgccggctgggtcgtgcgccgccatggtggcagctccgactctcgctgacagctgcgccggagccgcacgccaggcttgcgcgctggcacgggagccgcgtgcctgcgccggggacgttgtgcccacgccgtggctgcaatctcacttggtcgcgccgtgctgtggccacgcccgcttgctgccggggctagggctgccgcgcccgagctgagccgtcagggttgcgccaacgagccgggtccgtgtggtcgcgccgttgggccgcgcgcccgcaggggacgcgcttaggtaccgccagtgaattcccagatctgttgttgttgtgtcttttttttgttttcccagtcattgatcgggtttgcgtctccatcgcccaccgccagtcgactcgctcaccctcgacatcggcttcaacaacaccggcttcttcatcttcttcgacggtgcaactgacatggcatgcagcgtaattcgaacgcctgcctgtgtcgcgcctctttgtctgcacgtccatctatgccggttcatcgtcgccaccaccgatcgggaggctccaccatagacatcaccatcatcgtttccgactcgcacgccatcggcctgatcaaccgatcgcgggcgaaccatcctcccgagatgtttgtcgtccatcgcgcgatgcttcgccaagcaagaaggtcgtcgatgcgtcgcctcctcgaaaacaccatcgccgtctgacgtcaaccaacaccattgcatctacatcgctgtcgacttcgtcggcgcgtctcacgcgaatgaacaagctattcgacacatttgagttgcgccgacacaaccgttgtctgcgttgagggtcctcctacaagctacgtcaacaccttgcgctggtgttgcgcctatcctaggcgtgccagccaccgtcgccggtctgcaccgcatttttcatcgagtttttccccgacaaacactgccatcgtgctccactggcaccattgaggctcgtttcctatgcgtcgtggctctcgctgcaaggactctaggaacctcgatgtgtcgccacgcctatctcttctactttgtgtcaccacgcctatctcttcgcttcgtccagcacaacctcgttgccagcatcatcgtcttgtcctcaactaattcgtctactccgctttgacaaccatgcgttgggccggcactcccgtcgtgctgcatcacaaccatcgcgaaggccttctctgctggtcccttgagatgcaggcacatatggttggggccctctacctagtacattcggtaccggcaccaccggcacgtgcattcatccacgacacgtttctaggcttggcaaacctggaacatgcatcgtccatggttgcttgacgtgtcgcccccagcatcgacaccctcatctacctcgacgcattgtgccttcttctatggctgcttcacagtaccaccgtcaccacgacgtcctctggcgcgatttggaccttcccgcatgccgcaccaacgcccgcgacttatgcggcatgtcttctatgacgtcctcgacagcttcctcgaccacggctaccctacgcacggcatttcgacaacggctccgcgtcctcttccttggctatctctacattatcggcacacagggctatcatctgcatgggctactctagtcgcagcattcgcaccgcattccgactgtggggggtatatctccattattcttcagtttgtccgttcgtgttgctaacgctacgactatgggggtatatccccattattcttcagtctgtctgttcatgttgctaacgctacgacttcggggatgttagtatattaggcatgttagagtatattaggcaactcttgatatggttggtttaggattgatagtaatctcgggataccttatatctaggataacattccttatccctaggataggcttcttaccctccaagtcatgtactcctatatattctccctagaggctcaatgcattacatcccacacattatatgtaatgtct

SEQ ID NO: 513 - DNA, 2378 bp, Zea mays
aatctaccacataatttagggctttgaaaagcttcaaagttttcgcatggttcatgccacaattttttcgagaaaacatgcacaaaatcatgaccctttactcacaaatcagtgtattgcgaaaacttttatgacaaaccttgttgggtcctttttgtgaaaactaccgttctaaacattacatcatttagggctttgaaccgcttcaaacttacattaatgtccataaccatgaaacatttgaaatctttccacatatcttatgagataacatgcccaaacaagtgatgtttacagtttggcaaagagcaaattgtaatattattttccttggttaaattgttttgtaataaatatcatgagtcccatacttgttttttgagtggcctcaaaacatgcactgttgtccataaccaagaaatatataaaatagcactacatattaagatagcatgcctaaactagtattgtttatagtctcgcatagagcaaattgtaattaaaattggaatgaaattttttctatatttaattcttttattataaattgatataaatgtaatagaataataacaaagaatcttaaaacatggatcaaaataaaagcagaattgcataaatattgctctcaattccagaaaattacaaactctagtgccatcattcgaacatccaatatcttgggcaccaaactcatgcgataggttgtctatgttttaaggtaacatgcctaaacaagtatgtcttacagtacgacatttggaaaagactaatgaaagtggaaatataatttttcttccattaactatttttcctttaatagaggtcgtaactctgcaaaatcgtttatcttgaaaaaactgcatattacaattcaaatacttttaaagttacctcattcttcaaaacactaaactttaatcggcatgcgaccatctaattatgtgggtcccacactcaagttttgattgtgttgaattttagttgctggtggagcgtgtgaaacaacattttggatcattctataaatctaccacattatttagggcttcgaaaagcttcaaagttttcgcatggttcatgccacaatctgttcaagaaaacatgcatgaaatcatgaccatttactcccaaatcattgtattgcaaaaactttgatgacaaaccttgttgggtcgtttttgtaaaaactttcattctaaacattacattatttagggctttgaacgtcttcaaacttacattaatgtccataaccatgaaacatttgaaatctttccacatatcttatgacataacatgcccaaacaagtaatgtttacaatttggcaaagagcaaattgtaatgtaattttcattggttaaattgttttgtagtaaatatcatgagtcccatacttgttttttgagtggcctcaaaacatgcaccattgtccataaccaagatatatataaaatagcactacatatggtttaagatagcatgcctaaactagtattgtttatagtctcgcatagagcaaattgtaattaaaaatggaatgaaaatttttctatatttaattcttttgttataaatatcattgatataactataatagaataataacaaagtatcttaaaacatggatcaaaataaaagcagaattgcaaaaatatagctctcaactccggtaaattaccgatctaaaaaatatacataatgcactttaaacatttctaaagttaactcattctccacatctgtaaactctagtgctagcattcgaacatctaatatcttgggcccaaactcatgctataggttgtcttgcacttgggttgatgatgaagtatgtgaaataacatgttgggtagctcacgtctatagtaaagtgatgatctgaaaaaaatctacatgttatgctttaagcacttctagagtcacctcatccttcatatgaccaaatctagtgcaagcatgctgcaatctagggtcgcatactcatgttatggttgtcttgaacattggttaatgatggtgcatgcgaaacaatacaataagttgggtccatccataaaaactatctatctaaacaatacaacatttagggcttcaaaatacatcgaagttgacgcacaccagaaatcaatatatcatgtagtcaacttatatgaaattaataatcattagtctcatactcatgttttgattgttcttaaacttgggttgatgtgttcacaactgaggaacattgccaataacactatatatgtttttaaggtaacatgcctaaagaagtatgtcttacagtacgacatttagaaaagagtaatgaaagtgcaaatataaattttcttccattaactatttttccattaatagaggtcataactct

SEQ ID NO: 514 - DNA, 2376 bp, Zea mays
atgtcgttggcgccacgacggtgtaacacccctggtgtttatattctgctcgacaacaagtatgaatttaagcacgtaatatcagtggataaaatagatgctaaattttaaaacatcttcgcttattgctattttaatatcgcatctgttttgtctgtcgcgagttcgacatcattttatctatccgggcccttcctaaattttcgtaatgttcggatcatagttgttcggaaattcggtgcgtccggtgatcatttaaaattcatcgctcgcgcgaatatgaatttggaagatcgatccaccgttacgatccgtgtcccaaataaattaattataattcgatgactaaagtacttagtgcaacataaataggatcgtgcgtcgtctcagtgaaatcgtgcatgaggatatgatccaatttatccttcagcacgttgttttgactaagaaatcgcgtatacattagcggatctggtttcagctaagttcagtcaaatcacgcagagcagattaaaataccgaagccgaactcgtttcaatctggtccgtttacatcgtggccggaatagtcgcgaaaattatccaaacgagattcggacagaaccgtctaagttgttattcctatgattttccgtttcgtgattcgaaaaatagagtgtgtagccatttgccgtattatacgtcgactctttaatcatcactaaaaatcccgatccaaaatatctgtgatctctaaaaaacagcagaaagaaaatattccctcccatccctatcctcacgccactctctctccccttgatattttgtcgagccacgtcgctcagccatggaaaaatccagccgccgtcttcaccttatccctccacgccgctccctctccctatgatttttctcaccgctcaacgccgtcgtcatctacagccgccgctttggcctggagtaaaaatactgccgcccacgccctggataaaaatcgcgcgcagccgcttctctcctccctgtgcacgtcttcttcccagcgcctcctctgcttctccgtggagcacccgcccatggcagccgcgtttccctggcgcgtggagcttctcccagctccatcacccagctcgcggagctccctgactggcgcggcctctatttcttccatggaagcgcgcctggctgcctctctctccccggcctcgagcttccccattccaatggcgctcggctccctccctcatccctcctcggcgctgctctttttctctgtgccgcgcgcccctgccctgtttccatggccggctcgccgcgcgcccaagctccctctgctcgctctcccaatccatggtgcgagctcgccctgcgcttcctgctcgccctgcttttctccgttgccgcgcgagcttgtcctggctcggatccggcgcccggccggcgacaagctccgacctccctccctggcttttcccgagctcgcgctcaatctgctcgcgcccccatcgccatggacgccctagcggcttccctgctccaactcgtcgcaacctcctctgctggccgtccctgcatgctctcctgcaagctccatcgccaaaccgcgccctccctgctcagccgctcattttcctgtgctcaatctccagctcgccggtcttccctgtgcgccgggccgtagctccgagctcgcccttacgctcgcccatggcggctccctgagctcgctcccaaccacagccgcgcccttgccaagtccctgcgcgccgtggtgctccagctcggctactcggcgcccatctcccgggcggcgcgcccttctttttccccgcgcgcagctcgccccaacgccgagctcagtcctgccctctgcccagcagtcgtcaaactccgtgcgcgcgttttgctttctgcgtgctggccgcagctcggagtttctctgcgcgtcttcctcccatggccgcgcgcaaggctcctctgcttgctgcgtctgctctggtggctgcgtacgcccctctgatcccgacgccatcgaatcccgttctgctctgctcgtgtcagtatcccttcattcactggaggtcacgcagagcatgttcgaggagatgcagcagataatgaagctacaagactcgcaggccaagcaccaaggtttatagaccagaatgggctaaatagttgctaggccggcctgtgtgccggagtataatatataagtcaaacttggggcacagaaggggcatgaatgaatcagactctgaattctactatctactatcgtctctctgttcttcacctctattcctcttctctgtgttgtgtctgtatctcttcactcctgctattctatcagtgatctattaggatcgctaacaattggtatcagatatccaccgatcc

SEQ ID NO: 515 - DNA, 2376 bp, Zea mays
ccctaattatgatccccgacactatactagaggtacggtggcgcatgacccagcagacgactccataggggctatgaggcctagaagcacgacctaacaaacgacaccataggggctacgaggcccagaagcaggaggccgaactccaccctagtagaatacaagttcttattgtaacgtctacccttgagctataaaagggcaagacaacccccatcatccaggacacatctcatagcttcacacaagcactcaattgtaacatgctccaagcaatactactatcagcattacactggactaaggctccagcctgaaccagtataacccactcgtctcagatccaccttcgagtccctcgcagctcaccattcggagtgagtccgcactagcacccctgccgaacacaaatcttattgtcccccggttctagaaaccacgacaggaacattggtatagtatataatgaagtgcatctataattttttaagaagttttaacaacctttagtagtttgattgcacatctcgaagagcttgattgcacaacagtttgatccatatcagggctatcaccttgcaatttcatccgcagttacctggtattataggtgaaaatcagtaagactgcaaagatatgatgaaattattaattgatcctttgcatcaaagtaaatgacaatttagtaagaatcgaagtgttaatttttacatgagagggatacgtgaaggcaaagggatgtaatcaaagcttgtgaacatgtgccttgctaatgcaaatcaatgtgtccatgaaggatgcatattatatatcttgcatgctaataattctgctaatgcagatctacgacatgaaacaattgtctgcgacgacatgaaacatttgtctgatgagcaatgtatgtaggagtttttttgtatgcaagccttcctaaaagtcgaaaactacaaaacatataaattttccacattgtcattttgccaaacacatcgcagcctagcggcgtgcgcctggggcctagttacctgaccagaacgcttcaattcagcattccagccaacaactaatcgagatgcattggtgcgtgagaatagcagatgacttgcagtggaggacgaagagtaggttgttgttcagttgttgggcatgtactcgtagaccaacagcttctcatcgtggaggacaaaggactttttggtgcttagtgatggtttcatgtcatggaacgtgagagcatatcctgtacgcaaaggacgtcagtgctcccatgcgtaaaatgcattcaacccatccgttcaatatccaacggtgtaccgggttttttaatgaacaacactaacgtgaggagcgtgagaagacttatttacaaaaatgttataataccgttggatacaaaacggatcggctggatgcattttgcgcatgggagcacctgttatctttgcgtacaggatatgctgccatggaacattagctcggtgagagccagagaacttgagcgcaccagaatttcttaccacaaattgacaggcatgcctatatgaagtcagtagcacaaaggcaggccgaactggttgagctcgacgccgacgtagaagaagccgagaatctacaacagcgtttggggtgggaggtaagaacaggaagagcaaggagcagtagggtgaggggagggatacttcattgggctggccttgacgacgcggaaaggaggacgacgaggacagtgacgccaaggtaggtgacgatgagtgtgtcgaagcctaggtcgttgattacctcgacgacgacgctagccaagtccaggtccatcctcgcgccgtcgcgcgcggctcctagaagcgcctcctccacttcctcgcggtcgtcccgtatcgggggcatcctacccctacccacactccaagatgggcgcggcggagggaggacgtcgaggtggggatccgaggaggcgacacggatgccggcgggctcgacgtggccatctagatctggagccccttgccgtagcaggcgatggagtcgtccatgcggccgagcatggcatgcgtgtcaccgagctgcatccatccagagaaggcggcgagggaccactcctcgtccctcttgtcgtctggctcagcaacttgcccctcttgcctcggcctcgacagaggggagacacctctggcagcgtgacgacggcgatggcgcgctggagcccgggatggcgtcggcgtggcagctgaggctgcagtggatggtgtcgacgacgtggaggctcatggcgagctcgagctcggcgcccttgccgtggcgctcgtttggcgggcatcgcgcggcgggggtcgacggtcgtccgcggtgggagcatgggatggatgacgacggggaggc

SEQ ID NO: 516 - DNA, 2264 bp, Zea mays
agaatctcggcacgatttttggctaacggacatcgggttgaagacgactctgtcagggtggccccatgtggcggtggctgaaagagcagaggcacgcggcgagggaatctaggcaatgggacccacgcgtcaaagtccccgcgtggtgaagagctagcgcgggtgtgggtaaagtgggccgcgcacaggagaagggatctagacgcgtgtgtggtagtgggctagggggaggaaaagccggtccatgacggtgaatcctgtgttttcttttcgttttctttttcctttctatttcaaatttcaaacactcaaatcaacttcaaatttaaattcctgtttgaactttagcttcagatattaaacacaaaatataatatgaataatgctcctactgcccgtcataatgtgtttgatttattatgattatcttatttaggtaatgaaatttacaccaaatttattacataggatattgtttggggtgtgtaatcaatttaaagatatatcccgaagttcatattcatttattttgattgaaatcattttccagtgtctaatcttcattaagacctgttttgaccaacattattttattataatcattctctttagagagcggtggattctaaagttcaattatttatcaaaggcacttattttgtatagtgtgataaaaaaattacaaagaatttcctcaaatcccaagttaggattttgggtgttacatgaagacgcgaagccaagtgtgcggacgcttacctatgggtctggccatctggggggcagtgtgccattttattttcatgcatcaataatttgcatggacaataacatgtgttcatttccatattctaggcaggtgcaaagggtctcctttttgcagtacacattttcatatcgaatttgtaagtgaggcttctaatgtcgaagtaaaaaccaattctaggtttttgtgctagatgcattaattcttggaatgatcaaaccaagcaccatgccagggaatggtttaggatatgcttgggaatgggtatacatttgtgctttcaaggtaccgaactgagtctcattcctcttttattccttttttttaagaatggtataaaatgcactaaagtgactcagttgctatgcccaaccattttgattgcgctcgacattcctttttgtggttcattccctggaccatctgatggtgtagtagaaagtggacatatttgggtttctctgggtcgtgctgctgaagcagggctgcaactcttaatctgctctcctacaccaatcttcggcaaagaggccatggagttgcatagaggagaatcaggctcgaaggtaattgttgcttgatatccttctacgtacaatggatagagggaagcctctccccaaggagtagctatagtactcctagaatcatcatgatgctggagctcttgctcttgcgcctttcatcacaaacaggaatatttctcatgcttccacctgtaatccagtacctctgacaactcttgcaaaaatatttggtagcttaatgttgtagttgttgtactaacaaaactttgtatctatggattccaatttggaggtcctgagggttatgtgaagatagaggattttctctagctccttcaggaccttcgctccactcgggacataacccgacctacaaattagactctgatatggatatttcatcattgctggttgtttgattttcacactcatcactgaaattgttaaggctagaactatttgcctgaccaccatataattcccgatatgtgcattgcttttcccacagacactcatgtcccctctatcttcacatacaccatgacaaatataagaagactaagtaaaacaaatgtatcatgaaagcaggaaataaaaaaacccggtcgggaaggaaaagaccgccctcccggtattatattaagaagagaccgaaacatgattccagccgagaaaaccctcaaaccctggccccatcactaacgggccgatcaactgcccactctgcaatggcccagccggaggttgaatggcccagccggaggttggcgcgcaggatatcgatctccgagagcaggtggggcacagcaagaggattttttttaatcaagcctgaaattcgcccccgagggggatcgaacccgagacctggaggtgctattcggaagccttaaccattacgctagagaccctttcacgatagcaggaaatatgatttgtaagatgctgtaaaatatgtttatataagaaaa

SEQ ID NO: 517 - DNA, 2375 bp, Zea mays
ctcgactcagccgagtatcttctgtctaaaccgaattgaaaaccccgtatcgacagcgattttaaaatatcacgattcaccttctccgactaaaaatccaaagccgatcaaatcttaagatgatttattttcaaatcatgcgtagagaattattttcgagcgaagtcaaatcaaactctcggccgagttaatcgcgcaatcgtccgttcgttcgaactctagttcactctgttccgcgtacaaatgaattctgcacgagcatttttattccgggaagtatttagcacaacccgattaagtgttttgggccaaatccagcccagcccgtttggcccatttaaaaccgtagccctagagctcttctataaatagaaggacccctcacttgcacttggcttttattcatctaccccctagccaccactctttttctttcctgtcttcttctcctgcacggcagcagcccacgccttcttcctacatggccgccagccttccctgcagcgagctccttcctccaggcacccatgccgccgagctctcctccatggtgcagacgagctccctcccttccacggccgcccagcccctaccctaggcgctcgcctccccatttcggacggccggccttggtagccgctgttgccatgggcgccatggccgagctccctgttcccctgctccatgggcgcgggtctagccggccatctcccgcagcacacgccgagctctcctccgatccggttaagcgcagggagcagcaactcccatggatggcacccagaaattttttcagcgcctccctgttcatcttcctcccagccagcttccctcccctgctgctgctcgccccttcctccttttccctagtgcggcagcaaggagcccctgctcggactgcagccacgacgtccaagtctctgcgcagcgatgccagtccagaaagctgcagccctgtcactcccctggcttcctcgctgctagcactgcgtgtgtgccacgtgttcggcgatctgtccaagtgaggtgtggagcagtgagcagcacgccgtgatgccgtcgggtgtttgctgtctttgcgcagccccgtcgtcgtcgtcgttcacccccggtgagacatcccgctgcccctgctgctatcctatttttgttttgtttgctcggtagaatgttgaactattgtgtgtgtctaatcgcaactagccttcaatgctaaccatcgtgcacgcgtgttcgatgcaaggccggtcgggtgaaccacatgcatgcccaactccgatctgatcccgttcaggttgattgatttatggtttatgatacatatgatttggttgatgtcaggcagtgcatgtatgtgtgaatgcgtgtaaaatgtttcggttatgcgcattggtaggatcgtgtttgcgattggagaacaagaggttatttgatgtgtgcgatttgtagttagtctaattaggttttggtcgatgacatggatgtgtgattatgtgtgtgaaaatacatttgtatgaatggaagcgtgtagagaagaaaatgaagtagaaaagaactccgatgtttttatatcttggtaggaaaaatatgcgatgcgttgtagtagtgattgcgttaaattaaacggtaatgtctcgactgcacgccacaatatggttgtatgcgagacaggttaaaataaagtgtgctcgacatgaatgtttggtcgttgtaggaagaaattgtcttggcttaattagataggtggtgacatgctaaattagtcatcgcttcctctatgtgtataagtcgaggcaatacaccttatgcgtttattgaatttcacatcacacatagtgtacggtggtgttcattacttcaaatagatgttttcgagtggacaagtaggtttgtaatgcaagatgtgtgatgatatagtttgttttagaatatttgttgaaatgctccattcatgtgatagacatgtgtggttaattcaaatcgagtcgatgtgtgtggcgatgatattcatggattaagtagatgtcctgaaattgggtagtggagcttatgttaagttgcaagcgatgtgggaatgttttggtaaaaaatatatgtgaaatgtgaacgagtcattcaatgtattcggtatgccgtgtcgtggtgatatgaaaaatgggtagaaatcgatcggctaaatgccaagttcgattagagttgttttgttacttgggagtgtgtggtgaagtgatggcatgactatgtagccatcatatcatctattgtgtgactatgcttgaatatgccttagtaaagtgttagaataattgaagtctctaaaacatggcaattcttgaattatatagaaactgaaagtcattaattgctgttttgga

SEQ ID NO: 518 - DNA, 2365 bp, Zea mays
tttaatgcatgatatatcgatttctgatgtgcgtcaacttcgatgcattttgatgccctaaatattgtattgtttagacagacagtttttacggatggatccaacttgttgtttcgcatgcaccataattaacccatcttcaagacaaccataacatgagaatgtgaccctagattgtcgcatgctagcactagatttggtcatatgaaggatgaggtcactctagaagcacttgaagcataacatgtagatttttttcagatcatcaatttactatttccgtgagctatgcaacatgttgtttcacattcttcatcatcaacccaattggaagacaacctatagcatgagtttgggacccaagattttagatgttcgaatgctggcactagagtttgtatatatgaagaatgaggtaactttggaaatgtttaaagtgcaacatgtatatttttagatcagtaattttctggagttgagagctatatttatgcaattatttttttatttcggtccatgttttaggatactttgttattattctattacagttatatcaatgatatttataacaaaagaattaaatatagaaaaaatttcattccaattttaaatataatttgctttatgcgagactataaacaatactagtttaggcatgctatattaaaccatatgtagtgttattttaaatgattcttggttatggacaaaaatgcatgttttgagaccactcaaaaaacaagtatgggactcatgacatttatcacaaaacagtttaagcaagcaaaattacattacaatttgctcgatgccaaactataaacatcacttgtttgggcatgttatctcataagatatgtggaaagatttcaaatgttttatggctacggacattaatgtaagtttgaagacgttcaaagccctaaatgatgtaatgtttagaacggtagtttttacaaaaatgtcccaacaagatttgtcatcaaagttttcgcaatgcactgatttgggagtaaagggtcatgatttcgtgcatgttttctcgaaaagattgtggcatgaaccatgcgaagcttttcgaagccctaaattatgtggtagatttatagaatgatccaacatgtttcatacgctcctccatcacctaaaattcaacacaatcaataacttcagtatgggacccacatatttagatggtcgcatgccgattaaagttcaatgttttaaagaatgaggtaactttaaaagtatttgaattgcaatatgcagatttttcaagataaactattttgcagaattacgacctctattaacggaaaaatagttaatggaagaaaatttatattttcactttcattactcttttctaaatgccgtactaaaagacatacttatttaggcatgttaacttaaaacatatatagtgctatttgcaatgttcctcagttgtaaacacatcaacccaagtttaaggccgatcaaaacttgagtatgggactaatgtgtattaatttcgtgcaagtttactgcatgatatatcgatttctgatgtgcgtcaacttccatgcattttaaagccctaatattgtattgtttagacagatagtttatacggatggacccaacttgttgtttctcgtgcaccatcattaacccattttcaagacaaccataacatgagtatgcgaccctaaattgtcgcatgctagcactacatttaatcatatgaaggacgaggggactctagaagcgcttgaagcataacatatagatttttttcagatcatcaatttactataagcgtgagctatccaacatgttgtttcacatgcttcatcatcaacccaagtgcaagacaacctatagcatgagtttggggcccaagatattagatgttcgaatgcaggcactatagtttgtagatatgaagaataaggtaactttagaaatgtttaaagtgcaacatgtatattttttagatctataattttaaggagttgagagctatatttctgcaattgtgtttttattttgatccatgttttaagatactttgttattattctattacagttataccaatgatatttgtaacaaaagaattagatatagaaaaaaattcattccaattttaagtacaattttctctatgcgagactataaacaaaagtagtttaggcatgttatgttaaaccatatgtagtgctattttaaatgattcttggttatggacaatattgcatgttttgaggccactcaaaaagcatgtatgggactcatgatatttatcatagaacaatttaacccaggaaaattaaattacaatttgctcattgccaaactgtaaacatcacttgtttgg

SEQ ID NO: 519 - DNA, 2362 bp, Zea mays
aattttaatcatcttcgcctatcgcgattttaataacgcatctgtttcatttgtcacgagttcgacatcgtttttatttatccgggctcttcctaaaatttttgtgatgttcggaacatagtcgttccgaaaatcggtgcgtccggtgattatttaaactacatcgctcgcgcaaatacgaacttggaagctcgatccaccgttgtgatctgtgtcccaaatacatttattataactcaacgactaaaatactcagtgcaaaataattaggatcgcaatctggatgtcgcatcgatatcgcgcgtttatttcacgatatgtcgagtcgtgtgtccgtataaaagttatacagagaatacgaaatcgtaagctcgacccactcttacgattattatctagagcaaatttatttagaactcgacgaataaagtttcggggcaaaataatccgaatcgcgcatcgtccgagagaaatcatacgcgagattaataatcaggagtatttggtaataaatcgattaaaaaagataaaggtaattagagctgaactcgaataatttctaatcgatttaacttcaacaaaatcagttgaaaattaaaataccaaagccaaaatccatgtagttcggtccgtgtgttctcgtctagatctgaatctccatttataaatcacgggtgaaaacgcatctcattccgaaaaatccactaaatcaaatccttctcaaatattctatcgaacttattttggttcaaccttttaaacatctctccatcttctctcccgccgttctctctctgatcttttcagccgcccgtggccaggatatttttcttcagccctatctccacgccctgatttttctaccgccgcctgtacttatcttcttccacctgcgcgcttattctcagccgccattcagttcatggacagaaaaatcccgccgtcgttcttcttcacgcggagccggccttcttccatctccatccccagctccggcggccgagctccaaactgaaacatctagtgctagcgcccaggacgcacgaccccctgctcctccatcctcagcgccggtcccagcttgggccctcccatggcgtccgctcggccctgcccttctccagccgcgcccgaccgaatctccctgcgtcgcgcgtctgactcgctctatagctcccgcgccctgtcatcctccatggctacgcgcgcgagctcgacggtcctccctgcccgagcccgtccctatggcgctcgacgccctgctcgcctctgcgctgcgccctgctttctggcgctcgccctgcctgctcaagcgcaagctcagctgagtccctctgtcgcgtgcttggctcgcccagctccctcgctcctgctgcgctcgcctgggtcgctggcgttgccctctgtttgccgcgcgcagccgacgtttctccctgacgcgtgctccgccttgccgtctccctgcgcgttgtggtatcccggctcttcctagctcggaccgcgctcagtccccagctcgccacgcgcggtcgagctctctgcgcacacgccgcgcgcagccgtgtccctatgctcgccgtggccggttccctgcgtcgtgccgggggtttcgccgcgcgtccctgcttgtcctctgtccacacgtcatgcatggagcaatgaaacaaaaatctgtgcgcgtcgagctcccgcgtcgaatcctttttcagcttgtccgtgacgcgcgcatgatggacgtgatgttgtcgcagcgtgtgtttgcgtccgagcccgcccggccacaacctcgctttgctctccgcgtcgctgctcgctgaatccagccccatgttgtcgtgtccctgttccagcttgttgtgccgcgtcgtcatcacttctgtcgcgagctcgatccccgctgtcatcgggcttcacacgtgctcgcatttgtcgtcgagctgttgaacccgtcctctcttgctcgtgactccgtcgtcacgtcgtgtgtgaagctctatatacgtcaccctcctgtatcgtcgtcaagctcgtcgaaccgcgaatcccggatgttagacaaaaataagcgaggtccatgtgcatcgcttatcaaggactcagtcaaagacttcaatcgaaggtcgtcgtcgttccatgcgtcatcaagaaatcctaagaatcaggtgatgacgaagctagaagcgtgatattcaccaagtgctcgacaaaagctcgaacaagccgttgatcgtcatcctcgtctacgccaagctctgtgaagattaggcgcagatgaaaataaatcagtacgcgaccggagaattctcgatatgagcaaagaagaagcacgattcgacgcaacactcaccctatttttggtgaa

SEQ ID NO: 520 - DNA, 2361 bp, Zea mays
acaactcttctatatgatttttctacagaaaacaagttttagttcatcaaacatacagcacgacaaaaatagtgcgtgcagttcaaaacatcaattaatgactttcagtttctatataattcaagaattgccatgttttatagacttcaattattctaacactttaccaaggcatactcaagcatagtcacacaatagatgacgtgatggctacgtagtcatgccatcacttcaccacacactcccaagtaacaaaacaactctaatcgaacttggcatttagccgatcgatttctacccaattttcatatcaccacgacacggcataccgaatacattgaatgactcgttcacatttcatatatatttttaccaaaacattcccacgtcgattgaaacttaacataagctccactacccaatttcaggacatctacttaattcatgaatatcatcgccacacacatcgactcgatttgaattgaccacacatgtctatcacatgaatggagcatttcaacaaatatcctaaaaccaactacatcatcacacatcttgcattacaaacctacttgtccactcgaaaacatctattcgaagtaatgaacaccaccgtacactatgtgtgatgtgaaattcaataaacgcataaggtgtattggctcaacttatacacatagaggaagcgatgactactttagcatgtcaccacctctctaattaagccaagacaatttcttcctacaacgaccaaacattcatgtcgagcacactctattttaccctgtctcgcatacaatcatattgtggcgtgcactcgagacattaccgtttaatttaacgcaatcactactacaacgcatcgcatatttttcctaccaagatataaaaacattggagttcttttctacttcattttcttctctacacgcttccattcatacaaatgtattttcacatacataatcacacatgcacgtcatcgaccaaaacctaactagactaactacaaatcgcacacatcaaataacctcttgttctccaatcgcaaacgcgatcctaccaatgcgcataaccgaaacattttacacgcattcacacatacatgcactgcctgacatcaaccaaatcatatgtattgtaaaccataaatcaatcaacctgaacgggatcagatcggagttgggcatgcatgtggttcacctgaccggccttgcatcgaacacgcgtgcacgatagttagcattgacggctagctgcgattagacacacacaacagttcaacattctaccgagcaaacaaaacaaaaataggatagcagcaggggcagcgggatgtctcaccgggggtgaacgacgacgacgacggggctgcacaaagacagcaaacacccggcggcatcatgacgtgctgctcactgctccacacctcacatggctagatcgccgaacacgtggaacgcgtgcagcgctagcagcgaggaagccaggggagtgacagggctgcagttttttggaccggcatcgctgcgcagatacttggacgctgtggctgcagtctgagcaggggctccttgctgccgcactaggcaaaaggaggaaggggcgatcagcagcaggggagggaagccggctgggaggaagattaacatggaggcgctggaaaaatttctgggcgccatccatgggagttgctgctccctgcgctgaaccggatcggaggagagctcggcgtgtgctgcgggagatggccagttggacccgcgcccatggagcaggggaacagggagctcgaccaaggcgcccatggcaacagcggctaccaaggccgaccgtccgaaatggggaggcgagcccctagggcaggggctgggcggccgtggaagggagggagctcgtccgcgccatggaggagagctcggcggcatgggtgcctggaggaaggagctcgccgcagggaaggctggcggccatgtaggaagaaggcgtgggctgctgccgtgcgggagaagaagacatggaaaaaaagagtggcggctagggggtagatgaataaaagtcaagtgcaagtgaggggtctttctatttatagaagagctctagggctagggttttaaatgggccaaacgggctaggctggatttggcccaaaacacttaatcgggctgtgctaaatacttcccggaataaaaatgctcgtgcggaattcgtctctacgcggaacagagtgaactagagttcggacgaacggacgattgcgcgattaactcggccgagagtttgatttgacttcgctcgaaaataattccctatgcgtgatttgaaaataaatcgtcttaagatttgatcggctttggattt

SEQ ID NO: 521 - DNA, 2359 bp, Zea mays
ctaagtagccacctagtcatcgtctcttcttcaacactagcagtcaagtagccaccctgccatccttatcttggccattggtaaatattaatataaatgacaatattattatctaaagtagcaaatgtgtaaactgtaagcgtatagtcgttagtttagccttcaatacaagtaatctagttatcaatttgtacaaaaaacaagaagtgaacttataaaggactaggattatcttatgacaatacaagaagtttacgacagtggatagagatgatctttgtaggttatgaagtatgttgaggtaagatatttttactaacaatttagtcttcctttctcaccagggtcataggcgagacaagaggaataatagtttctacagaagaggctatacagttgaccccaatcctatcatttaagaacttgccacgaacacatggtcaaataccaagagtaggcatgattgttaccacctattagcatccataatccatccatgcgacaatgatatacataagtaaggtatagtctagacactacatctacattatataagttctccatcgtatgttataaatatactacaccctaatcagatatcgattgatataaaagaatcttgcatgtatttcttagaagaagagcaaatacacagaggtataccatggaaatgattcctggcagatctagggctttctttaaaagacttttctcactctctccctatttgcatagtattactatgactgcctctgggtacgggtaccccgtgcgctatagcataaccggccaacacaaagtatagactaaggaccccaccatcttggtgggtcaaatcaagaagacccatgtatgaggagaagactgtatgaccaggagccctgccacatggccgcgtgggaggtcccctgccatgcatgacttgaccaagctcccaccctacgggcaccctgccaatgtgattggtggtgtcggtgtttggatctgtggtcctaaccaaccagtgaaatagagtcgcatgccccagacccagatggtgaggcgagttgacacaagtcgtttattctagtttgggctaggaaaggcaccagcagagggaggatgagacttatattactcacatcgaagtgctcgcagtagggtttataggcacaacaggagagggaaggataccatattaccatgtcccaggagatgattgaggcaagtgccaataccgagtggagaagacttgagaagtattcgcccgcccttgaagagtcgtagactatcctatttataggctcaagggtgcttcctagaggacgggagtcggcaacacactgtgaggggatgtcttgcgtatcctatagacggtatggtcttgtacggcgttgttgacttgtgcctgcttgttttctgctgagagccgacgtcaaagctaagggctgggtcacgttcccgagcccccctagggagggtcgcccatatagtagtggttgacacagggttaggtatggcgaaaagctgcttaagaggtgtgacagccccaccgtgtctaatgacattggggacatcctctgtcacggacatcgagggcagagccaagctcgggcgagactgaagtctgcccgaggtcatgactgagccttccttaacgtgcgctacagtcgacagagtggcctcctatgggattcgcggggagcaggtagccgagaccgggctcaggcgaggcagactttgtacccatgggcgagctcttcgtcgggcgacacggagtctgcgcctgaaggctgatttgtgcccctatcatattacatgttccgttaggggctgtcaggcatcatgcacatgcgtaatcatggtggtaaatctttcaacaagaccgcagtctcgtcatcactgtacgcctgcagccttgcgtgggttagttacacacattaaatgcggttgtcctccagtggccttcgagcgagcccagccacaagttctgcccctctcgcctgagatgggttcgagcgaggcagacatggcttcccaggggtgtgggagcctcgcatgggacggagatgcatctgagctctgaagacccctgagggggagctcggatgaggcagagttttgggaagacccctaagggggacctcgggtgaggtagagttcttgatcctttggcttcgaggacgtaccttgatggtgtccttagggttttaagcgtttttaccgggataatctgggtacccctaattctcatacccgatagtagccccccaagccttccaaataagtgttttggcacttgtttggaggttgttctactctttgtgtgggtgcgctatctttctttaaggagtgaaaaatgggtgcgcgcgagcgcacc

SEQ ID NO: 522 - DNA, 2359 bp, Zea mays
acccgtcgtcgtcgtcggtctggctgcccggccacctcgatgcttagcttatcgtcatcaatgcggaaagcaagcgtgtccactcagtctccgatcctgttaacggttggacgtacgcgtatatcgcgttgttcatgagtcagtagtctctgactgttgatttcatttgttggttacgaacagttgacggcaaaaggcattttttttttgcactcctctgcatatttttttcatacgaagttcgaggtggatttcatccacagcctttatgtgtacaacaggaggcatgcgcgttcgcccgtgcatctggttcacacaagcttcgatcaaacgcgcgtacgtttacacgttgctgaaactgttggcgtacaacagcaacacgtcacgttgttgctggttgcagccgtttatacgagtattagttctgggcactgcgcaaactaaccgaaagaaactgacacgctcgcgttctgaaatttccaacagacagtgctcagtgctcaccttggaatggaagaaatgttcttttttcttttcttttcggatgtgggcttgagcggatgtgctcaccttggaggtttcggttctctgcatttttgctggttcaaacacgcgtgcgtgcgtacgtggaccagtacgtatcagcgtcccgtaattgcttaggcgccactctactacgctacgcccggagatgacgatttcgtaggcagccccctccaaagtcatcttgtaacgaaatccccaaaattaattggggtggcacaccgcattactatactagtactagtactgtagcgtatgtaatggcgcataatatactactactactgtctcccacggggctcacaacacaacgcggctgccgtgcgcgcgaagcttcgcgcagccgggagcgaacacggccgcgcctatatatatgctcgcccctccccggctccggttcgtactgcacgagaacctctttgtccattccagtttccagactcctccagacagcagagcaaccccgaaccgcgcgctgagctgagcgggagcgagtccatcggccgcaatggcgagcgcggaggagctgtgcgagtgcgaggtgctgtggcctgagacggcccacgacgagggagacgacgacgacgacgcgacgcccagctgcagctcgtcgccgcccgtggcgccgcagtccagaacgccggctccggctccagctccggctccgcgaccgcgaggcggcgtccctgggagcgagaggccgacgacgacgacgcgtgcgggctcgcggccggtggacatccagaggcccgcgagctcggccaggcgccggggccacgaggacggggaccgcgaccgcgactggagcgccgccgccgcgacgatggtgccgcctcacgtgctggtgtcgcggcggcggcaggaggcgccgtgcgcgctgctgcggccgggcgcgcgcgagctcagccacctgcgcgactccgtgctgcgcgtcaccggcttcatcgaaggctgaccatcgtcccctcctctgtttcgcgcacatgcagtgttcattcaagcaggactcgtcgactagtcgtctcgtcaccattcaccgtttttttttgggtctttgtagttgtatgatcggcggcgttgcctgtttcgttcgttcgttcgttttcctgttggtccatggtcacgatgcacctccacttgtaaagagagatgactgaactcgctacttgcttgatcctccactccacccacctgcattgtgggcggaaaacatgtacgtgttcttcgatctgaaaagtccagtctgaatgtgtagaagggttaaactcgaggaaaacgtgcagattattagcatcctggttcttaatgtataatacaactcatctccacgaggcacgtacaagtttccattcactgccacgggtaaattaaacccgtctgtttgattactgtagctgcgccctaattcacttattccgcgtacacatttctcagcaaggacttggtcacttcgatctataccattccatattgattcaagtttagccaaacaaattcttggcgcaaaatgcgtctaatctaatcacttgagcacgaacaaaacgtgcaatctaagcaggctgacaattctggatactgcaacagtgctagcttcttctttttttcaaaaacacaagattagctgcccttctttgtattaaagagagaaaatatccccacacattacacatctcattcggggaccaaatatgacaagtggtcatgttaaatcacatgatcaccatgaatgaaaaaaaaagactcaaatgaacgtgtataattcaaatgatcaaacagtagtactctgaacagtcaaagggcgtgttcggctggctac

SEQ ID NO: 523 - DNA, 2358 bp, Zea mays
tgaaaccgataactccccagggggaggcgagctgaaggtggtgatgctagtggtgaaggagcaatcgtcgggagtagatgaaaccgttgaatcgtccagtcgtggtgcggccaggagtcgacagagtcctggtgcacggagcagcagagcaacgtcttgtagggccgttggggatgtcgaggcagtcgggggcgcgactgggcagctattgcgtcggtgggagaggtcgcagaagccccgcgcccagagtgtgatgtagaggtaggcaacaacaatgcatgtgtggcgagacacccgtgggtgctgtcagtacaagacacacgtggctgtgcggtgatctccaaagttcctacagacaaagaagaatgtgctagttcgatgggagcaggcacaggccagttgtgcgccgcggaggcgctgaccatcatccgaggcgacgccaggaagatccgtcggagtagggaggtggtctgacgacagagcagggacgccatcagagacacctgtagggggtggacagctagtgggtgccagccatggagcagtgcgcaggatgtggcaactacgagaagcaacgctggagagcgtgctaggcaacggaagggggaggaacgggggtcccagactcgtcatttcatgaaaagtaggagatagtctgtaaaattctatgattcatagcctagagattataacatatataggaggggaggggacatcagccggcttatagaatcaggacgggattgatctccttacccaataggatcgatatttcctaaacagaggagatagcctatcaagactacctaaataagaagatagagatcctgtcagatacaatcagtatatctcctactgtaactaagggtggtaatggatcacaatccaaatgtttttttcacaataagttaaggcccttagctaatctgattcgatccttaaactttatattgtaaaatatagaggtcattacaacacctaaatgtaaacaaatctggttactataaatggcctggcgtacatggcaaagagggcctacccaatatacaaacaacactgctaacaatatatataactaaggaaggctgaaaagaatctgtgataactgaatacttcaaacataataaattaacatgccttctaaagaaacagcaatagactagaaatcacatgtcataagcagcaattcgtaaatgcaaccaaactgcaaagatttaaaatattataccagcatgagttggccaaagaacacgatgtcaacatcagttaaggagaaattttcaaccagactatggtagcctcgtgactcatcgatcaacgatcatagtgagcatggctgacaagaaatatgggattatcaaagatcctaaacatttcagttgaaagaaatgatccaagctaaaattctcagttctaaaagatggtactagtacagtagtacaattctgcaacaaagtgcaattacccgagaggtcgtctgaatatacaactgccctagttctagagtccacagttgtacatcttctacaatttgaggggaaaaaaacttccatcatgaaacatcagtggaaatgtagcagcaagatgacaaaccacaagattataaacctgaaatggcatggcatgatgccgatgacaagtcatctcctttcaccagcaaccggcctcgattccatgtgcacaggcattggtgctgcaagcccaggcttaccataggcacctctcttgttaggcttcagttcatcagactcagcagagctggagccttcagagccctcatcaacctcatttctattctctatctttccattgagcgtgcgaacctgatcattaccagagaaactcacctttttgctcacagacgggcgagctgccacgaatgtagcattgcagccgtcatggtactcgtgggtttccaatgcatcacccataaccatctgctgatgctctttgatcagcaccttgtccacgaactccaagatccgggttagctcccggctcaccgctcgcttgccctcccggatcatcgggtctcctccctgacccaaaacacaattcaaaacccagcacaccgatggcatacagaccgacctgaacgagtttccatggtaagggttccatcacctggatagcgtcgagccggaggaggaggcccatggccacctcggagacggcggcggggtcggcgccaccgcggcggccggagagcgacccccggatcgccgcggccttggaccggagcacggcgagctccttgagctggcgcagcgtcctggagcgccgcgccaggaagcggcggaaatgggcctggatcgtccgcgccgcgcggtcactcgccgcggagggcggccccgcgcg

SEQ ID NO: 524 - DNA, 2356 bp, Zea mays
ggggtgtttgtggatctcggggtgttacaccaaacaagtgatgtttacagtttggcaatgagcaaattttaatgtaattttcctaggttaaattgttttatgataattgttttttgagtggcctcaaaacatgcaatattgtccataaccaagagtcatttaaaatagcagtacatatggtttaacataacatgcctaaactagttttgtttatagtctggcatagagcaaattgtacttaaaattggaatgaaattttttctatatttaattcttttgttactaatatcattggtataattgtaacaaaataataacaaagtattttaaaacatggatcaaaataaaagcacaattgcataaatatagctctcaactccggaaaattacagatctaaaaaatatacatgttgcactttaaacatttctaaagttacctcgttctccatatctaccaactctagtgcctgcattcgaacatctaatatcttgggccccaatctcatgctataagttatcttgcacttaggttgatgatgaaggaggtgaaacaacatgttggatagctcacgcctatagtaaattgatgatctgaaaaatatctatattttatgcttcaagcgcttctagagtcccctcgtcctttatacgattaaatccagtgctagcatgcgacaatctagggtcgcatactcatgttatggttgtcttgaaaatgggttaatgatggtgcacgcaaaacaacaagctgggtccatccataaaaactatctgtctaaacaatacaatattagggctttaaaatgcatggaagttgatgcacattagaaataaatatatcatgtagtaaacttgcacgaaattaatacacattagtcccatactcaagttttgatcggccttaaacttgagttgatgtgttcacaactgaggaacattgcaaataacactatatatgttttaaggtaacatgcataaataagtatgtcttacaatacgtcatttagaaaagagtaatgaaagtgaaaatataatttttcttccattaactatttttccgttaaaagaggtcgtaattctgcaaaatagtttatcttgaaaaatctgcatattgcaattcgaatacttttaaagttacctcattctttaaaacattgaactttaatcgtcatgcgaccatctaattatgtgggtcccatactcaagttattgattgtgttaaattttagtttatggtggagcgtgtgaaacaacatgttggttcattctataaatctaccacataatttagtgcttcgaaaagcttcaaagtttttgcatggttcatcccacaatcttttcgagaaaacatgcacgaaatcatgaccctttactcccaaatcagtgtattgcgaaaactttgatgacaaacctttttgggtcctttttgtaaaaattaccattctaaacattacatcatttagggcaatgaaccgcttcaaactgacattaatgtccacaaccatgacacaatttaaatctttccacatattttatgaggtaacatgtccaaacaggtgatgtttacagtttggcaatgagcaaattgtaatgtatttttccttggttaatttgttttgtgataaatatcatgagtcccatacttgttttttgagtggcctcaaaacattcattattgtctataaccgagaatcatttaaaatagcactacatatcgtttaagatagcatgcctaaagtagtattgtttagagtctggcataatgcaaattgttattaaattggaataaatttttttctgtgtttaattcttttgttataaatatcattgatataactgtaatagaataataacaaagtatcttaaaacatggatcgaaataaaagtagaattacattaatatagctgtcaactccggaaaattaccaatctaaaaaatatacatgttgcactataaacatttctaaagttacctcattcttcatatctacaaactctagtgccagcattcgaacatctaatatcttgggccccaaactcatgctataggttgtcttacacttaggttgatgatgaagcatgtaaaacaacatgttggatagctcacgcctatagtaaattgatgatctgaaaaagatctacaagttatgcttcaagctcttctagagtcaccgtatcattcatatgactaaatctagtgctagcatgcgacaatctagggtcacatactcatgttatggttgtcttgaacatgggttaatgatggtgcatgcgaaacaacaagttgggtccatccgtaaaaactgtctgtctaaacaattcaatatttagggcatcaaaatgcatcgaagttgac

SEQ ID NO: 525 - DNA, 2356 bp, Zea mays
taggcaatttgtcgagcgcttggcagatactatccgaacttcacgcaccgcaccatccaacctttggacatcttctcttggggcttcttttgtcagcacgactccaactcagaggcatcatgtagagaccgacatcaagacgggtgaccgaacgacgacggcaagacaaaggttggcgacgaccggatatcaacgacaagcactagagttttacgacgggctgttgtaatgggacgtcgatacacgatccatggcaattaggagatcgacgtaggcggaaccgatacccgaacaggaactgcgcagatcgacgacgcgagactcgatctggcgagcacgacgcatgggatcgcagctgctgcttcgacatgaattacttgctgccgagcatgacggaggccggggtgcaggaacgctgcgcagcgaaacccaccgttgtgcgcaggggtgaactcggctgggcgcggcgattggagcaggtggccactggggcagtgcccaggtacgcacaacgagaatccgagcagggctagtgcgtagcgaccatggaaaagatctgagctgggctgaatccgagctggagttcgcggcaacagggagcagggcgagctagagactggaagacgccatggcgagcaggagggagcttcaacggagagaggtgcgacaggaaggtggagcagggagacggacacgcaggggaggcgcacgccatgggagatggctgtgcgagcacgtcaggaagaaacgccggctgcgcgcagggcgaactctgcacgacagccatggacgaggtgggtgagcggaagaacgacgcgatggaggagcgcgacttgcgatggagagtagggctgacccgcttccatgggagatcgacttggcgagcaccgacggctggagaaagttgaggggaggtcgaggagctgagcggctgcgcagtggagcaagcagccatggaagagcagagagtcgactgggagggaggagatgggacggcgctaggatgtctgggaccagggcgcggctgcagcaggaagatgtgagaacgagcgcctactgccgtgtcgagaggagagataatgttgaggaaaaaaatctacagaagaagataaggctgggagagtatgcgcatgtagaagaagatattctaccggttacccacttaagcggcgacggagacaaggaaaaaaatgcatcgaatacgattgctggcaaagaaaatatcgatgacgaccaatgatattctaggaagtttacgtacatgagaagaaaacaacaatagagagatattttctatagtgaaaaatccaaatacgttgaaaatcataccaaggaacggtggaaatatttagagaaggattttccctaattttccttcttttttttaaaacaacaaaatacgtatattttagggtatgaaattagagtctaaaaaatatacaaaaggatcaaacaaaaatgagaccgacaacaatatttagataggatttgattcggtgaatactctcgaaattagatgaatttccacccgttatttatatccgaagttttggatctggccgagaaacacaagggccaaaacactatccggatatggtacttgagactctattaatttagttgaactcagataaaaatttatctgtttccgaatcgatttgatttctctacctagaatagcacactaatgaataatcccaatcgttaatcttgtgcacggtttcttggtaatgcaagcgatccagagtattctttcagacctagtattatctgctataaaatcaaacgttaatctctttgtctctgataatatcgggttcggataggatgcaaatagaatgaacccaaacgagattgagactgatattttaaactatatttgatacgacttgaaatcagataacttcgtcttccactcgaacacctgatcactctgccatagatgatttattggagaatcaaatctcaattataatcctttggttagcaatctcgcacatgatttttctcatacaatgtgcgattcagattattttgccctgaacattttagtcgtcgagttcaaattaatttgtttgggataaaatcatccgagtgggtcgagatttcaattcgtattcacgtgagcgatgagttttaaataatcaccggacgcaccgattttcggaacaactatgttacgaacatcacaaaaatttaggaagagcccggatagataaaaacgatgtcaaactcgcgacagacgaaacatatgcgatattaaaatcgcgataggcgaagatgattaaaatttagcattcgttttatccactgatattacgtgcttaattccatactcgttgtcgagcggaatata

SEQ ID NO: 526 - DNA, 2353 bp, Zea mays
gttgttccgaaaatcggtgcgtccgatgattatttaaaatacatcgctcgcgcgaacacgaattcggaagctcgacccactagatgattttatcccgaacaaattaatcagacttccacgactaaagtgttcgaggcaaaataatctgtatcgcgcgtcgtctaagtgaaatcgtctgtgcgaatatgattcagtttatccgtctgcacgttgttttagcgacgaaatcatgtgtgctttcgcagatatggtttcgtctaacttcattcaatttacgcagagcaaatcctcgaagccaaaactatagtggttcggtccatttgtttctcgcctcgatttaaatctcaaaagtgaattaacagcacgattccgtccgagtttagagaattcgccaaatcaaatcattagtcctcggatttccatttcgagattcggggaatgggatgcgtagataactagtgtatcgacccagtgtacagcgctaaaaatcggaaacctaaaagcatttgcgaaattcgtttaggttcaactaaataaaaccgcgtcataattactgtctaccccgtatacatcgctaaaagaatcgtgatccgaaatatctgtaatttctaaaaaaaaaagggaaaaatatcctcgttcatctctatctacagtcgctctcctccctccctttgattttttctgccgtgatttttctgctcatcttcatccggccgccgttctggatccgtggaaaaatccagcgcgatcctatcctccagccgcccgcagcttggatttttccagccgatcttatctctggaaaagatctcagccgccgcgctgttaaaaatcctactcgccggcagaagttccgaagccaagcgcccacgtcttcttcctcgcggtgtccagcctcaactcagattcccggcgtcctctccatggctccctacgccctcgtcttccccctggtgccgcgcgggcgcgcccctggaacctcctcgctgcacgcagctgcttccccctcactccccagccgatttctctgcgcgcccagcccagccactcgccatggctcctccctgcgcgcgtcgaagttcctctgctcgtcccatctccccaaagcttcttcctccctgctcggcgcttcctattcccagcgctcgaccgccccagctcgcgcccaatcctcctgcttggatttcgtccagatcgagctgctcccatggcgatttcccctcggattcctccctgctcgtgccccatcgccatgaacgtgcgcgagtttccactggtggtcgtcgcgctggacacctcccctccggtctcctctctcaagcgctgcttcttcttcctgttgccgcgcgcccagccgcctttccttttcctctcgacgcccggccgagctcctccctcgcccatggccgcggttctccaagttcccctgcgcgcgcggtcctctgtccctgctcgccctctgcgcgtgcttctccctgctcctatgcgcgcgcggttctctgctcccccgcgcgctcgttctgttgctttttccagcacgccgcgcgcagctccctctagctctgaccatgccgcgtcgcgttcccgttcccagccatggtggtcgatccctgctgcccagctccttcggcacccagccaggccgtcctggatattgcgcgctcctcccggttgccatcgctcgccgtcgcctcctcgtgctggccgactagtctgtcgtggtcgcacgcagttccctgctcggccaggatggtcgcgtcgtcgatcccgcccggacctgcagccccaacacactgtttctctgctcggtgccaagtattctactacgtcacaccgtgtccacagtaagccgtgaagacgctactatgctcgctgctcgccacctgccaacataatgcaagaaccggctatcgatcttgtctctaccatcgccttcgctttacatctttgctcccgttgtcgcggagaccctgccagccctgcacgtcgtccacgctttgttgtgttcgcgtggaggggaattctgggaaattgggtgaagaaacccgcatggcgtttaccgggtgctcgacagatagctcatatcggagatcgtcgtcgttccgcgtgtcagcaagaaatttcaaaaatcgggtgaagacgaagctagcagcgtggtgttcaccaagtgcgcgacaaaaagctcgaacatcctgcgcacgactcaagttcgattcatcaaaattattcggccgaggagaagatcttcagcaattgattacagaagaaaagaaggtccctagatgacatcaaccagaaactgtcatcgtgcttccgactatcgcgtcgaagtagtcagggtaagcaaatttgt

SEQ ID NO: 527 - DNA, 2350 bp, Zea mays
cgccgacctgatttcatattcgtctttctgagatttttgtgaataaaactagaccatacatgttatatgtcattctcatgaatgactgagcctaaatggatggaatgactatattcacatattgactgattttgttcacttcttttctcgtaatgcatgttttttagaatgactaacttgctaaatgactcatattccatctattcttcatgaatgacttatgctaacagatggaatgactgagtttttttatttcctttcatgtaaaaccttttttagaatgattgactcactaaataatttctatcttagttattctaacaatgactttttttacttcctaaaaaggtggaatgttttttagaatggctgttttttagaatgactgtaatgtatgtttttttaaaaagatgtctcagttattcccattaataactaaggctaaaaagatagaaggatgtattcatagaatgactaagtttgtcctttcccatgatgtctgttttttagtctggttcactaaatgactataatcttagtaattctcatgaatgactgaggctaaaagatggaatgactaaccctaatatactctaagataaatatgtcaattggaatctagttttgaagatttcatcgctacaaagacaacggtaaatcaattttcaatttcaacactcgatttaatagatattagttttttcaagtataacatcaaacatgtatgtacgccatctttttttaggaaaattgcggttgttacatgtagtgtcttcttttaggaaaaactagtacattgcccgtatattgtgacgggacataaacatatttgattagtgactatggtaatttatttagacaaagagttatatattatattcttgatactttctatatacttattttcgcttgcatgcaagagaacagttcgcgaatttgtacccacccaataaaatatggccatgttatgccaatttaagaaggattccatggaaatcatcttgcatatgcttggtagtttctccattttttcccaatagcttgctaacccaagtcacaatagcctcgccaattctgcatcaaattttcacatggctcggacatcgaaagactaaccatgctgatccttccagttatctggtaactcaaacaaacttttattaatagtattgcacagtgacaaaaaagaaagaaaaatagagcatatacaaggagactaaattcaacagcaaatatatacagtatgtctatgtttgtatctgttttccagaagcaccagccttctgcatttacaatctttttcggaagcaccatccttctccatacacaagctacaaactctacaagttgttatggatttacgaaaaggttgcttagatttatgaaaagtttgtttggatttacgaaagggttgcttagatttatgaaaaggttgttaagatatatacttgatttattccttatttaaaattcaaaaaaatggatttctttattttattatttttgatctagaactagaagaattcccacatacatacctagtgctatggtcattgcttgggtacggttaaagaacattttagatgccagtattactcttgccaaccatatttaggcaaacggttggggccatgccacgcccacgcatcattgtagctataaccggacggtgatgcaggaactggcctagctgtccgctgagaccgtggacggcggctgtggtaccgtgtcggtagacgctgatcgagcgaggctcgtctactaaacacgttggtgtcggcgccacgcaggattaggaaggtttcacgcaaacgtgtcatttgtttagagtacaaagcactcctttgtatttatataaacaaagcatcccatcaataaagagtacaaagttttcattcttgccatttatctctcgcttttgctccatactcaaacatgttatcagcacttttgctctcactgatcttgagttgaagaacgctgattgctagaatacgttggcgtaatcgtccttgccggatcgccccatcccactacaactatcggaggaaaggataagagcctggtacaagaatcgaaaacaaagaagatgacaaacaagaaacaataaggtaaatccacaaccgcatttgccatgaaacaaacatacatgtgcgctgaagccaagcctgaatggctgcacgcccgcgctgcggggctgcatgcccgcgtgtcggcgcaccagtggttggacggggcctcgcctgaggcgtccgggctggggccgcactcgcgcctttgtgcatcggagccgcgcgcccttcgggcttgtggacactgccaccggaggaagtggtagttaggttgtggt

SEQ ID NO: 528 - DNA, 2349 bp, Zea mays
gcatgatatatcgatttctgatgtgcgtcaactttgatgcattttgatgccctaaatattgtattgtttagacagacagtttttatggatggacccaacttgttgtttcgcatgcaccatcattaacccatgttcaagacaaccataacatgagtatgcgaccctagattgtcacatgctagcactagatttggtcatatgaatgatgaggtgactctagaagcgcttgaagcataacatgtagatctttttcagatcatcaatctactatagtcgtgagctatccaacatgttgttttacatgcttcatcatcaacccaagtgcaagacaacctataacatgagtttggggccatagatattagatgttcgaaagctggcactagagtctgtagatatgaagaatgaggtaactttagaaatgtttaaagtgcaacatgtatattttttagattggtaattttccggagttgacagttatatttatgtaattctgcttttttatccatgttttaagatactttgttattattctattacagttatatcaatgatatttataacaaaagaattaaatatagaaaaaaattattccaatttgaattacaatttgctttatgccaaactataaacaatactagtttacgcacgctatcttaatccatatgtagtgctattttaaatgattcttggttatagacaataacacatgttttgaggccactcaaaatacaagtatgggactcatgatatttatcacaagacaacttaaccaaggaaaattacattacaatttgctcattcccaaactgtaaacatcacttgtttggacatgttatctcataaaatatgtggaaagatttcaaatgtttcatggttatgaacattaacgtaagtttgaagcggttcaaagccctaaatgatgtaatgtttagaacggtaatttttacaaaaaaggacccaaaaagttttgtcatcaaagttttcgcaatatactgatttgggagtaaagggtcatgatttcgtgcatgttttctcgaaatattgtggcatgaaccatgcgaaaactttgaagctttttgaagcactaaattatgtggtagatttaaagaatgatccaacatattgtttcacatgctccatcatcaactaaagtttaacacaattaataatttgagtatgggacccacataattagatggtcgcatgacgattaaagttcaatgttttaaagaatgaggtaactttaaaagtatttgaattgcaatattcagatttttgaagataaactattttgcagaattacgacctctattaacggaaaaatagttaatggaagaaaaattatattttcactttcattactcttttctaaatgccgtactgtaagacatacttatttatgcatgttaccttaaaacatatatagtgttatttgcaatgttcctcagttgtgaacacatcaactcaagtttaaggccgatcaaaacttgagtatgggactaatgtgtattaatttcgtgcaagtttactacatgatatatttatttctaatgtgcatcaacttccatgcattttaaagccctaatattgtattgtttagacagatagtttttatggatggacccagcttgttgttttgcgtgcaccatcattaacccattttcaagacaaccataacatgagtatgcgaccctagattgtcgcatgctagcactggatttaatcgtataaaggacgaggggactctagaagcgcttgaagcataaaatatagatatttttcagatcatcaatttactataggcgtgagctatccaacatgttgtttcacctccttcatcatcaacctaagtgcaagataacttatagcatgagattggggcccaagatattagatgttcgaatgcaggcactagagttggtagatatggagaacgaggtaactttagaaatgtttaaagtgcaacatgtatattttttagatctgtaattttccggagttgagagctatatttatgcaattgtgcttttattttgatccatgttttaaaatactttgttattattttgttacaattataccaatgatattagtaacaaaagaattaaatatagaaaaaatttcattccaattttaagtacaatttgctctatgccagactataaacaaaactagtttaggcatgttatgttaaaccatatgtactgctattttaaatgactcttggttatggacaatattgcatgttttgatgccactcaaaaaacaattatcataaaacaatttaaccttggaaaattacattacaatttgctcattgccaaactgtaaacatcacttgtttgg

SEQ ID NO: 529 - DNA, 2347 bp, Zea mays
tatattccgctcgacaacgagtatggacttaagcacgaactgtcaatgaagataataatctctatatctaaatcctagatgtcctcgcctatcatgatttctatatagcacctttctccaactatctagactgtccaaaatattccgtggagtttagactttatcgaccttccaaaatatcgagtcttgtgctattcaaatttatcggataacggcgaaattcgtttagattcaactaaatcaaacgtcggctaaaatatcgaatctgatctcgtccggtttgaacctgtctacagctcgctcccatgacgatgctgacatcgtctccgggggattccgattgcgataccgcattcggtatgcacggtttaaaatttatttctttctaaagtgtcgagcctagtgccaatttaaaattatttgattaagacaaactaaaattgtcacttaagtatttcgttcggttcgagcaatctctataaattcggtaaatatgctatttggggcaggctgttcaaataaaccggaaccggaaccataactagccaattcggtttcctatttcaaaatccgaggaaataatacgcgtagtcgtataatgcgtcgacctaaaaatcccaattcaaaatatctatgaatttctaacaaaaaaaaaagaaaagagaaatatctcccgccgcactctccccagatttttctttcccgcctgcgcgcgcggcgttgattttttttcccagtgtggcgctatctccctggataattgctgagccaccgcgcgcaccgtcttcgtctccagtttttctacgggcggtgctcctttctccctacgcattcccagccactcctctctccctgcagctccctccaccctgctcgcctacggcgcccagtccatggcctccctggtgtttgtccgtgttctcggcggtgagcgagggcctcgaggtgaagcccgtggcaccgcacgacacggccacgatgcagttggcagagaacctggtgctcgcccctcccctccgccgtctccctccccaaagatgcgccttcaagttcccagcgccctgctcgcccccttgcttctccctcctcccgatctcccatggctgagcgccgccgtcctccctgcgcacgcgtcgcggcgtccaactcctcccagccgagcccctctacgcgctcctgatctctgtttttcccacgaccgccttggcgccatggtttggggctgcgttgaaacggtgaggctctagcttaaccatgacattctatggacgggcggattcgtctccctcgacgagctcacgcctggaacttccagcggaccaaggctgaccaggatcgcttgcgccgtgacgaggattggggccggctgtccggtctcgtgaatcgcctcgtcgtggatggatggctggatgggggtaggcaaatccggatccattgcgctactcgcagggcgcgtgggggtctcgccggccactgtccatggtcgtatgacagatgtgactcgcctgccatcctgcttctcttctatctcgtcgccatggagctcgtcgcgtccctgtgtttgagttcgtcgcccttcactcttctccccatggtcggacaacctcatcgatgctgctatttggtggtcgcctcttggcctgatctcgtcatcgcgtccgcgctcctctgcttggcccgtcgtcattctctagctgtcctgcgcgttcgtcggggcgtgctgtgtgccggtgttcccttctgcagacctcgtcgtcgcccatggtcatagatctcgtcctcacgtcatgtgcatgctggcagcaccgtctcctctgtgctcactggccacggcgtccccagtctatcgcgccacgttctagtcctcgattcacggtcgtgtctgtttctccatggatctccctcaacggacccgcccttcacctttggtcgtgccagcaggcacttgagtcgctgtccttgacgtttgttgacgtgcgggtcgccttggcctaggtcgtcgtctttcaaccagcagctcgtcacgggaccgggtgtcgagctcctttcccaaaaaaacgccagatgtacaagttgtttaatcctctaccgtgaaacattatttagtaatgtacaagttgtttttatgttcatacatgtgcattatgcataccatataggtacgataattcatcacgtgatgcggaagatgagccaagtcgaccccaagcacgggctactccgcatgatggtgctgatcgacgaacctgcctgatcaagtgctaggacatggatgatcgtcaagtggtcgtcgtctaacaacactaacctagtattcttccaagcaagccccggtgcatttgtcacc

SEQ ID NO: 530 - DNA, 2346 bp, Zea mays
tcttgtaacaccccaggtgtttatattccgctcgacaacgagtatggacttacgcacgaaatatcagtgaataaaacagatgctttattctaattattttcgccatcgcgattttaggatcgcatctgttccgtctgtcgcaagtgcgacatcgtttttatttttatccatccggggtcttccgaaaatttcgtgatgttcggaacatcgtcgttccgaaaatcggtgcgtccgataattatttaaaacccgtcgctcgcgcggatacgaaatttagaagctcgatccactcggacgattttattccgagcaaattagctgaactcgacgattaaaatgtcgggggaaaataatctgtatcgtgcaatgtctgagaaaaatcgtgcgcgagattatgacccagtttattccttcagcacgtggttttggcaacgaaatcgcgtgagcattcgcagctatggttccggctgatttcagttaaatcgtggagcaaattgtcaataccgaaatcagtttatttcggtctgttgtttctcgccggatccaaatcttcagatataaacaattgttaaacaattcggttcctactcgacaaccgagacagctcgtccgagaaattctaattgagctccaattcactggtaacttatccgtggctgtggaaccaggtgttcatacacggatgaaattattgatttcaaatcaaatggaatacaatccggaatactgttctcaattgttctgattacaattcgctccgatcaacatattcggataaaagtatttaacaatagattatctgattctgtgaaagtttaccaaattaaacgccatctaaatattgtcgtcagtctcggtttggttcaaaccatttttcatctttaaaatactagtttctgtaactgtatttattttgtagaaaggatagaagaaagaaattaaaaaaaaatataaagatcttcggtcgccaatctctatctctatcccgtggtgatttttttgttgctgcctctcagattttttttaccaatgaccggttcttatctgctggtcaccagatttttctgtacgagagcttatctcctacgcgtcgtcatcgttctcaccctgatttttctacggccgccgctcaccgtcagtgaagattccgccgccgttctcccctgacgctcggccttatctcctccctctcttcttcttccccgtgcacccagccattccggcattcagtccagctcgcagaagctcaccagcgccctgcgtcttctccctgccgtgcccagccgcgctggctccctgctcgtccggcgagtggagcactggccgcgtcgggctccctcgacgtgctcccttcccttctttctcgccggcgtgcgctctagcggagtgtcggccgtccgcgcgtttctctgctcacggcgctccctgtccgctcgtccaacagctgcccaagtccgtcctctgtttggatctcgtctgtgccctggagctcgcccctgtcgcgcccagtccaagctcctcccctgccggcgtccagcacccggccggatctctgatggcgcgcgtgcccttctcttggcggcgctcactttctgcttctctctctcgagctcgccgcagtgcttttcccttgctcccatggcgcgccggccgctcctctctgcccagcatagcagcttctttccctgcttctcccagtcggccgaggtctcgcccgtccgtgctccttcttctagctccagctcgcggcgttccctctgctgagccatggctgtcgtgcctcggctccgttgttttccctgcgcgcagcaatgaggattctgccgcctagccttcgctctcttcaacctccagctcgctggagctcccatcgccgcgcacagcttcttctctgatggccgcgcgcccttccagctcgccacggcgctcggtcctgctcgatgttcctttgctcgcctagattcccccttgccatggccgtgcgttgccggctcactgctcgaccgcgttccctgcgcgtccctggatcagccagcgtcgcgtgtagtgtaggtgtttgcggtcggtggatcctcgccgtcgatactgcgcttgctgatggccgaagctcacgtcgttcgtggtgctgtcgtgccatcgcctcggtctggccgtcggccaggacctctcaatactcagctccctgttcgtccacggcgcaccccgttttctgtcttgtcgtcgtcgttcagtcgcctcgccctcgcgccgtccattgttaggcacaatctgctctagctcgtggacgtcgtatcctggctctggtcgctagatgccgcacctcgcctgtgctgaccgtcatcacgt

SEQ ID NO: 531 - DNA, 2346 bp, Zea mays
atgtgcagatttttcaagataaactattttgcagagttgcgacctctattaatggaaaatagttaatggaagaaaatttatatttgcacttttattactcttttctaaatgtcgtactgtaagacatacttctttaggcctgttaccttaaaacatatatagttctatgtgcaatgttcctcagttgcgaacacatcaacccaagtttaaggccgatcaaaacatgagtatgggactaatgggtattaattttgtactagtttgctccatgatatatcaatttctgatgtgtgtcaacttcgatgcattttgtattgtttagacagacaatttttacggatagacccaacttgtttcgcatgcaccatcattaacccatgttcaagacaaccataatgagtatgcgaccctagattgtcgcatgctagcactagatttggtcatatgaaggatgaggtgactctataagcgcttgaaatctaacatgtatatttttttcgtgtagtcaatttactatatgcatgagctatccaccatgttgtttcacatgcttcatcatcatcctaagtgcaatacaacctatagcatgagtttggggcctaagatattagatgttcgaatgctggcactagagtttgtagatatgaagaatgaggtaactttagaaatgtttaaagtgcaacatgtatattttttagattggtaacttctcgaagttgagagctatatttatgcaattttgcttttctttcgatccatgttttaagattctttgttattaatctattgcagttatatcaatgatatttacaacaaaagaattaaatatagagaaaatttcattccaattttaattacaattttctctatgcgagactataaacaatactagtttaggcatgctatcttaaaccgtatgtagtgctattttaaatgattcttggttatggacaacaatgcatgttttgagtccactcaaaaaacaagtattggacacataatatttatcacaaaacaatttaacctaggaaaaattacattacaatttgctcattgccaaactgtaaacatcacttgtttaagcatgttatctcataagatatgtgggaaattttcaaatgtttcatggttatggacattaatgtaagtttgaagcggttcaaatccctaaatgatgtaatgtttagaacggtagtttttacaaaaaggaccaaacaaggtttgtcatcaaagttttcatagtacactgatttaggagcaaagggtcatgatttcgtgcatgttttctcgaaaagattgtggcatgaaccatgcaaaaactttgaagcttttcgaagccctaaattatatggtaaatttacagaacgatccaacatgttgtttcacacgctccacagtcaactaaaattcaacaaaatgaataactaatgggacccacataattagatggtcgcatgccgattaaagttcagtgttttaaagagtgagataactttaaaagtatttgaattgctatatgcagatttttcaagataaactattttgcagagttacgacctctattaatggaaaaataattaatggaagaaaaattatatttccactttcataactcttttctaaatgtcgtactgtaagactacttgtttaggcatgttaccttaaacacatatagtgatatttgcaatgtttctcagttgtgaacacatcaacccaagtttaaggccaatcaaaacatgagtatgggactaatgagtattaatttcatataagtttactacatgatatatcgatttctggtgtgcatcaacttcgatgcattttgaagccctaaatgttgtattgtttagacatatagtttttacggatggacccaacttattgtttcgcatgcaccatcattaaccaatgttcaagacaaccataacatgagtatgcgaccctagattgcagcacacttgcactagatttggtcatatgaaggatgaggtgactctagaagcgcttaaagcataacatgtagattttttttcagatcatcactttactatagacgtgagctatccaacatgttgtttcacaagcttcatcatcaacccaattgcaagacaacctatagcatgagtttgggcccaagatattagatgttcgaatgctggcactagagtttatagatatgaagaatgagttatctttagaaatgtttaaagtgcaacatgtaaattttttagatcggtaattttccggagttgagagctatatttatgcaattctgcttttattttgatccatgttttaagatactttgttattattctattatagttatatcaatgataattataa

SEQ ID NO: 532 - DNA, 2343 bp, Zea mays
atcatcaatgtcccaacaatatacagaataatttgtgtgattacactaggaaggtatcccattactaggttactcatgtagtttttcctgcaaataggccaggtaatatatattcaataggtgcaatatggagacatgtcaaatggatagtatatatatttgtagcgacataagatcacacatctatagagatagcccaactgaagtttcagtacttacttctccaacctttcttttaaggaagcaggaatcaactgttgcaactgctctaggtcagataatgcttgtatacacaccatcagcatcaaaagtaagaatgcaaaaataatacagcctagaactagtgttgatttacgccacttattagattgccaaagattggaccaatacatgtcttctggttctggagccggactagtaacccatttcattaggttagatgtctggaccatattcgatgcagtaactacatcatagcgagttttgaaaaatacaaaagcagttgtgcattcctgctgtatataattccacatagaaattactaatttaatccatattattattgttaaattaagcaattaacaaatgcatgcatgcaagaattttaacctcatgatctaagtttagggtggattcttcattgtcagggttcctcttgttttgctcgcatttagagttgaacttcgaagaatttggagagcgtggtcccgcaaaacaacaacttttggtagttgtcgtcctacatccccgactgccgatttcagctatgaaatgtttaaacttcttatgtgccttctttgcgccagtctgtcagataagttaaatacaccataaccaagaggtgaaatacaaacacacataaggaaagaaaaaccattcaacactgaaggaactggacatttgttcacttgttcatgtcaaaaagacaaaaaaaattatgagaaaacctagctaatcataagatgaagaagccttatttatacttcgctttagaatatttaatagtaaaagagaaatgcatgcatttagtactagataccattatcttgtggacaagcccaactttgtagacaatttgatggaagagataactagacgagtgatactttgtgaagaaatttccaacatcatctctgaatgattctttagctgtctatggtatttcacgaacaaggagtgcaaatttgcttggatttagctttgctcttctgagatgaagggacatcaacgtggcaatgtgcttcccctcctgcattgaaggaaaaaacagatcagcagaaaaccttccaactacaaggagatggagcctttcagaattcaaatgcaaaacaaacttacaatgtacagaagtaagcatgttactccagaaattatgtacaacaccgcacaatggatcaagaggctgcatgcaaggaatcataaaaacatgcactatgttatattcttcactgctcattcttcctcaagttctaaagaagtgaatgaagaagcatggtgggtgaattaatcaagtcagaaaacacttgataataaattaagagagagagagatctgatggctatcatgtggaaggaggctgctatctaagcatcacccgcacaatcattcttttaatctaagacgcacacgtgtgatctgttggctaaaacacaccgatattggttagcgcctaagtcatccaacgctaacaatgctagttttgcatcaaaacccctctattttattgaaataaacatgtgatacactccaatatatggttatttgaaatttaaacttggatgttcgataatgaaataaaatcagtaacaaaatcattttaactcaaaaaatttattttggtctcaaataaaatatattcttgcatagaaaaatctacagatattttatgcaatattttcatgtgttggtgtaatatttcttacattatcttagtgagactatctcatgtcgtttggtgcctgtttttccctcattccagcacttaaaagattttagacatattgtaatgttacttggggtagtggttcctctaattgtcactctctttctacctatcgtgttttggtgattctattattgcttgcttggaagactaagaagtagtttctcattcatgtgtagaggtagatttgcatgcaatggctcctgtgatggctaaggagacttgttatgttgcttgcttgtggattttggtgttcaatataggtgtatcacacgtgtgatcctgtcaaacatgagcttatagtattcatattagtgttgatgtttattacactcctacacatgtttagggtattatgatatctcttcgtaatgtaccttcaatggctgattaatgatgaa

SEQ ID NO: 533 - DNA, 2342 bp, Zea mays
ggatgggctgggatattttctttttttttcattttctcactctaccaaaagcgcgagccaaaatatcacggatctagaattaaggtttggaagagccaaattgagtcagactatagtgtttagacaatatttgatttggtgaaggttgctggaatcagataaatttatacgagttatttatatgtgaagttgtagatctgagtgagaagcaacagaccgaattaaactgatttgggcttcgataatttgctctgcgtgatttgactgaagttagccgaaaccttatctgctaatgtacactcgatttcgtcaccaaaatatctgaagaaacaatccaatttaaaatccttaaatgctatttatgtaacatccctggtgtttatactccactcgacaacgagtatgaatttaagcacgtaatatcagtggataaaacagatgctaaattttaaacatctttgcctatcgcgatcttaatatcgtatctgtttcatctatcgcgagtgcgacgtcgtttttaattttatctgttcgggctcttccgaaattttcgtgttattcggaacatagttgttccgaaaattggtgtgtccggtgattatttaaaattcatcgctcgttcgtgcgaatacgatttggaggctcgatccaccgttgtcatctgtgtcccaaataaatttattataattcaacgactaaaatactcagtgcaaaataattaggatcacgcgttggctgagagaaatcttgcgtgaggctgataatcatgatatttagtagcaaatcgttcaaaacagataaagataattagagccgaactcgaataattgctaatcggtttgacttcaacagtcgtaaattaaaatagcaaagtcgaaattgtcttgatacagactgattgcatctcgccccgatcaacatgaatattttttccgcaaacagtttagtttgcagcagggctgcaccaaattttttttccgcgtggggcaccagcctctatcctcttcctctcgcgcgcagctttccccagccggctgagcttcttccctacggcgcctggcttgctccctgcgtgctcctctctgaccagccgttcttctctccctcaagctcgccgtggagcttcgtttccccatgccgcgcctcaagctcctcccatggcgtcttggagctagccatggccaggtggtgctgctcccttgctcctgcgctctggtcgccctttgtctgcgcgcccctctcccctgttctcggcgccaaatttttcttcgggtctctctcttccacggcagctgcgcacgtcgagcagtctcttcatttctgttcgccatggttcgcccagtcggggtcgcgtgcagctcgcccccttcttctccatagccgggcgcgtggagttctctgctcgccggcgtgttcctactccaaccatggccgcgcgcttcatctccctgcgcgtgctgccgcgagctcctcccttgtccatgccacggcgcccctgctcgttcttccctgcacgcccagccggagttccgctgctcggccatggccgccgtcgagcttcctgctcgcacctatcttcttcgctgtctgcaccgtcgaagctccccgtgctgtgcgctcgcccagctctgttgccgcgcccagctgttcctccctgcgcgcagtggtccgtcgttcccgaccatggccaccgcgccgtggagacctgcgcaccgactccagctcggattggtccatgccacgcgtgcgcgtctccctctgcgcgtctctctctgctcgctcgcgctccgcgaagctcgatccctgctgcgcagctccttcggcgccctccctgccgcagcacacgcccgtcgttctgcctgctcgccgcgcgctactccctgtgctcgccggtttctcctctggcacgcttccagcaccatggtctcgccaagatccctgtcgagctcgtccctacgcgcatgtttttctgcgcgcagcttcctcaagtcgtcgtgtgcctagctcgctccagctcgccggtcgagtttctccctcacgttcggacccggccattaacacccagtcatgtgttcttttcccagctcggatctcgtcagccgccgttctctaacctgtgtctcggtcggtgtcgtggagttttggttgttcggctcgtcgttgaccttgccggtgtcgtcgaaccgtcgaaccttgttcttccctgctcgatctcgtcgaaccccgaatcccggatgttaggcaaaaataagcaaggctcatgtgcatcgctcatcaagtgctcggtcgaatacttcaatcgaaggtcgtcatcgtccgtgtgatgatcgagtcaaatttgc

SEQ ID NO: 534 - DNA, 2340 bp, Zea mays
catgcataagattttgttgacacctagaggagacggttcctacattgttcgactccagtgcacctaattgggcctataaataaaccaacaatacaccttaagggagaaaattaagttgggtatatgatcgcatgcaaatgcgacattagttttcaggcctgctctgacggtgtaaacaagcgaaactatatttttcagacctgctaaccaactgacacaaagttgatatagttaggcctcatttggatcagctaaactcgacaacagctaactcttgtgttttagtcttttgttgatcttcatttttattagtttcaagatcttcatgcttaacaaaagagaacaaatttcccagcgcatcctcaagaaatagcatactatctttggcatttatcgccactacatgtcatctaagaatttcaacaccttaatttatttgtgctcccacttccacctcctcaacattatgcaaaagcttttgagctgcttcagtagcccgctttacctgtaagttcttcctcttaatggtcccaccgtaacattcttccattgtcttaagttgtttccacacataattctttttcgtttgttatgctgaaatttcattgtgcttctctcatctcaggatctagtaagctttctttagtttttaatctcttccctaatctcttctccaatcttttgggatccgaattgtcaataccaatatatgaagtaaagtttagtcccaacaattcagatcaccaaaaaagtgaggaagatattaggtaagagataagaaaactaaagtaagcttccaagatcatgagattagaggacagtgaaaattcagcacaacaggcaaaaaaagaattttgtgtggaaccagcttaagacaatggaaggagattacactgggaccattaagaggaagaaaatagaggtaaagcaggctactgaagccgctaaaaagtttttgcataatgttgatgagttgcaattgggtgccccaaagaaggatgataaattgttagactacaaatagtggcgacaaatgccaaaaagaggatgttgtttcttgaggatgagctgcaaaaattgttgtctttggtcaaggataaagatcttgaaactttataaaaataaaatcaaccagagactaaaatgcaagatttagttgctgtccagattaactaatccaaacgaggcctaactatatgaataggtggttagcaggttactaggttcttattgggtgagaaacatttgatgccggtggattttgttatgtgggtaaaccctgaatcatgtcacatccactcttctcaagactaaacagaagagttaggtgcagattagtttaactgtggtctatataaaataatgtggactaacttgttctctatagacaattttttagtgatctcgtgggccaaaagttagacgaaaagttacctacttctccacgagaaagttgcaattaataacatgcatgttggtcaaactgaccactcagacccaattgcatcaagatttggcacacggacgaactacaaacataaatgaacagtcaggactcacaaaatcaataggcttgtgctattgctcactctctcactcaccgagaagacatgtacacaactctctatcttgtgagtatcaggagcatcgtcttgctagctttctcctaccagagcaccgcactttctcatagcactagatggcacatcattgattgatccctacatacagcgttagcacccattaaataaatagaagtagacaacaacatgtctagaaactacacctctcgtctcgtctggtccacatgatgcatgcatcttaccatgagaagcggtcactactgcaggccaaccgtatgtgtctctccaaacataggccgcactagagtgcgttcttcaactagtggacgcaagactcgcactaaatgtaggcatggtctgcatgcacaaggcgccagcccgcacgcctcctccgttgcttcatgcaaatggggcgcgtcctttggctctgcgatccacctgaaccgctccactttttcatgtactcatcgttaaactccagcaggtttcatataaactcatgcatagttctagtatatggcatggcactccggtcgaaatccaggactgatggtctgatgtgctgcacgcatgttaggtaggcttcacacatcagtcgtgcttgcttgttcgtggagctagcttggtagcctttccatttctggtgttcttgctcctagctatagcagatcacgagagctttcaagctcgttgttcatgctagaggccagaggctctccctagctccatctgaaaaaggctgcagcaggaaatgact

SEQ ID NO: 535 - DNA, 2340 bp, Zea mays
aaatctataccctcccatggaagggtggttgtaacaacccaggtgtttatcgtctgctcgaccacgagtgcggactttaacacgtgatagcggtgaatgtaaaggtcactaaattttaatcatcttcgtttatcacgatttttatattgtgcctgtctccatctgtctaaattgtcctaatttatttttgcaaaatttagacttgagtaatcttccgaaaaattgaatccaatatcgtttgggttgagccatcgacatcttgcccaaactctaattcttgaaatcggatttggttcctaaactttgtttcaaattctttcacacttgcgttgcacttgtctctctgtggcctggcatcgtggcgcgtggctggtgctaaccggtgtctggacagcgcacaacctttcgcccacgtgaacgatgcgtgatgtcgctttcgaaaggattataatttcgatgccgcagaaatctcgcatatttatttcgtgaaatgtcgagtctagtgcgagtttaaaaattatggattaagagaacatgaatttggagccccgacccactagtgattgtcgtcctaaacaaatattattagaactcgacgataacaatattgatgcaaaaattaaatcggaccgagataactagaaccgaactgagtattcataattaatttgtttttatgttcagaccatggataaaattatctgctctaaattaaatcaggcgcagtctatactagtttatcttgtatcttttgtttcgtctggtttacatctcgtgcatactcaatctgataactaaattatctgtgctctcttgtaaagaaaaagtgggaaaataaaaaaaagaatatttttctcaagtatttccaccgcataggtcatccattcctatccagtgcatgcgcgcgttcagcttcttggaaagaaattttccatatcttcaacgtcgcatgttccagctcctcacaattctaaaccgtcgtttatcagatggatatttactaactgccaactcatgtttatgtcctggagatttttttttgcaccgctgctcccaaccagatttttctccctccgattcttatccttccgccgctcactgccttcactttatcccagccaccgcctccttcagattccttaatgccgtaagccttctctgctcctctacgtatatgacaggcactaatccctggtacgtctccctgccatgtcgtgcccttcaccttccgtcgtcgcagtagcacacccgtggagcagcggtgctcagcatcggctcccaggtgcctagccgcctgacttcttcctccatgccgcagttggaacttcgtcggctgccgctgccagcactcgtccagccacggtgcgcatctccatggcggccgagctccccttccatggctgccgcgccctatgctcctcccgtccggccgaggcccctcccacgatcgtctccctcaagccaccgtgtgcccagcccccagctcggatctctcccagtcccagctcgccagctcgccagcaccccctctctgctcgctcggctacatggtggctggagctcgccatggactgtcacctgtcgcgttcttcgtccaagcctacaggtgcgatcgcgaccgatcgagctcctcgatctgcagctccagcactgaccgccaacttcgcacgtggatccctgcaagcttcgtccctatgccgtcctacagttcgacgtacgacgctacttgagtgctgccagacgcagcttcttcactgtgccccaccgtcgagagccactgcggctccccccgtgatggtgctcgtcgtcgattcatcggcatcgtcctgttcatcgcgtgggcactctggctgcgggctgttccttcgcggcggactcagcctcgccttgcagctgcgaacgccatcgtctccatctcttttgctgtccgtgccatcaaccgtcgtcgagcttcttaccgcgctcggctgttcgtcgtcgtcacccggtcgtgtgacgagttgatagtcccggcactcgtccttatccgtgtcacgtgccccacaccctatgttcctcgccgtcgcgtgtcgttcgccatcgagctctacagcaccctcccaacgcgctcggaccttgcagcagcccccttgctcctcgttgtcaattcacgttgtgtccacgacgtgatcatcgactccgatgacctgttttccaattgcgtgctgcctacgtcgattttccgaagctctctgccgtgctcgaccttgcaagtctccaactcattgtcgttccgtgcgtcatcaagaaatcccgagagctgggtggtgaaatccgcgtggtactcaccacgtgcccgat

SEQ ID NO: 536 - DNA, 2338 bp, Zea mays
cctctcttgaatttttgttttctctccaatctttatcctcttcataggatatttcctgacgtcgtgctcatcttctctccatccgttcagccggcgcaagattttcctgtgtctcagtcgtttctcgtcctctccccagccaccgtacctgactgcgtgatatttttgccgccgcccctgttcgttttatatgtgcgcagctcgccggcggaagcccccagccgagttccagccgtcggtctcatcccgtcgcggaatatttcctgctctctctcctcagccgctcggtttcttcccgtggacgcgcgctccctcccagccgatttccctgcggctcgctctcttccccaaccgcgccgggtcccctgcaagcttcagccttcctgtgcgcgtcctcccatggggctcagacttcttcccagacattgccgcttctctctgctcctccctgcaccagctcggattttcctcccatggagttcgcccgcgcctgctactcaccggtgctccagctcgccggccgtgcagctcggccctgccctctctgctccagcctgctcagtcggacccctggccgttgtcaacgaacctcgtggtcgcggctctccgctgctagcacctgcccacattcggtctcctgctcgtcgccatagcgcgtctctgtccttgcgcactccacagtttagccatggtgctcctcccagctcgcccagccgtcgagctcctttgcgcgcgcgtactccctccctgctccatcttctcgtgctcgtgcgttctcgccgcgccgagcgccgtgaagtctgcgcgcgctgcggctcgattctttcatcccgcgcgcgtcccctgcgtttctctgctcggcctctgttactcctctgcccgcagccgcgtcccactgcttggctacggctcatccgtcgtgctcgggtcaccctggtgttccagctcgtagtcgccttgtttgcagtcgacctcgctagatcgccccttgctcgacgccggtgatggccgtcgtggagcaccgctgtgaactcccagcacctttgctctgctccaggaaatatcaagccttgaacagccatcgttttgttgcgacgtgtgtgtgcgctattcgctccacgtcgtcgtctttgtgtttgggcagctccgtcgcggcatctgcaaaccttgccccttgtcgtcatgttctccctgtctgccaaatcgtcgcgcctatgctgagttccccggccatcgcctcggtctggccgttggccaggacctctcaatactcggctcccaggcgtgtctccctgctccatagtgcccttcatctttcaccattgcaacagcaacccccttgcttcttgtcgccaatacccgtcgcgtccgcgacatgcttgtggcccccgacggtttatctttcaattgcctgctactggcgttgggatccgaagctctttgtcgtgttcgaccctgcaagtctccaatttattgttgttccgtgcgtcatcaagaaatcccaagaatcggatgaagatgaagatagcagtgcgatattcaccaagcgctcgacaaattgcctagatcggaaaatcattactgatcccgcggattcgagtcagctgttgaaaaggtaagctgataaattattcagaataattcgatcattgaatgaattaatgtgctagtgcaatgctcattaaggtgctcgataaattgtgtaagtcacgaaactctcgtcgaattcacaattcttgcgattatcgagctagattcagctatgatgagtaatttcgctattccagtcacttagctgaattagtgtaccgagtaaaatattagtagacctatgtgttgatgaaatattttaatcacttataaagatgtagtataatttataaagcaagggatacgtttagaatttaattaattaactgataagttgtgataaggctaattgtatttcatgtgtatagtttgttgtttcgtgttgatgcgttaggttcgtttaatttagagaagcgtaattattgcgcgtagtcgtatatcaataactagtatttccgtatgaacttgtacaacgcctcgccgctaggtgtttaaattcgctatcgtgtagcactagttagatttgtgttattccagttttttatgcattcatgtgcataatgcatttcattcaggtatgctaattaatcgggtaatgaggaagacaatccaagtcgaccccaagcgcggggtactccgcatggcgatgctgatggacgaacctgcctgatcaagtgccaggacaaaggatggtcgtcaagtggacgtcacctaacaacactaacctagtgtttattccaggcaagcc

SEQ ID NO: 537 - DNA, 2333 bp, Zea mays
tagagcttctgtgtactagtgtctggaatgcgcgcataggcggtggccttatccccatcgtgcactcagcgtaatctccacactgctctttctctctctagcttcttctcagccgcgtcggtctggtctgctccacacgctttccatggatatcatgctttggcttcgtctcatccgtgcctcttcgttctaggcacgtctctctctgctccaccggtcgccactttgacatgcttcctcggtcgaagtcctctgtgtcggcaccctctgttcctccaccgtgtgtacgccagccagcaccgtgcgtgcgccctcctcaagcttgcttccttctgctctcctccctctgcttctcccacgcatgcttctctctccagcgcccaacctctcctgcgcacggctggagctccacgctcgccctctccagttctcgagctcgccggcgctcctccccagattctcctctgcgcgccccctgattcttcccgagccgcgcgcagcttcttccctgccgcgcccctgctttcccaagtcgtgcctcatctccaacggcgcctggccaagcttccctcatctccctcaagctcgtcgtggagctttgtttccccatgccgcgccccagatcctgcttcctcccttctcctaactcgaccgctcctcctctctcccagcgcgtcttcttctctgctgctcgccggtgctctagctcggctactcaccggcgggatcctggtaccacgaactcgctggacactgctccttggacgggctccactacgtcgctgccactgggtggcgcggtcggagccaactgatccatgcgctggggagccgtcctccgccgctcgccgtgcccctctgctcgccacggcgcgccgacttccccagtagcgccctgccaagtttctccctcgctgtagcccctggtcaccgcacttctgcaccctctcgttccccagttcttcaccctcctgtaagcacgccacttttgaacctctccgtgcgtctcgcatagagcgcagtcctccgccggtgaagccctgatcccgtggtgctggcgacactcgtcctcggcacgcttgtggttggtgcgactagagaaatccgtgacttgctgcttttcctctgcatccagtatccgcggagtgcatccatggatttgtctacagtagggatgtctggtcgtccacctccgcgtgcgttaggtgtctttccgcgctctaactgctcggcctcaagctcagcacatccaagttccacaacacactccatcatgctcagacaatgaagtttggttgtgtcggttgctagttgctcgatgaaatgcccaacaagaaatggaaggattaatcgaccccgtgttcaaccccggcgaatcgccccatgatggtgctcgtcatcaattcatcggtcgtcctgttcgtggcgtgggcgctctggctgtgggcagttcctttgcggcggactcaggctcgccttgcaaccgcgaacatcatcgtctccggctcttttgctattgtgtgccatcaaccgccgacgttcttgtgatttcggatcggtttgatcttggtaagttgaattaattttcatattagttagactgatgaacatagtgagtagatatcgtaattgtagcatcgtcaaactaattttagttggcgtgctcctctgaaaataatagttaaaaaggattagcttgtttctatccacgctcttagttttagaggtcctcttttagtgaacctaattgtgttagccttttatgtatcgtgctttagctatggaaaatatagaacatgttataatttatatattccttgatatgtgagtccggttcaatccctctcgatgaaacacacacgctaggtattcggggagttgtctgaactagggatcattactgttttcgtgacttctgagtcaaattagtactagtgaatcgattcgctaatcctcctagctagtttgataattggatatgcggttaaaattaaatctgattaagttagaataccataactatagttttaatgtgatatcgacatctaatattttcgtactagatttgagatatcttgctataggtgtttaatattcttcgagtagctttatctatattataatatttatacttacacttatacatgtgcatcatgcattttaattaggtacgttagttgagcgcgtgatacagaaggcgacccaagttgaccagacgataacacagagataggacatctccgcaagacaacgtcgtcagtcggaccaacctgaagatggacatacgaagcaagtataggaacaaaggctgatcgtcaagtgatcgacgtcta

SEQ ID NO: 538 - DNA, 2332 bp, Zea mays
ttaaaatctataccctcccgtggaagggtggttgtaacacccaaggtgtttatcgtctgctcgaccacgagtgtggactttaacacgtgatagcggtgaataacagtctctctgtcttaatctgtttttgtttgtcgggagttcgacatcgtttttatttttatctatccgggctcgtcctaaattttcatgatgttcggaacataattgttccaaaatcggcgagcctggtgattatttaaaattcatcgctcgcgccgaatttagaaacttagtttagtccttcgactttgtccgaaacgagatttattagaagtcgacgactaaagttttcagtgccaaataatttagtcccctctcgtcaagcgagacatcgtgtctaaggaattataatcatggtcagtttccaacaaattatccttgacagagaaataaaataggttcaaatggcagataaatatttgtccgatttcagctgcatcaaatatcatctgaagtagtgaagccggtattatttttaatctggctgtttacatgttgcttgagaaaaacaatacgccagctcattaattgaatcgttctgtagtcaaatgaccgaaagcacgtgagactcataaaaaattgactagattaaatatactctaaaatatcgaagccgaaatcagtttggttcagtctgtgtgtttcttgtctcgatctaaatcttcaaatagaaataatgggtacgaattaatctgacttcggagtagtcatcaaatcaaatcgtgtccaaatatttgttctcatacatataacagtaaaaaaaagagaaaatatctcttatcctcatctcccaccgttgataagcattgatatttttttcttcatacgtggataccatatctttgttcctatccggtggttgattattctgcaacgcacaagtgtgccagccgtatcttctttgcctctcggttcttcttggacactctctctctcacctcgtcattctctctcgcgggacgttgctccctgctagtgcctggacgctcgcctcactcagctctcgttctcctcgtccccatgctccatccatggcgtgtgcttgccagacaccgatgtgagcttcctatgttcttctggccctgctctagttcgccacggtcacgcgctgttttccccagctcggatttcaccagccactgttctctggtccgtgtgccggtcggcgtcgtggagttttgtttggtcggctcgtcgttgacctcgccggtgtcgtcgaaccccttcctcaattgcgtcgggtctccatgccggttgtcgtcgttcgtcgtcgcgtcgtgtgtgcaataacatcgctgattcctccatggtgtatgtcgacggacttcgcttcatcggctcctcgcttttggttcggctcacgtatgcaggtcgaacgcattcgccgcttgaccctttgtcactagagctcatggcctcgccaacgacggagtcctcactggattcgtgtcctcgctagagctcgcaataacctgctcgaccacacctcaccagctcgctccagactcgacctcgttgttgttcggtgcgtcatcaagaaatccaaagagttgagtgaagacgaagctagcatcttgaaattcaccaagtactcgacgaaaagcctgaactataaatcatcgtggttcttgaagagttcgcgtcgaatttaatcatgggtgagctgattcgctactactattattttgttttaattaatggattgatagatatgtaggttccgacgatcctttttatttagcatagctgcgcttagtgattatgtttagatccgttgttgtgtcggtgtgctgttccgtggtgatataattatttttataattataaagtagtcgggtcaggggttaaggtctagaattttgataaaaaagttatgcgacggatttgtggcttgtgttcaatttgtggcttggttaaggtctagatgttatgctctaatttgtggcttgtgttcaattattgttgattggatgtttgaattaattacaattatctcgaagattataattattgtagagtcatagttatctagtgtgcgttcataggagtagtgatgcatcgtcactaagtgtttagtttgttttcgtgaagcattatttaatcctgctattccttcttatgttcatacgtgcacattatgcatttcatttaggtacgttaattaatcacgtgatgtgaaggaccaaagcagagtcgaccacaagatgctattaagcatgggtttcttcgcaaggtgatactgatgaatgaacttgaagattcggtgatcggatcaagcgtcgggatgaga

SEQ ID NO: 539 - DNA, 2332 bp, Zea mays
tgttctgttctcaacgtttaaagaaaattactggatgattgataattatagtacaaatgttataaaattaatgagtgattgagaaagtgttgaacaaatactgcaaaattactgcatatttattgttattttattagtgtgttaatgaaattattactaggtgactgaggaagtgttgaacaaatgctgcaaattaatagaattaccgaacaaatgttgtcaaattactgagtaatttatgtagaattatcgagtgatcactgtaaattaactgagtaactagacaatcattgcatatatgtgttcttttctcaacatgtaaagaaaattactggataattgataattatagttcaaacgttataaattaatgagtgattgagaaattgttgaacaaatactgcaaaattactgcatatttattgttattatcttagtgtgttaataaaattactggataactgaggaagtgttgaacaaatgctgcaaaactaatcagtgattactgtaaattactatgtaactactcaatctgggtgattgaaattactgaataaatggtgcaaaattacttagtggagaatgtaaaattatttagtaactagataatcactacatatctgttgttattttatcaatgggtaaatgaaattagtgtgtgcttaaggaattatcgaacaaatgatgtcaaactactgagtgatttatgtaaacttatcgagtgattactgtaaattaacttagtaacaagacaatcattgcatatatgttgttctgttctcaacgtgtaaagaaatatactagatgattgataattatagtacaaatgttataaaattaatgagtgattgagaaagtgttgaacaaatactgcaaaattactgcatattattgttattttcttagtgtgttaatgaaattactaggtgactcaggaagtgttgaacatatgctgcaaaattaatcagtgattactataaaataaatatgtaactactcaatctcggtgattgaaattactgaataaatggcgcaaaattacagagtggagacaataaaattatttagtaactagataatcactacatatatgttattattttctcaatgggtaaatgaaattactgtgttattaaggaattaccgaaaaaatgttgccaaactactaagtgatttatgaaaaaatatcgagtgattactgtaaattaactgagtaactagacaatcattgcatatatgttgttctgttctcaacgtaaattactggatgattgataattatagtacaaacgcaataaaattaatgagtgactaagaaagtgttgaacaaatactgcaaaattaatgcatatttatttttattttcttagtgcgttaatgaaattactaggtaaccgaggaagtgttgaacaaatgatgcaaaattaatgagtgattactgtaaaattattatataactactcaatctgggtgattgaaattactgaacaaatggtgcaaaaattcatagcggagattgtaaaattatttagtaactagataatcactacatatctgttgttatttatcaatgggtaaatgaaattactatgtgattaaggaattaccgaacaaatgctgtcaaattactgagtaatgtatgtaaaattatcgagtgattactgtaaattaactgagtaactagacaatcattgcatatatgtgttcttttctcaacgtgtaaagaaaattactggatgattgatacttatagtacaaattataaaattaatgagtgattgagaaagtgttgaacaaatactgcaaaattactgcatatttattgttacattcttagtgtgttaatgaaattactgaatgactaagaaagtgttgaacaaatgctgcacaaataatcagtgattactgtaaaattactatgtattcactcaatctgggtgattgaaattactgaataaatggtgcaaaattactgagtggagactgtaaaattatttagtaactagataatcactacatatctttgttattttcttaatgggtaaaagaaattactgtgtgcttaaggaaatatcgaacaaatgatgtcaaactactgagtgatttatgtaaacttatcggttgattactgtaaattaacttagtaacaaggcaatcattgcatatatgttgttctgttctcaacgtgtaaagaaaattattggatgattgataatttagtacaaatgttataaaattaatgagtgattgagaaagtgttgaacaaatactgcaaaattactgcatatttattgttattttcttagtgtgttaatgaaattactgggtgact

SEQ ID NO: 540 - DNA, 2223 bp, Zea mays
catatatgattacatcatatggatagtctactcatttatttggtaaacaatatgagtattgtcatgtttttttggcactcatgtagtttccctgatttcctcattataacaatgattctccgtaaagaacagcactttcagttgatgacttacatatgtactgccttcttctcttacgcttgaatacaaaaaagttatatccaaatcagaaaccagattattttcattgtaaatgtcttcctgaaagtgacaatttggtatataaatgttcatgataattataggcttatggtattcgacaactcttttggccgttccaattctagaatgttgttttcgttaggagtaataacaattcatttagagatagcataaacatgaccatggagatcagttcccaaatatcttaagtatcatttttttacaacattcaatttatgatcatggagataggtttatactgataattatacacttatgatcttcgacacctcttttggccattttagttctagaacgttgtttcattaggagtaagaacatttcattcagagatagcacaaacatgaacatggagatgagttcccaaagatctcaagtatcattttataacaactttcaatttatgatcatggagataggtttataattatcttaaagatgacttccatcgctcttttggccattttagttctataatgttattttcattaggagtaagaacatttcattcagagatagcataaacaggaacatggagatgagttcccaaagatctcaaatatcatttttaaacaacattcaatttatgatcatggagaaaggtttatagttatcttaaattgacttccatcgtttctcttgctatcaatatttgttctctgttggcatcataagaattttttgtatggtttcgagatggcagtccaccatgggtcctctatacatctgacatatagtttattttcattcgagctgttgctactactcgatatgggtgctgctacataaagtcacttatacatttctaaaaattgttttaatagcaacaatttctgcggggctacaattatttggctaccaacttatagaggtatggtttctctcttctgtacttcaactacaaagtagtatttagtttcatgaaaaaaacatttataactatactacaaagtagtatttagtttcatgaaaaaaacatttataactatgtactctttttccgtagtttagacatactgccactgtattttctattgttcaacatatttttactgtagcccatcaaacattgtatctttccctgcaacaaatttacttttcacttatttctcagagaatttaatatttttttctctccgacagtactcttgcatggtttgctgatatcaaagatccttacctttttacatttaccgtcgaacgtcgtcaccttgttaaagttagcctagagtctagattttggtagtctcttcctcatatatgcgactgtcacgagtagcaatgctagtcgtggccatgggctcgaggagcccatcgtcgtcgaaaaatttgctattttagcttttttaacgtgggctaaatgctattatgtgaccctctgtctatgactcgtgggaccatctgtgtttatgatttgtaggtctgggtctaaaatagagaagttcacaactgggagtgacaaaatagcaaatttccctcgtcgtcatggtcctactcggcggcacaacatcgacgttggtaaccatatctacattgccgtcgaacagggccatggcatccagagccttattgtgtgcctcaatctcatgctctgcatacgcggcagctagataaagacccatatgaaatttgtgactggcccctccacgtcgtcttcggctcctcaacgacatttcctttcctttccttattattaaagccggttcaaaccggcaacgacgacgctatccacgtcattagaaattcattccccgcttgattaggaatcggcgacgctggcacactccacgtcggcaattctatacaatagagcggggagggaatcttgcattccagaccatccacgtcgtctctattattaacagcgtaagatcgttatccaacggacacactcgaatcgagcttccagcatcttcttgcatcgcaagacttctagacttctctccccagtccccatgtctctgccgccgccactatcccattgcatgtggtggcgcggcc

SEQ ID NO: 541 - DNA, 2330 bp, Zea mays
tgctaaattttaatcattttcgactatcgcaaatttaatatcgcatcagtttcatctgtcgcgagttcgacatcatttttatttatctgggctctttcaaaattttcgtgatgttcggaacattgttgttccgaaaatcggtgcgtacgatgattatttaaaattcatcgctcgcacgaatacgtattcggaagcctgacccactcggacgattttatccccaaacacatttaagtagaactcgacgactaaattgatcggtgcaaaataattaggatcgcacgttatttgagagaaatcttgcgcgaggttgataatcatgagtatttagtagtaaatcgttcaaaacagataaagataattagagccgattcaaataattgctaatcggtttgacttcaacgaaatcagtcgtaaattgaaataccgaagctgaaacccgtttaattcggtccgttgcttctcgcctcgatataaattttcaaaagtgaattaacagtacgaattcattcgagttcagagaattcgccaaatcaaatcgtgtccaaatactgttatggatctcgtttgattcgaccaattttatatcgctaaaaatcttgattctaaaatatctgtgatttttggtaaaagaaattaaaaaaaatatcctcacgccgccctcagccctgatctttttagacaccgcgcgcgcgttcctgatttttccaccgccgttctctctcactttggatatttcctggccgcgcttatcttctccgttctccccgtcgtggtgctccagtcctccctgcccgtcgtttctggcgccgcaagctcgccgcgccccgggtcgcctgctccagctcgccctgctcggagcccccttcttttctctctctctcccagcgctctcctctccagccgagcttctccctgcgcttctctctgcattgcgcccagccgcgccttgcaactgctcgccgtggagcttcgtttccccgccgcgccctgctctagctcctgcgcgcgcccgcctccctgctcccagcgctgcgcccagcctccatcgccggcgctccttcccccttccacgcgcgcagacttttttttccctgcttggagtttcctcgccgcgccctggaccttgttccagctcgccggcgcgaagctcccctgtggctgtgcgctcctccaagccggagtcctctgctcgttcccatggacaagcacccatctcctctgctcctccagctcgtccagacagtggaggtccttcccatggcgctcctctctgccaacgcccaagctccctgctcgccagcgctcttcctcgcatccatggccgctgtgtcctcccctgcaggcagccaagctccatctcccagcgcgccctctccctggtaggctgaatcacagtttctggatcggaggagcatccccgcctaggtctctactgacatggtttgcgggtcgctcggcaagcttgcatcgcgccccctctgctcgcctctggctcggatggcgcccccaggtcccaggttgctcggtatcaagcctccctacgcgcagcttctcctgtccagcctcttcccaagacgccatctccagccgtcgtgtggagcactggagcgccaactgagtctctccctgtccccagctcggaccgtgcgtcctcgcctagcgtcgcgcgctctccttgtgtccatggtggcttccccctgcttgcagccgcgccctgctcactggagctccagtcgtcgcgctctcctgctccctgttccccttgtgtcccctagatccttctctgcgcgcgtgccgccgtccgccgtcgagtccctccgcgtgcgcagatgctccgtcggaagatccagccttcgggccccgccctttgccgcgccctttggcttggctatggccaccgtcgcgcccaggatttatgcatcctctctgttcggcctcggcaaaaactctggacgctcggaccccacctcggccaagtcttcctgttcctgccatcgtaggttgtcatcgttcgtcttcgcgccccttatcatgctcgtggttaatcctgccattcctgctgtgcccgcttccgtggtgttcgattgaatgtcggaccaagattccacgatgtcgctcatcctcgctgtgaaaccctcacgctcgcctcgcctctaatcttggtgtcgtcattggccactttcgtgtcaagccatcgtcgtgttgtcgtctttcacccagcagctcgtcacgggatcgagtgtcgagctcctttcccaacaaacgccggacctacccctactcctgcattcgctatcagccttagctcgtcggtcacgctcaccaga

SEQ ID NO: 542 - DNA, 2330 bp, Zea mays
gttgataagcgtggctgcctcgtggatgagaagggcagcgcgagcatcaggaactataggattggtgtcgaggtcgagctggtctgcgtcgaggtcggactagtgagacccaacgtcgtcgtcgagatcagccacgacatgggcttgagcggtgcgtgccagggcgtcaccgatgcgcgcaacagcagcatcacgcccctgggtagtgtcagcgacatcgcgctcagcgtcgcgagcgtgagtaagggcagttgtgtgggcgagttgcgccgcgtggagacgttcgatttcctccgtgctggtgatggtggtagtaggggtggtcggtgcgtctattggggcaccgttggaggcgctgaggggtggggcagttggaacttggttgccaaccatggagcagcgcgtaggtgcagcaactacagacgtgcaacgcacaggtgcagcagactgtagattttagtggaaggtggaagaaacggaattgtcctgaacccgtggtaccatgtgagagagatatgatctgtaggctattgtgtattgaatgaatagagtgccagtcggttacaatatatataggaagaggagatcatgtgtggcttatagaaatagcgccagattgatctcctctatcaatcagtatcaggccttcctagtgtgggttgatacagattgatcccctgcaccaatcacgatctctcctaccatagctagcctggtttctatccataatagcatagattgctatccttgcctagtacacggcagatttcaccaagtcagccaccatctttgcatagaaatatctgccaacagttatactgggacccacaatctgaaagctaagagatttcaccaagtcagccaccattttcgccacctgtgttgcatacagaaatagaagtgtgtttcgatcatctatgtatggcccatgggaaataaacatatgcaattgaaagttctgcagaagaaaggctatttgctcaacagttcaacctagcagtttcagagagtttagagaaagtggcaccttaaaggctaacaattccacatctccgtacaaatgctaaggtaaatgaattgagctccaaagattcactttcatttgtgaaggtgttgcagcctctgaacataggtctcgcaacctctagacaaggatcttcaccatagctgcactacacttacctagccaacagtagctaaaaacctaaaacaagaaaagagatgagcgtctcactctagcaaaaatttgaatcacataatgcccactaaaattaagctggtcaaatcttagcaccgaagagtacaacatgaacacgcctctaaaatgaggccattagatcatctacaactacgaccacacattcacagtctagatcaaccaaactcaatacgctcgcgcacatgttcccaaacacagtggaaagggtgggattctcaagaggtcttcacctccagggagtggaggtaccgatcgatgtccctaatgtacgacgcatgtgggctttcagcgtcacgtggccttgtgtccatcggtcagcgtgcgacgtccctggcttcacgttgtttcctcggctccttgcccaagacattagatttcaattaagtctatcgtcaaacaacttcactgcgtagtttcagtagaaatatatttaattaaagtacatatgaaatacaaaactatttcagctagacgaaaatgttatctttattttaataatgcgaaaactcacaccctaactctagaaaatgagcaaagcttcacattatcacaaggaaccatcagaggccggtgcaaattcatcatcaaagatgtgtgcttcatttattatcgaaataagcttgataaaaaggtttataaaatatataaggttcattcacaaacctaaggacctccaacatcctccagattagaatatgaaatagacataatcaagactgcaaaatagattacaaatacaaacacaaaattaatagcccaaattcagctcctgtttcagtagcaatgagctaaaagttgacaaatgatactccatttagtcttgatcttcccaaggtttgcatagatagaattttcttattcatgatgcagtagctacagtaagggtactttcgctgagctgctcaccgcgacgacgtcatagacgtatgagtatcaggtgcagtggtgctctaggaagcacatgtactcctccttcctttttgactccccatcacctgcaacacagacacaaacaacaatttcctccttcaattctttagtttattcaagcaacaaatttttataattttgtctacaaaatcttggcactgaaattcttattgctcacaac

SEQ ID NO: 543 - DNA, 2329 bp, Zea mays
gcttggggtcgacttggcttttcttccacatcacgcgattaattatcgtacctcatgagatgcacgatgcacatgtatgagcacgagtataacgagtataagatagatactctatactaaaaaggatgaaactcttaaaatcaagcattaagcaccatggatattacagcagggcatcgattacatctattaaccaaattgacataataacactagaacatctatttttattcctagctttttattaactctttaaactgtgtaccttatatattaataaaacttttcatttttaacacctatagtcccgcaaccactaagacctattgagatctttttcatcttacgacatcgaccaaattactaaaacgactcaggaaaacaataaatattaaacctagtcaaaccatccaccaatccactaacacgagtaacaaatttacttaccctaaataattcgacgcgatagtcgcaaacacgactacgggttttggttgacgttatccagaggccttcatttctttgataatcaattgctgaagatcttttcctcgactaaataattatgacgaaccgaacttgagtcgtgcaggatgtctgagctttttgtcgcgcacttggtgaacaccacgctgggggtcttcgtcttcacccgacgcttaggatttcttggagatgcacgaatgacaacgagatcatgtttggagcgagctggtggggtggggtcgagcaggggatgacaggttcgatgacttgatggcaaacgcgagcacgcacgaaacccgatagaggagagtgagtgccgcagtgacaatgagcagacacgcgggcgtttacgtgagccagcggcaagcacgagtgctgaggtacaaccaacaacactcggcgagcacgcagcgaggcacacaaccgcgacgacagtcgaattggcaacaacgtgttggcgaacctgacgaacacgaccacggtcacatgctgatgcggtcaagataattgtggctaacgagcttgcgacagaagcgatgatggtgcgggagctcgacacactgtggcaagcagataaaattcgtgcgcgcggcaaacaaagaaaatggagagcagaggggctgggcaactccatgggcgagcagagcgcgccaccatggcgagcagagaagcacgacgcgcgacatggaagcttcgagcagcggacggcagcacgcatggggaatttggtgcggccgtggaagctcgaagccggcacggggaagaagccaagctgggagggaggctgcgcaccgaggaagctgccgcaggggaaatcgccatggatgcgcaggggcagagaagacgctggcgagcagcaaggcgacgacatcgctggagattcgacgagcaggagccaggcgcagaggtgagttccacagagaagaagctgagggggggtcatgaccagggagatgggcaggggttgagctcggccggacggctgccatggcaacggcaaagggattccggtgagcagagaagtacacaggggcggcggctgggcgcagggcgagccatggagatgggcgccgagctggaggagcaaggggtgcacggcgatgggtgtacagcgcgccagggagaggcgaacgcgaccaccatggggaacgagccggactgggcgcgctggaaaatcaccaaacagaggacggctggagaagataaaggcaggggatggagagaagacgagctcacgttgggataaccggataaggtcattagctgtacacggtggggaatatcaaagaaggcagtggtagccagcagataagaacggccagggatgaggccgacggccaacacagtgaaagaaaatctgagaacgtgagcggtggagaagatagagtagaagacggctgggagatatttttatttttttctcttttctctttttttataaagaaaatcgctgatattttgagtcacgatttgtagcgataatgaaagggtcgatagtatttgtgacacggtttgattcgattcgaagcacgagatatttgatctgcggtcagaatacatgattccatggtcatggtaatttacccgagaatcgaagctcaattataattcttggacacacagtcatggttttgatttagcaaatacttggaatcagatgaatttgcacccgtcatttatatccaaagttttggatcgggcaagaaacgacagaccgaaataaactgatttcggcactgataatttgttcggcgtgattcgaccgaaattagccgaaacaacatctgcgaacttatacgcgattttgtcttcgaaacagcgtgcagaagaataaattggatta

SEQ ID NO: 544 - DNA, 2326 bp, Zea mays
tcatatattttattttagttctactgagtctaaaatctttggattctaaagtctcccgccacaactctagtttcctatttcctcttgcatgagtgttgttgtcagagatcagatccctaggcccctaaggcccacaaatcagagggatgacagatgaagagtccatcctagaaggacccacccctcaaataaccccaaggcatcgagcccaagggtcagatgaggcagagctagaaggggggcggtcgggcaaactgagaggaagacactcgagtggttacacacctagcctagggactacccctatcataaatgactgaccaaattaaatactcaaggcatcgagtcacgacagagggtcgtccctccttccagttatgacctacgaacctagaccaagagccccactcatgacctatgaagccgaagacctatgactcactcttggctttaccgagcctagtcctaagtctctcgatgatctacaaaacccacaacatggcgaaggacatcgaagcataggctacgaaggacaggggacgatgtggcataggaagagtaatgacgatgcctgggtccaccaccgtccatgcatgtcatcctagccgacttaaagagctcaaccagagagctcaggggatgatggtgaataccgacaagctcaaaggacaagggtgaatactgatcgataggtttctaccaatggtagaacacttcattctaccatgacgcagtaacttgttccataagaagccacttgtaaccgacccctccttagtctataaaaggggagggtcagcccaacgaaagggaggataggtgatagagcatcaatactcagtcgacttagctaggtagcgaacacctgatacgtagtcccttagaaccaacaacacatagagacttgggaactcttccctctctcgcccgcttgtaacctctactatgagcatcgagcaacaaggtgccggtagcgcaagcccctgatgactagaagtagggatgttctgctcgaaccagtataaatcttgcaccactgagcacaccatctagaactagaacacacatacaaaaatttactcgtcaatgctagttcaaaacaccgatagttggcgtgccaggtaggggcctaacatgttctcaacgtctccttcaccaagctttgtatggctggccacgatgccatttgggcccccgagacgaccattcattttgggagcctcgactttgtcgttaacagtgagggagttatgaccagggccttggtagcccagtccccctcagcaaaagatctggctgacatcactaaggccttcgatgatctggctgacatcactaaggccttcgatggagttaacagtgagggagttatcaccagggcctcggtagcccagtcccctcagcaaatggtggtgcttgttgggatgcgcctatgttgattttgtggggatgatcgaccccgttaaggactcattccatgacctcctcttattgaactcagaatacagactcagctccccatccaacggggcgagtcatgacccggctcaggagtgcttcatggttagcactctaggggctcgctccccacccatggcatgtctcgagaaaaccctcgcctacataacgatgcatgcagcgacatctgcaccgccacgactcgattgaacatacaaaaggttgccctaagagccgagtccttcccgagacaactaatatttctggatcgatgggcgaggatgtcacatagtggctggcctaattacgatgaggtggtggacgtgcatgcatcgtggtacctaacgtctgccgccacataattggggatggaagtgaactgtcacgatttcccaggcatgccagaatgtcgcggttgccgcaacactcctcaaaactcccaaaatgccgaggcaccggacgcacgcaggacccaacatgagattcaacatctcttcgacctggccacacagcagcagaccgagagctccatatcatggtggagggagcctaagctcgaccagcatatcgcgtccacactacgaggggggggcaacgccttgttagactagcttctcgattatgatgaggaaggcgtgacacgggtccaccccaccgcacccgaggttaggcaggaatgcgaagagcatccctaacccatgaccgtggggaagggcccaaaagaccgggcattgtgtccttgttacaactgacactgtggaggaaattttgaccccctaatgaggaccgaagcctaagcccatctccgtcgggccctcacactttcggccgccacatcccccaaccactgctgtagctatatagggca

SEQ ID NO: 545 - DNA, 2325 bp, Zea mays
acagaggacagtcaaaaagcgactgttgtcctttagatgctaaagagactacagaggacagtcaagctgtcctctagatgctaaaggactacagaggacagtcaaaagcaggctgtcctctagatgctcaagacttattccatcaaagtcatgaccagaggtaccattttgaattcgtcacaggattgccgtgaattcctcatgcttgccaacaacatcaaatactcgaaagaccatattcaaaattatataaatgaacagttggatacagatctttccatgtgcaacctaatttatatatgaacttgttttctatctgatttcttacaataattgattttgactttgttctagagtaagtaaaggctaagtgttttcatacctttcgaccggcaaaacgttgtgtcagttcactgatgtgcctttttactgctggaagctccaattgctcccttgaaagttgaaactatcagagtatatcccagtaggaaactgaagatttcagccaagtgaatgaaaagaatcattcactaattttggaaatacattttgtataacttgtaaataatcaacatgacaaagaaatgtgcataatgcattagttttgtgttttaccgctgcaaccctggttagtctttaagtacgtgtacaacatatggctcataaaagcatcagttttgtgttttaccgctgcaaccctggttagtcttccttgatcttccacacactcatgggtaccctcaagtccaagtattctttcaagaggcagctgggaataaaacaaaagatgccaaatagaacatctctgaacaataattaaataatataatataaatgctattgaatagtggtcaactgggtacaccataaaagatggcaacaaaatcacgatgaaaaagaaataacattatagtggatcggcaatattgacttatcaaagaaatataggatgagccgatgcagaaataggaaatattgttttgttcagttaatcaagcaagatgctgtcggtaacttatcaaaatgcacagcatcatctaccacctaaaactcaataataacttatgttcctaattaaagacataaatcatttgttacaaagagttcacattccttgctgcttcagcatcaacctcttgaaagaagcctgcttagttgttggatcaaccaccaccaaccaccagatctatatgcatggacactttgctcacttggtaaggaggagttcattcattgttatataggatccaaaggacctcccaggtatgttcttgcaaaaactaaaggttctcaatcgaaacaaacacatagcccctagaatcaaagtaagatgatattgttaagactcttcatgtgttagagaaatgcaggcatgtttgttgcacgaaaccagcagctgattgtgggcctataagagaataaaatgtcaaggagcattataaaaaaattcacatgaaaaaactaaaaaggaacagtgtgaaacatatttttgacaacctaaaatagagcatagatagacaaaaaactcaaaataacttgaaatcaatcgttggttgatgccctgccaccacatgtctttccgctgttctgaaactaagctagtgagctctgtatcaggaaaggaggcattccatagagccctaagcgattattaaatccaaagcacacagtataataaaattcacatgtcaacaacggatgaggaatcaaggaggaggcatgactccctgtgtggtcgtccagctccatgacgatgcgccttcaccggtgactcatgtggaccagaagaggttcagactacagaaagcaatgaaaagcgaaggccaatcgtacctggagcattctatcgagcacctgagggcttcccttgaggcggagctccgttcgcttctagcgcgacggcggcagcgtacgcggggtcgaggcaagcgggcggcgacgtaaatgttagggtttagcaccagatctgtatgtagtcataaggctcatgggttggccaatcgtacctagagcattctaacatcacatatattgtaaatctaaaaaccagccacgccaagaactggtggcgccggccaccagccagccctccctctccggcaaaaatcatggcgagcagcggcccaatcctaccttcttcactgatcggcagttgaaaagggagagggagcagtgtgcacaggaagattaccgcacgatggctggagaccagggggcacgcgaccgaggcgccgctggagcctggaggagccgcgtccaagaggactgctgaggaggatgaacctttatatctaagggagggggagatttggatgggacggcgcc

SEQ ID NO: 546 - DNA, 2325 bp, Zea mays
cttagtattcttctgcatggagtgcgatgaacttcttgtggactacaagcagtggtgtttgtgttacctactggttaaatatacttcaggtgccattagtttgattatgatggacgatcaattaatgaacgtatttatgttatttttgtcatgacatggaaggatactaaaactaaccgtggaacattgtcctttggaaaatgctagaacattgaatctgccggacctttccttccaacacttaaccctcctcgtgttcccgatcatgtattgctaaaatggcacactagccacccgattccttccatgcatggctgctgcaagggctactcttgagctcaatagcatacaagggaagagctactcttgagatcaaactgaaattagtttaggctgggaaagcagtaactttagggttgcttggcaagaaatgtgaccttttggtgaacccgaagcccatgatcgtcccatcatggactgaggccggcgtacgatatatggtggcaaaaaatctaggcaaattcataaccattggtaacttcaggtgaggctgcttcaattctatgaactcgatcgtatatatactacaaattaaaatccctgagaatgcatgattctcactcacgtcagtcttctctcttctgcacagcatgctcgaagatgggggcacttctcttagttttggcaaaatatgttttgcatgaagtcttaaggagaaacactatatcaaaagctcgtaaaaatatctctgcacactatgacctggtcagtggatttagttatttattttttgtctgaaaaaaaaaatattattgacatctctggttggaattttctgttactattctacttatgtgatggaatcaatatcataaatatctctaaatttgttctgtccgtccacatgctacaattaaatcagttgtacacgtttctagtgtaaatgaacaaagtactgtcttattttgaaacataactagtatttgtaatgatttctttgctctttttctggatccgacgatgacttactcttgtggtattttcaagctaaggtatggaattaattattgtggcgtagtatgttatgtagctagctcttcactcatgaacgtacatgtacatccctaaacatataccacgtgattggttactaggccgcccacgtctaggccgctcgcgcgcgcgttgactacgctccagtgtattgattgtatagtatatcctcacggagacaatataattattttttacatcacctagctgcatccacagagaagtgagcggagcgcgtttctacagatccagggtgtcgtttggttcacatatttgtaacacaatgggtaactgataacgttaaatcatgtttgttttagtccaaccgtaatcagataccacactaaaatttgataccagcctattcaaatttgttaccgccagtaatcgagcgtaaaccattaccattaccatttgcgttacatttcttgaaccaaacagcaccttggttctttagaatcgtcatttccgccgtgtgaatcgccgaggggccgcgctccactgtgagcaggggatttcatgttacgattcgctggccatggcgccgccgcattaggcgggcgccgccgcttctctagcctgcggtattggggtgcattaggtggtgcttatagctgcagtcgccttccttgggattattgctcgctcctccctcgcgctcccaccgctacatctgccgccgccacgagggttatggtcgaattggtgggggaaaattccgccgtaagtgggcgcagggaattggggagcattgagcattggtcagtcgcggtggggaggctcagggttgcggggtagctcgtcggggcttcgacgtgcacgggggctcctcgggggcgaaaattgctcaccgtcgcggtgaaatcaccgcggaccgcacaaccgcgagggcagagccaccgtcgtctcgattcgaggtaagaacacctccatatgcttcgccttactctcctctgcgcgtagcacctttcaggtaggattttggggcactaaattgcggcaatcgtgctcggcggtgatgcgccattgtggccgtcgccgttggtggagctgaaggttgaagacagacgtggggtgtccatcttgtgatctacgtctaggattagagtctgcgtaccgtttcggtgtgatcaatccggtgtgttgattcggaattgggcggtcttggattggtcgagcgatttaaaatctgggacgtcgctctcgaatcccacggtctaggtttgataccggttcaccttgcggatgattgaaaggaaaatgtgcccttgg

SEQ ID NO: 547 - DNA, 2325 bp, Zea mays
ggaagtccgactgaaagcttgcgagaacgtcgatagtctccgaataaagtcttcgattgaacacctgatgagtgacgcatcggaacgtcactttcttcttttcccaaactccctgatatttctcattggtcgaatccgacgcgaacacaagtcggagatgtcccgaaggaactggcatcgaggcgaggtgacggaataacgacaagcacctaggatggatctacaataaggttgtagacgcgacacagagatgaacaacgacgaaccagcaagctgaaccatggcaattgatgtcttgatgcggatgagcaatggcagctagcggaatcggaacaacggggtgaggtgcacggtcagcaagcaaggatgatcgcatgtggcagagaagcgaaagcaatcttcaacaaccggcatggagacccgacgcgatagagcagggggggtcgatggatggacgacaccggtgaggtcaatgacaaaccgaccaaacaaaactccacgacaccgactggcacacggaccagagaatggcggctggcgaaatccgagttggggaaagcgccgaccatggaggagaaatggattccgcgagcgcacggctgcggcttgctgctggggaaaacggcgcgtgcaggaaagctccatggcaacgccatggaggcttagcagagaggggcgctagcgaaggacagggccgcggcagcagggaaacaggcgaccagggacgaggcctgagctccatgtcgacacaccatggggggtgggcggtcggctgtagcttggggcgaggtggagcgcggacgggcggggcctcagctaggagatgggcggtcgggcagaggaagctgggcagggtcgagcttggcggccatagcgagttgggcgaccgcggcactggggctgggcgcgggagggcgcgcgcaggggctccacggcgcagacaccagggcgcgcggcatagcgagctcgaggcgatgtcgagcagggggagccaccatgggcgagatccgagctgtggaggatgccggcgtgctgcaggaaggggaggtcgccgtgagctgagggagagagaggaggggtaactgggcgctcggccaacctggagctagagagagcccacgagaactccatggctgggcgcgacgaaatggccgagacggagaggtctgagctcagccatggatggaggagcagaggcgccgagtggacagggaactccagccagaagatgagccccggctgctccagtaggcttggcatgctaacttgctcactgatggaggagatggcgtggggtggggagctcacctatggacgaactggagataagcacggccggcttcaggaaatatcaagaggaggaggaacatagacgagataaagctgagcgctgtaaaatatccagggagatgagaacggctgggatattttttgttttgttttgtttttcttttatttttttaattattctataatcttttctctgatgtattttagcacaataattattcccggtttgaatctcatggctatgattaatcttgattagaatttatactgcaatattttaaacaattcgtggctttactctcgaattttaaattcaacatacgtcagtccgaattattgtgacacgagccagcgaaaacctaatatgagttttagggttatgatttagatgagagttaaaaaggccggattaaaacgacatttaggctacaaatattattttctcggattttgaaataggaaaccgaattggttagcaattgttctggtttcggtttatttaaacagcctgactcaagtagtgcatttaccgaatttacagagattgctcgaatcgagcgaaatacttaggtgacaatttcagtccgtcttaatcgattaattttaaattggcactaggctcgacatttttagaaataaataaattttaaactgtgcgaaccgaatgcggcatcgcaatcggaatccccccgaagaagatgtcagcatcgtcacgggagcgagatgtagacggattaaactagacgagatcagattcatattttaatcgacatttgatttagttgaacctaaatgaatttcgccgttatccaataaatttgaatagcaccggactcgacattttggaaggtcaataaagtctaaacttcacaaaatattttggacagtctagagagttggagacagatgctatatagaaatcatgataggctaggatgtctaggatttagatatagagattattattctcatcgatagttcgtgcttaagtccatagtcactgcttaacaggaggtaaacacctggggtgttaca

SEQ ID NO: 548 - DNA, 2324 bp, Zea mays
ttttaatatcgcatctgttttgtctatcgcgagtttgacatcatttttatctatccgggttcttcctaaattttcgtgatgtttggaacatagttgttccgaaaatcggtgcatccggtgattatttaaaactcatcactcgcgcgaatacgaattggaagctcgacccacttggatgattttatcctgaacaaattaatttgaactcgacaactaaaatgttcagggcaaaataatctgaataatgcattgtctgagaaaaatcatgcgcgagattgctaaccaaggaattataattgagatttgattctccaataaatcatctatggcagagtgatcaggtgttcgagtggcagatgaagttatatgatttcaagtcgtatcaaatatagtttaaaatatcagtctcgatctcgtttgggttcattctatttgcatcctatccgaacccgatattatccgagataaagagattaatgtttgatttaatagcagataatactaggtccgaaagaatactccggatcgcttgcattaccaagaaaccgtgcataagattaacaattgggattattcattagtgtgctattctaggtagagaaatcaaatcgatttgggaaacagataaatttttatctgagttcaactaaattaatagagtctcaactaaatcaaatcgatccggatagtgttttggtccttgtgtttctcggccagatccaaaacttcggatataaatatcgggtgaaaattcatctaattccgagagtattcaccaaatcaaataccatctaaatattgttgtcggtctcatttttgtttgatccttttgtatatttttagactctaatttcataccctaaaatatatgtattttgttgttttaaaaaaagaaggaaattagggaaaatccttctctaaatatttccaccgttccttggtatgattttcaacgtatttggatttttcacaatagaaaatatcactctatcgttgttttcttctcatgtacgtaaacttcctagaatatcattggccgtcatcgatattttctttgctagtaatcgtattcgatgcattttttccttgtcttcatcgccgcttaagtgggtaaccggtagaatatcttcttctacgtgcgcatcctctcccagccttatcttcttctgcagatttttttcctcagcattatctctcctctccacacggcagcaggcgctcgttctcacatcttcctcctacagccgcgccctggtcctggacatcccagcgccgtcccatctcctccctcccagtcgactctctgctcttccatggctgcttgctccactgcgcagtcgctcagctcatcgacctcccctcgactttctcgatccgccggtgctagccaagtcgatctcccatggcagccggtcagccctgctctccattgcaagccgcgctcctccatcgcgtcgttcctccgctcgcccacctcgtccatggttgtcataccgagttcgccctccgcgcagctggcgtttctccctaacgcgctcgcacagccatctcccatggcgcgcgcttcccctgtgcgtccgtctccctgctccaccttcctgtcgtgcctctctccgtcgaagctacctgctgctcgccatggtgtcttccagtctcaggcttgccctgctccctgttgccgcgagctctagctcagattcaacccagctcggatcttttccatggtcgctgcgcactggccctgctcggattctcgtcgtgcacgcttgggcgctgcccagtggacgcctgctccaatcgccgtgcctagccgagtttacccctacgcgcaactgtgggttttgctgcacagcgttcctgctccccggcctccgtcgtgctcggcagcaagtaattcatgtcgaagcagcagatacgatcccttgtgtcgtgctcgccagatcgagtctcacgtggtcaatctgcgcagttcctgttcggctatcggttctgcctatgtcgatctcctaatttctatggatcgtgtatcgatgtcccattacaacagcccatcgtaaaactctagtgcttgtcgttgatatctggtcgtctccaacctttgtcttgccgtcgtcgttcggtcaccctgtctcgatgtcggtccctacgtgatgcctctgagtatgttggagtcgtgctgacaaaagaagccccaagagaagatgtccaaaggttggatggtggggtgcgtgaagttcggatagtatctgccaagcgctcgacaaattgcctaaatcggagaatcattaccgatctcgcggattcgagtcagctattggaacggt

SEQ ID NO: 549 - DNA, 2323 bp, Zea mays
actagtaattgatcggaatcatctcgatgagatctatacatctacggcctccaatcatccataagatacaccatatttggattataaacaaggtttaatttttagggcgttacatttgggcatgttatctcataagatatgtggaaatatttcaaatgtttcatggttataaagattaatgtatgtttgaagcggttcaaagccctaactgatgtaatgtttagaacggtagtttttacaaaaaggacccaacaaggtttgtcataaaagttttcacaatacactgatttgggagtaaagggtcatgatttcgtgcatgttttctcgaaaagattgtggcatgaaccatgcaaaaactttgaagcttttcaaagccctaaattatgtggtagatttacagaatgatccaacatgtttcatcaatctactataggcgtgagctatccaacatgttgttttacatgcgtcatcatcaacccaagtgcaagacaacctatagcttgagtttggggcccatgatattagatgttcgaatgctggcactagagtttgtagatatgaagaatgaggtaactatagaaatgtttaaagtgcaacatgtatattttttagatcagtaattttctagagttgacaactatatttatgtaattctacttttaatctattacaactatatcaatgatatttataacaaaagaattaaatatagaaaaaaatttattccaattttaattacaatttgctatatgccagaccataaacaatactagtttaggcatgctatcttaatccatatgtagtgttattttaaatgattcttggttatagacaataatgcatgttttgaggccactcaaaaaacaagtatgggagatatttatcacaaaacaacttaaccaaggaaaattacattacaatttgctcattgccaaactataaacatcacttgtttggacttgttatctcataaaatatgtaaagatatttcaaatgttccatggttatgaatattaatgtaagtttgaagcggttcaaagccctaaatgatgtaatgtttagaacggtaatttttacaaaaggactagttgtcatgaaagttttcgcaatacactgatttgggagtaacgggtcatgattccgtgcatgttttctcgataaagattatggcatgaaccatgcaaaaactttgaagcttttcgaagcactaaattatgtggtagatttatagaatgatccaacatgttgtttcacacgctccaccatcaactaaaatttaacacaatcaataacttgtgtatgggacccacataattagatggtcgcatgacgattaaagttcaatgttttaaagaatgaggtaactttaaaagtatttgaatttcaatatgcagatttttcaagataaactattttgcagagttacgacctctattaacagaaaaatagttaatggaagaaagattatattttcactttcattactcttttctaaatgtcgtactgtaagacatacttgtttaggcatgttaccttaaaacatatatagtgttatttgcaatgttcctcagttgtgaacacatcaaactaagtttaaggccgatcaaaacatgagtatgggactaatgggtattaatttcgtggaagtttactacatgatatatcgatttctgatgtgcgtcaacttcgatgcattttgatgccctaaatattgaattgtttagacagatagtttttacggatggacccaacttgttgtttcacatgcaccatcattaacccatgttcaagacaaccataacatgagtatgcgaccctagattgtcgcatgctagcagtagatttagtcatatgaatgataaggtgactctagaagtgtttgaagcataacatgtagatcttttttagatcatcaatttactataggcgtgagctatccaacatgttgttttacatgcttcattatcaacctaagtgcaagacaacctatggcatgagtttggggcccaagatattagatgtttgaatgctggcactagagtttgtagatatgaagaatgaggtaactttagaaatgtttatagtgcaacatgtatattttttacatcgataatttttcggagttaacagctatatttatgcaattctgcttttatttcgatccatgttttaagattctttgttattattctattacagttatatcagtgatatttataacaaaagaattaactatagaaaaattttcattccatttaattacaatttgctctatgctagactataaacaacaatagtttaggcatgctatcttaaaccatat

SEQ ID NO: 550 - DNA, 2320 bp, Zea mays
aacatgggttaatgttggtgcatgcgaaacaacaagttgggtccatccgtaaaaattgtctgtctaaacaatacaatatttcgggcttcaaaatgaatcgaagttgacgcacatcagaaatcgatatatcatgcaacaaacttgtacgaatataatacccattagtcccatacatatgatttgatcggtcttaaacttgggttgctgtgttcacaactgaggaccattgcaaatagcactatttatgtttttaaggtaacatgccgaaacaagtatgtcttagagtacgacatttagaaaagagtaatgaaagtggaaatataaattttcttccattaactatttttccactaatagaggtcataactttgcaaaatagattatcttgaaaaatctgcatattgcaattcaaatacttttaaatttacctcattctttaaaacactaaactttaatcggcatgcgaccatctaattatgtgggtcccatactcaagttttgattgtgttgaattttagttgctggtggagcgtgtgaaacaacatgttgaatcattctataaatctaccacataatttagggcttcaaaaagcttcaaagttatcgcatggttcatgccacaatcttttagagaaaacatacacgaaatcatgaccctttactcacaaatcagtgtattgcgaaaactttgaggacaaacctttttgggtcgttttgtaaaaactaccattctaaacattacattatttagggccttgaaccgcttcaaacttacattaatgtccataaccatgaaacatttgaaatctttccacatatcttatgagataacatgcccaaacaagtgatgtttacagtttggcaaagagcaaattgtaatataattttccttagttaaattgttttgtaataaatatcatgagtcccatacttgttttttgagtggccgcaaaacatgcattgttgtccataaccaagaaatatataaaatagcactacatatggtttaagatagcatgcctaaactagtattgtttatagtctcgcatagagaaaattgtaactaaaattggaatgaaattttttctatatttaattcttttgttgtaaatatcattgatataactgcaatagaataataacaaagaatcttaaaacatggatcgaaataaaagcagaattgcttaaatatagctctcaaatctgataaattagcgatctaaaaaatataattgttgcactttaaacatttctaaagttgcctcattcttcatatctacaaactctagtgccagcattcgaacatccaatatcttaggccccaaactcatgctataggttgtcttgcacttggcatgatgatgaagcatgtgaaacaacatgtttgatagctcatgcctatagtaaattgaggatacgaaaaaatatacatgttatatttcaagcgcttatagagtcacctcatccttcatatgaccaaatctagtgctagcatgcgacaatctaggatcgcatactcatattatggttgtcttgaacatgggttaatgatggtgcatgcgaaacaagttgggtctatccgtaaaaactgtcaatctaaacaatacaacatttagggcttcaaaatgcatcgaagttgacacacatcagaaatcgatatatcatgcagcaaacttgtatgaaattaatacccattagtcacatactcatgttttgatcggccttaaacttgggttgatgtgttcacaactgaggaacattgcacatagcactatatatgtgttaatgtaacatgcctaaagaagtatgtcttacagtatgacatttagaaaagagtaatgaaagtgaaaatataaattttattccattaactattttccattaatataggtcgtaactctgcaaaatagtttatcttgaaaaatctgcatattgcaattcaaatacttttaaagttatctcattatttaaaacactgaacattaatcggcatgcgaccatctaactatgtgggtcccacaatcacgttattgattgttttcaatattagttgatggtggagcttgtgaaacagcatgttggatcattctataaatctaccacataattttttcgcatagttcatgccacaatctttttgataaaacatgcacaaaattatgaccctttactcccaaatcagtgtattgcgaaaactttgatgacaaacctttttgggtcctttttgtaaaaattaccattctaaacattacatcatttagggcaatgaaccgcttcaaactgacattaatgtccacaaccatgacacaatttaaatctt

SEQ ID NO: 551 - DNA, 2320 bp, Zea mays
ccaatgatatttttaacagaagaattaaatatagaaaaattttcattccaattgtaagtacaatttgctttatgctagactagtttaggcatgttatgttaaaatatatgtagtgctattttaaatgattcttggttatggacaatattgcatgttttgaggccactcaaaaaacaagtatgggactcatgatatttatcataaaacaatttaaccaaggaaaattatattacaatttgcacattgccaaactgtaaacatcacttgtttgggcatgttatctaatcaaatatgtggaaagagttcaaatgtttcatggttataaacattaatgtaagtttgaagcagttcaaagccctaaatgatgtaatgtttagaatggtagtttttacaaaaagcacccaacaaggtttgtcatcaaagtttttgcaatacactgatttgggagtaaagggtcatgatttcatgcatgttttctcgaaaagcttgtggcatgaatcatgcgaaagctttgaagcttttcgaagccctaaattatgtggtagatttacagaatgatccaacatattgtttcacactctccactatcaactaatattgaaaacaaccaataacgtgtttgtgggacccacatagttagatggttgcatgccgattaaagttcagtgttttaaataatgagataactttaaaagtatttgaattgcaatatgaagatttttcaagataaactattttccagagttacgacctctattaatggaaaatagttaatgaaagaaaaattatatttgcactttcattactcttttctaattgtcgtactgtaagacatacttctttagacatgttaccttaaaacatatatagtgcaatgtgcaatgttcctcagttgtgaacacaacaacccaagtttaaggccgatcaaaacatgagtatgggactaatgggtattaatttcgtacaagtttgctgcatgatatatcgatttctgatatgtgtcaacttcgatgcattttgaagccctaaatattgtattgtttagacagacagtttttacggatagacccaacttgtttcgcatgcaccatcattaacccatgttcaagacaaccataatatgagtatgcgaccctagattgtcgcatgctagcactaggtttggtcatatgaaggatgaggtgactctataagcgcttgaaatataacatgcatattttttttcgtatcctcaatttactatatgcatgagctatccaacatgttgtttcacatgcttcatcatcatcctaagtgcaagacaacctatagcatgactttggggcctaagatattggatgttcgaatgctggcactagagtttgtagatatgaagaatgagataactttagaaatgtttaaagtgcaacatgtatattttttagattggtaacttctcggagttgagagctatatttatgcaattctgcttttatttcgatccatgttttaagattctttgttattattctattacagttatatcaatgatatttacaacaaaagaattaaatatagaaaaattttattccaattttaagtacaattttctcgatgcgagactataaacaatactagtttaggcatgctatcttaaaccatatgtagttctattttaaatgattcttggttatggacaacaatgcatgttttgaggccactcaaaaaacaagtatgggactcataatatttatcacaaaacaatttaacctaggaaaaattacattacaatttgctcattgccaaactgtaaacatcacttgtttaagcatgtaatctcataagatatgtgggaaattttcaaatgtttcatggttatggacattaatgtaagtttgaagctgttcaaatccctaaatgaggtaatgtttagaacggtagtttttacaaaaaggacccaacaaggtttgtcatcaaagttttcacagtacactgatttgggagtaaagggtcatgatttcgtgcatgttttctcgaaaagattgtggcatgaaccctgctaaaactttgaagctttttgaagccctaaattatatggtagatttacagaacgatccaacatgttgtttcacacgctccaccatcaactaaaattcaacaaaatgaataacttgagtatgggacccacataattagatggtcgcatgccgattaaagttcagtgttttaaagagtgagataacattaaaagtatttgaattgctatatgcagatttttcaagttaaactattttgcagagttacgacctctattaatggaaaaatagttaatggaagaaaa

SEQ ID NO: 552 - DNA, 2318 bp, Zea mays
ctcattccaattttaattacaatttgctctatgctagactataaacaataatattttaggcatgctatcttaaactatatgtagtgttattttttatgattcttggttatggacaataatgcatgtgttgaggccactcaaaaaacaattatgtgactcatgatatttttcacaaaacaatttaaccaaggaaaattacattacaatttgcttattgccaaaatgtaaacatcacttgtttggtcatgttatctcataaggtatgtggaaaacttttaaatgttacatggttatggacattaatgtaagtttgaagcggttcaaaaccctaaatgatgtaatgtttagaactgttgtttttacaaaaggacccaacaaggtttgttatgaatgttttcgcaatacactgatttgtgagtaaagcgtcatgatttttggcatgttttctcgaaaagattgtggcatgaaccatgcgaaaactttgaagcttttcaaagccctaaattatggggtagatatacagaatgatccaacatgttgtttcacatgctccaccatcaactaaaattcaacacaatcaataacttgtgtacaggacccacaaattagatggtcgcatgctgattaaagttcagtgttttaaagaatgaggtaactttaaaggtatttgaattgcaatatgcagatttttcaagataaactattttgtagagttacgacctctattaatggaaaattagttaatagaagaaaatttatatttccactttaatttgtcttctctaaaagacacacttgtttaggcatgttaccttaaaacatatattgtgctatttgcaatgtttctcagttgtgaacacatcaacccaagtttaaggccgatcaaaacatgagtatgggactaatgggtattatattcgtacaagtttactgcatgatatatcgatttctgatgtgcgttaacttcgatgcattttgaagccctaaatattgtattgtttagatagacatttttttacggatggacccaacgtgttatttcgcatgcaccatcattgacccatcttcaagacaaccatatcatgagtatgcaaccctagattgtcacatgctagcactaatttggtcatatgaaggatgaggtgactcaaaaagcgcttgaagcacaacatgtagatttttttcagatcatcaatttactataggcatgagctatgcaacatgttgtttcacatgcttcatcatcaacccaactgcaacacaacttatagcatgagtttgggcccaagatattggatgatggaatgctggcactatagtttgtagatatgaagaatgaggtaactttagaaatgtttaaagtgcaacatatatattttttagatcggtaattttccggagttgagagctatatttatgcaattctgcttttatttcaatccatattttaagatcccatgttattattctattacagttatatcaatgatatttataacaaaagaattaaatatagaaaaaaatgtattccaattttaattacaatttgctctatgctagactataaataataatagtttaggcatgctatcttaaaccatatgtagcaatatttttaatgattcttggttatggacaacaatacatgttttgaggccactcaaaaaacaagtatgggactcatgatatttatcacaaaacaatttaaccaaggaaaattacattacaattttctcattgccaaaccataaacatcacttgtttgggcatgttatctcataacatatgtgaaattttttcaaaagtttcatggttatggacattaatgtaagttggaagtggttcaaagccctaaatgatgtaatgtttataacggtagttgttacaaaaatgacccaacaaattttgtcatcaaagttttcgcaatacactgatttgtcagtaaagggtcattatttcgtgcatgttttctcgaaaagattgtggcatgaaccatgcgaaaactttgaagcttttcaaagccctaaattatgtggtagatttacaaaatggtccaacatgttgtttcacatgctcaaccatcaactaaaattcaacacaatcaataaattgagtatgggacccacataattagatggtcgcatgccgattaaagttcagtgttttgatgaatgaggtaactttaaaagtatttgaattgcaatatgcagatttttcaaggtaaactattttgtagagttacaacctctattaattcaaaaataattaatgaaagaaaatttatatttccactttcattactcttttctaaatgttgt

SEQ ID NO: 553 - DNA, 2315 bp, Zea mays
tgtggaaagatatcaaatgtttcatggttatgaacattaatgtaagtttgaagcggttcaaagccctaaatgacgtaatgtttagaacggtagtttttacaaaaatgacccaacaagatttgtcatccatgtttttgcaatacactgatttgggagtaaagtgtcatgatttcgtgcatgttttttcgaaaagattgtggcatgaaccatttgaaaactctgaagcttttcgaagccctaaattatttggtagatttacagaatgatccaacatgttgtttgacatgctccaccaacaactaaaattcaacacaatcaataacttgagtataggacccacataattagcgggtcgcataccgattaaagttcagtgttttaaagaattaaaagtatttgaattgcaatatgcaaatttttcaagataaactattttgcagagttacaacctctattaatggaaaaatagttaatgaaagaaaatttatatttccactttcattactcttttctaaatgtcgtcttgtaagacatacatgtttaggcatgttaccttaaaaacatatatagtgctatttgcagttcctcagttgtgaacacatcaacccaagtttaaggcagatcaaaacatgagtaatggactaatgggtattatattagcacaagtttgctacatgatatatcgatttttgatgtgcgtcaacttcaaagcattttgaagccctaaatgttgtattgtttagacagacagtttttatagatggcccaacatgttgtttcgcatggaccatcgttaactcatgttcgagacaaccataacatgagcatgcgaccctagattgtcgcattctagcagtagatttggtcatataaaggatgaggtgactctaagagcgcttgaagaacaacatgtagatttttttcagatcatcaatttactataggcgtgagctatgcaacatgttgtttcacttgcttcatcatcaacctaagtgcaagacaacctatagcttgagtttggggcccatgatattgtatgtttgaatgctgccactatagtttgtagatatgaagaatgaggtaactttagaaatgtttaaagtgcaacatgtatattttttagatcggtaattttccggagttgagagctatatttatgcaattatgcttttatttcgatccatgttttaagattctttgatattattctattaaagttatatcaatgatatctataacaaaagaattaaatatagaaaaattctcattccaattttaattacaatttgctctatgctagactataaacaataatattttaggcatgctatcttaaactatatgtactgctattttagatgattcttggttatggacaacaatgcatgtgttgaggccactaaaaaaaattatgtgactcatgatatttttcacaaaacaatttaaccaaggaaaattacattacaatttgcttattgccaaaatgtaaacatcacttgtttgggcatgttatctcataaggtatgtggaaaacttttaaatgtttcatggttatggacattaatgtaagtttgaagcggttcaaagccctaaatgatgtaatgtttagaactgttgtttttacaaaaggacccaacatggtttgttatgaatgttttcgcaatacactgatttgtgagtaaagcgtcgtgattttttgcatgttttcaagaaaagattgtggcatgaaccatgcgaaaactttgaagcttttcaaagccctaaattatggggtcgatttacaaaatgatccaacatgtttcacacactccaccatcaactaaaattcaacacaatcaataacttgagtatgggacccacaaattagatggtcgcatgctgattaaagttcagtgttttaaagaatgaggtaactttagaagtatttgaatttcaatatgcatatttttcaagataaactattttgcagagttacgacctctattaatggaaaattagttaatagaagaaaatttatatttccactttcatttgtcttttctaaaagacatacttgtttaggcatgttaccttaaaacatatattgtgctatttgcaatgtttcttagttgtgaacacatcaacccatgtttaaggccgatcaaaacatgagtacgggactaatggatattatattcgtacaagtttactgcatgatatatcgatttctaatgtgcgccaacttcaatgctttttgaagccctaaatgttgtattgtttagacagacattttttatggatggacccaatgctgtctcttatacacatctgacgct

SEQ ID NO: 554 - DNA, 2314 bp, Zea mays
aatcgaatcaaattaagcacaatcttgatatatcgactctgatgtcgtttggtttggtccatcgatatcttgtctaaaacactatctcatgtatcacctgcatttctatccatttggactattctaaatattttatggagtttgaaatttaagaaactatcgagacgtcgagttctgtactgtgagaatcacccaagtggtgaaaataaatgtagagagtgtctaaactttataatccgatcgcgcacgttattagagaaaattcatgtgcgaggtttacatttgggattgttcttctagtatgctattcacgtcagagaatcatgagtttggatggcgggtgatatttatttgaattcaaccagatctaatacaatctacaatatcgaagctgatctcgtttggttcggtctatgtttctcgccagttctaaatctttggatataaataactggtaaaagttcgtctaactctcataatatttaccataacaagtcctgtctaaatattattatctaaatattattgtcgattagcttgactcttttatatatctgttgagcatctccaagagcttctcaaaagtctcaattaaatcaaaattttgggaaaaacacaaaaacgtgtctccaacagttcccctaaaatgctcccaactttttcatagcccttaaaactctctcatttgtagctacaaatgaggggggttttaggctccccagaaacaatctgtcgctttaagggatctgttggagaaaaggttaaaatctaccccactaattttttagataccccttaaaactaatttttaggagtcattttctagagagctcttggagatgctcttagacccctcaaatcttagtcctaaaaacagaatagtataaaggtatcttttgatttctttaagaaaggaaagaaaaatatcttttccttatccctccacgttcatttctccaaagaactccccgcacgtttatttctccagataattcctcgccgcatgtcccagccatatccattgcttgcctagaagctcctcccgtactcagccaccgttgaaggttgatatttttctgcaccgtacatggacaccaggccacgctcagcctttgttcctatctccccagcgtcgctcgctcctgcagctgccagctcgagctcgcctccgatcgacgaagtcccagctcatggtttcttgtatgcgtgctccgccatcccactgtcctcaacgtcggtgaaggtccggtcatcgccgtcgagcgccggcttcctcttgggatgctgagctcgcccagctcttcatcctctgctcggtctagctccttcgctagccgcgtcgacctccctactcgacataccctgctcggttcctgcagctcgacgtcggcaccttggcagaccgtccctgtttctcctcgcttctccctggtggatggtgctcggcctcctggtgtgcgtgttgctcggccagggtgccagcctcctcgccagtgctcacctatcactcctctgctcccttcgtcgtgccctgcgccgtggtcgcagtttccgccgtggcgtcctggcgcaaggtcgcccagcccctagctcagtccctgtgcgcgctctgcgcgcagccgagctcctccctgcgtgtgctgcgcctagccaaggttcccccgcgcttctctgcgcgccgcgcgtcccgtctctctggtgcctcgcccagccatctccagctcctcgccatggacgcgcgcagatccttcaaggtttctcccatggcgcgtccagcgctccctctgtccgttcgccccagctcggagctccctggtgccgcgtccctcagctcgcctgctccagcccagccgcgcgtcttctctgctcattccccgcgcccgctgcttgctcctcccatgtcgcatttttccagctggccggagctctgctctctcccatggcgcccagttcagctcatgcccagctccagctcgatccttttctgcgcgcgcacgctcctgtcgagctcggccctgtccatctcaccgcgctcggtctctagctccctgtgcgcgcctttgttcatggccgtggtggtgttgtggcatggagacgtcgtgcacttcgcgacaactgtcttggccgcaaagcagtccgcgccatagagttcgctcgaccacggtctcgtcgaactgcgaagttcccttgccgtgcgctctaacatcggctatcgcagattctgccataatgttcacgagcgctccttgctctatttatttcgctatgggcaatttctccatgtttcaatttcgtgctgcttgccccgtgtgcg

SEQ ID NO: 555 - DNA, 2313 bp, Zea mays
cagtacttagcccttcaagctaacggaacagaagctgaccatccatacatgttttggatcactccagattccaacatctaaacaaaccacctaatcaaaatgaaatagctcataagaaccctaacaataccaacaggtttttggtaagggccctcaattacatgtccatatcatccagaaataaaccagacactttaagaagcagaagctgactccagctgacataaaaatatatatctttactattatatattacaggagtttcgtcggtttcttcatgcgtcaattcgctcccgcgcgagatcccaggcctccccacgcgtgtttgcgtctacattaaaattcaaggtatgcatcaaaaatattaagtgagagtagggatcgaaccaacaccctctaccacaacaacacttgtataattgcattaaaattaagagagatcgatatcgttaatatatgaactaataattacaaaatttaaaatatgatatatagaaaccaccgtaggcatgtatcgacaatatggataaattctcggactcatctacaactttttcatacggatgtggggtttaaatggtaaaaataagaaaaattatgcacaattgttggctctaaacccatgttcatatccacatagccactagaacacacatttttatgttttatactctgtattcaagtatattacagagattttatagaaaaaacaacgaaataataaaatatggccaagtcatgccgtgctcgagttgaccaaaaccttgttggaccacatgtcactcatcagaccgggtttatgtagacatatatactcgtacatgttgcgtccgcgtagtcggtaacattgattttatttgagtaagatctatcttacatatactgtcgcaaggcatggacacttagccagtgttctttttaacgacatgtctttgttttcgtccgtaatgtcattttatttggaagcgtggggacacgtgacactatttgaataccttgtttaacaaggaggttagaaccgccccgggtacacaactcacttcctcagaggtcggagctggacatgtgagaacctgatgacttgacgaggttccagatcggggtcaagtccacgcccgggtacggactgcgggtcgggactgcgtgagtgaagtttcatggcaggcagcaagagctaggcccagcccagcccagggcccaggcaccttcatcatcagccagagtgcttgacggtacgtgcgacggtgcgaggtcaagtctttgtgaaggtcatataaaaaacctctgcgtctcaacacgcggtccgcatcgcctgcaggctgccacataagtaagctaaagttcacctttcgcgagtgagagcaccggcgatggccaagcccgacaatagcggggactcgtggtcgtgggagtacaggctccgcaagtacctcctgttgctggccatgctggtggccacggtgacgtacggcgcggcattcaacccgccgggcggcgtctggcaggacgccgacccggcactgggccacatcgccggcgaccccatcatccgcgagaccaactaccgccgctacctggcattcttctacagcaacgccaccgcgttcgcctgctcgctcgtggtcatcgtcctcgtcctcgtcctcgtcctcgccgtgctgcacgagaggcactacaccagcctggcgccgctccgcatcctccgcgtcgtcatggtgctggacctgttcagcctcatgggggcctacgccgccggggcgttccgggacaggctcacggccgtctactccctggtcctgctggccggcgtcgtcctctacctcgcggcccagatggcgctggcctggcgggcggacaggaaggacgacagcgcgcccgagcggctccgcaaggtgctcatggtgctcgccacgttcgccgtgagcgtcacgtacgtggccgggctcagcgcgccgggcggcttccgggaccgcgccgagggcgcccaccgcccgggcgacgccgtcctcaggggcggcccccacgacgcgcgcctcaaggcgttcttcgtcttcaacaccaccgccttcgtcgcgtcgctgctcatcatcatcattctcctcgagaagaagctgtcgtacagccagaatgtgcggtcggtcgagctctacgggttcatcgccgtcacgctcatcggcctcgtcggggcatactccgccggcagctgccggcaggttgatactactatatatgttaactctctcattgctgccgtcattgcctgcattctccttcaagcggctgccatgaagttctgcaaaaaggccataatgg

SEQ ID NO: 556 - DNA, 2380 bp, Zea mays
tgtgacacagaagcatcaacaacaaaaaaattagactacatactccacaaactccatacaaatagagatcctaacttaatatacaacagccacaattccacgaactctgtctaattatccttgctacagtttacaaagaagaaagaatacacaactctatatgtttttgaattagaagaatgtttatgttgctacatcttggactattcccgcagttagtatccaaattttgaattagggaaatgcagcatttgtattctcaccgcgtcagacccaggtcggcatatgcgcagcgcacaatggcatcgagagagagagagagaggaggggtcggccccgtccgccagcccgaaatccatcggtcgcaatgacaagaccctccgtgcggtgcccgagcggagcacagcagatgcgccggacctgtcatcatggcggtacgagcgacgtgaccaacagagccgctgacattgtgctgcagcacgcatgcatgcaggagacttggcgcgccggcttacgacctggccacgcacacgacatgcacacacgcactagctaggcggcctccttgcagcatcggcgctaaacaaactcacgtaaataaaaacaaccagcggctgcatgcacacagatgaagcatgcatgcagtcgacagtcgccaccgacgcgcacttcccccgcgggtgatctcaagactcgatggatcgttgttgttcgcttggataagaaccagacaatttagggatagaaagcagagtggcgtatgtgtgccatgcatattgccacctggggcttctattaataaacttcccttgcatgcacaaagatggagcatgcatgcagtcaacgcactcgcaagtcgccagcgacgtgcgcttcccccgcgagagcgatctcaagactcaattgatcgttgttgttcgcttggataagaacggaacaaattagggagaggaagcggagtggcgtacgtgtgccatgcatattgccaccaggggcttctattaatatacttcccatggccttcagcgcgatagatctaaaaagactccctgttgttatagcttattatcattgcgcttaagtttgcttccagacagtcacacctcagtcgtgacccgcagttttatgtgagttttcttacgtacgtacccctctcttaccagtaaatgtgccagcttatatgtatatgtttttttgtgatttctttcattttttcttgtagatggaaaatatgacccaagatgagggtaggttccgctggtatccggatatagacactgtgttctgcaggggctgcatcgacttgcttgacagcggcatcataaagcagaggcaatccaccttggatgatacagctctagaatatttgtcggaaaaactttataaggtgacaacaataacaatttcaaataaaacactcataaatagatggaaccgtatgaaacagttgtatgattaccatgttctgcatcgtatccactcttcaaacatgggggagacgaaaagccgcaagatgcatattaaaaaaacaagggtattctctgtctctctttgattgaatccatattatatatattctaattatacgtttgtttcatttttagaaatgtggcaatgatttcaagcatatgataaatgaaccacctaagaatttggatctacttgagagattgtttcatgaacaagatgaagcgacaccgccacgacatgcgccattccagccaccgccgacgcccccaacacgtgcgccatcaaggacaccatcgccgtccccgccagcgtcgccgtggcatgacatgtctccctccaaggtagacgattatgtcatccacaaacaactaaatgctttgggcaaaaggatggatgccctgaaagaccaaatggatggcattagcaagtcaaaatcttctcagtgtcgtgacagatgagtttttgatatgttgggctatttgcagccgagtagtggaatcaataattattcacttttgtgtgttcagattatccattaataaattttgtcatcgatcaccatgatatataggttcaaggaactttttcagtgttgtttcttatgattcctttatgtgtctagcttgcatgtttttacaatcggccatgataatatagatagaaaaaggggcaaaaaagaaagaaaagagggaagtggaataagaataaaaaaggagaaaataatgagtgttgtgatagttaccgacatcttacaagtgttttctaccttgattaattcatccaccatgcttcttcattcacttctttagaacttgaggaagaatgagcagtgaagaatataacatagtgcatgtttttatgattccttgcatgcagcctcttgatccattgtgcggtgttgtacataatt

SEQ ID NO: 557 - DNA, 2310 bp, Zea mays
ccacgccgcccccttcctcctgatttttttctcaccgcgcatgggctgaggccttatccgtcgctagcttccatccgtccctgctcccagctcccttggcgtctctcccatggccgcaccgctcctctctcgcgttcggctcctcaccagcggatcccctggccttgagttctggcgccggctgcccctccctccctagtccctagagctcgctccatccatggccgcgccggtgctcctccatcatcgcggcgcggccgacttggagctcgccagtgatggcagggctgtccgtcccttctccccggcctccctcatctccctcaggtccggcacgtgctccctatccggccgtgcccctagcactcctcgacgtcggcgtcttctccctttcctcgccataatgtggagccgcgccccctggtggttgagctcgccaagtccatcccaagtccaagctctctccctgctcgctgtcgatttcccaggtctctgtggccatcgcttgctcacttgcgctcgattccagccccctgctccattcctgctccaagtacctccctcccatggcgtccgttctcagcgcccctcctcatctcagccaaatcggatctctctcctctccctggacactgccgtgagctcgtgcctagcctgctcgtcatgactcgcttggaatcctgctcgcaaatccctcctgcgctatggtgctagctggtcatcgtgtgtgctcgttctcgccaagatctggtcctgcgagctccacgcgccttggctgcgctcaccgtgtcctccgcatatattttctcctagccgcgctaaccttgccatcgtcttggtcatcgacgccacgcaatcgtccacgcactgttgtcgtgatgtcctcgctgcagtaccaacgtcctcaacctcgtccaaagctctatgttgggttcatcagcgtgctactcgtccgcactcatcgcatccgcgacgttgtcgcttgtctcctcgccgaccgtgtccgccatcccgtcagcctttgctcgcctctactcactccatggcacgttgatcacccaacagcctgtcctgagatcgggtgtcgagctcctttccccctcgccgacatgtcgcgctgttcccctcctcagtcgtgtcaggcctcgaagcccgttgttgacaattgctttcgctttattgccacatgcgatcatccttgtttgctggccatgcacctcaccccgctgttctgatttcgctagttgtcgttgctcatccgcgtcaagacatcactcgccatggtttagctcgctggttcattgttgttcatctccgtgtcgggtctacaacaatattgtagatccatcctaggtgcttgtggttgttccgtcgcctcgcctcaatgctcaatgctagtccctacgtgacatctccgacttgtgttcgcgtcagcaagcaaacgaatcccaagagtgtggtggaccaacctccagatcgacgcctaccaagtgctcggtgaaagccctgaacaaggatcgttgtcgtttaggtggattgctagtcgaaatggtaatcatactttgattcgctattctagctaattaatttgatagatggattagaggcttatttatcgtgataattattctatttgtagcttaaacgcgtcgtgggtgtatttgatgcatgataaaggtcgtaattgtgtgctgcttggttaccgccgtaattgtgaagtagccgcgaggcgtggtgaagtatatgttgcagtataattcatgtgaagaatgtattggtagacgtatctgataggtgttgtcagtattacgtataatgattttttgtttatttgtatggagttgatgccttcttaagtagatatgatcatgtagctcaactagtggtaacccatcggtcatgatatttgtgactgaaagttaaccttgcatacgttcttgtattcttgtagttgtaaataaagcgaataatgtgatgtcgtattaattattgtgctatacaagttaacctagagaatcaatttagcaagttagttaaacaatttctatgcttattccaaatttgaatgtcgaggggtagcaagtctaagtgtttagttcgcttttgtgaatcattatttagtcctcctattccttcttatgttcatacatgcggattatgcatatcatttaggtacgttaattgatcacgtgatgcgaaggaccaaagctgggttgaccccaagatgtcgttaagcgtgagcttcttcgcaaggtgatactgatgaataaacttgaagattggatgatcggatcaagcgccaggatgtga

SEQ ID NO: 558 - DNA, 2309 bp, Zea mays
  misc_feature (605)..(608): n is a, c, g, or t
  misc_feature (1495)..(1499): n is a, c, g, or t
aaagaatcttaaaacatggatcgaaataaaagcagaattgcataaatatagctctcaactccggaaaattaccgatctaaaaaatatacatgttgcactttaaacatttctaaagttacctcattcttcatatctacaaactatagtggcagcattcgaacatccaatatcttgggccccaaactcatgctataggttgtcttgcacttgggttgatgatgaagcatgtgaaacaacatgttgcatagctcatgcctgtagtaaattgatgatttgaaaaaaaaatctacatgttgtgcttcaagcgcttttagagtcacctcatcctttatatgaccaaatctactgctagcatgcaacaatctagggtcgcatactcatgttatggttgtcttgaacatgggttaatgatggtgcatgcgaaacaacacgttgggtccatctgtaaaaactgtctgtctaaacaatacaacatttagggcttcaaaatgcttcgaagttgacacacatcagaaatcgatatatcatgcagcaaacttgtacgaatataatacccatttgtcccatacacatgtcttgatcggccttaaacttgggttgatgtnnnnacaactgaggaacattgcaaatagcactatatatgtttttaaggtaacatgcttaaacaagtatgtcttatagtacgacatttagaaaagagtaatgaaagtataaatataaattttcttccattaactatttttccattaatagacaccgtaactctacaaaatagtttatcttgaaaaatctgcatattgcaattcaaatacttctaaagttacctcatcctttaaaacactaaaccttaatcggcatgcgaccatctaatcatgtgggtcccatactgaagttattgagtgtgttgaattttagttgttggtggagcgtgtgagacaacatgttggatcattctgtaaatctaccaaataatttagggcttcgaaaagctacaaagttttcgtagggttcatgccacaatcttttcaaaaaaacatgcacgaaatcatgacactttactcccaatcagtgtattgcgaaaacaatgatgacaaatcttgttgggtcatttttgtaaaaactaccgttctaaacattacgtcattaagggctttgaactgctatgaacttacattaatgtccataacaatgaaacatttaaatctttccacatatcttatgagataacatgcctaaacaagtgatgtttacactttggcaataaaaaattgtaatgtaattttccttggttaaattgtattttgataaatatcatgagtcccatatttgttttttgagtggcctcaaaacatgcactattgttcataaccaagaatcattcaaaatagcactacaaatggtttaaaacagcatgcctaaactaatgttatttatagtctggcataaagcaaattgtaattaaaattggaatgaaatttttttctatatttaattnnnnngttataaatatcattgatataattgtaatagaataaaaacaaagtatcttaaaacatggatcgaaataaaagaaaaattgcataaatatagctctcaactctggaaaattaccgatcttaaaaatatacatgttacactttaaacatttctgaagttacctcattcttcatatcaaacaaactctagtgccagcattcgaacatccaatatcttgggccccaaactcatgctataggttgtcttgcacttgggttgatgatgaagcatgtgaaacaacatgttggatagctcacgtctatagtaaagtgatgatctgaataaaatctacatgttatgcttcaagcgcttctagagttacctcatccttcatataaccaaatctagtgcaagcatgctgcaatctagggtcgcatactcatgttatggttgtcttgaacattggttaatgatggtgcatgcgaaacaatacaataagttgggtccatccataaaaactatctatctaaacaatacaacatttagggcttcaaaatacatcgaagttgacgcacaccagaaatcaatatatcatgcagtaaacttatatgaaattaataatcattagtctcatactcatgttttgattggtcttaaacttgggttgatgtgttcacaactgaggaacattgccaataacactatatatgttttcaaggtaacatgcctaaagaagtatgtcttacagtacgacatttagaaaagagtaatgaaagtgcaaatataaattttcttccattaactatttttccattaatagaggtcataactct

SEQ ID NO: 559 - DNA, 2308 bp, Zea mays
atgccagactataaacaatattagtttaggcatgctattttaaaccatatgtagtgttattttaaataattttttgttatgaacaaaaatgcatgttttgaggccactcaataaataagtatgggactcatgatatttatcacaaaacaatttaaccaaggaaaattacattacaatttgctcattgtcaaactgcaaacatcacttgtttaggcatgttatctcataagatatgtggaaagatatcaaatgtttcctggttatgaacattaatgtaagtttgaagcagttcaaagccctatatgacaaaatgtttagaacggtagtttttacaaaaatgacccaacaagatttgtcatcaatgttttcgcaatacactgatttgggagtaaagtgtcatgatttcgtgcatgttttttcgaaaagattgtggcatgaaccatgcgaaaactttgaagcttttcgaagccctaaattatttggtagattcatagaatgatccaacatgtttgacacgctccaccaacaactaaaattcaacacactcaataacttgagtataggacccacataattagagggtcgcataccaattaaagtttagtgttttaaagaattaggtaactttaaaagtatttgaattgcaatatgcagatttttcaagataaactattttgcagagttacagcctctattaatggaaaaatagttaatgaaagaaaatttatatttccactttcattactcttttctaaatgtcgtcctttaagacatacttgtttaggcatgttaccttaaaaaatatatagtgctaattgcaatgttcctcagttgtgaacacatcaacccaagtttaaggaagatcaaaacatgagtaagggactaacgggtattatattcgcacaagtttgctacatgatatatcgatttctgttgtgcgtcaacttcgaagcatttttaagccctaaatgttgtattgtttagacagatagtttttatagatggcccaacgtgttgtttcgcatggaccatcgttaacccatgttcaagacaaccataacatgagtatgtgaccctagattgtcgcattctagttgtagattcggtcatataaaggatgaggtgactctaagagcgcttgaagaacaacatgtagatttttttcagatcatcaatttactataggcgtgagctatgcaacatgttgtttcacatgcttcatcatcaacctaagtgaaagacaacctatagcttgagtttggggcccatgatattgtatgttcgaatgcagccactatagtttgtagatatgaagaatgaggtaactttagaaatgtttaaagtgaaccatgtataatttttagatcggtaattttccgaagttgagagctatatttatgcaattatgcttttatttcgatccatgttttaagattctttgatattattctattccagttatatcaatgatatttataacaaaagaattaaatatagaaaaattctgattccaaatttagttacaatttgctctatgctagactataaacaataatattttaggcatgctattttaaactatatgtagtgctattttaaatgattcttggttatggacaactatgcatgttttgacgccactcaaaaaacaattatgtgactcatgatatttttcacaaaacaatttaaccaaggaaaattacattacaatttgcttattgccaaaatgtaaacatcacttgtttgggcatgttatctcataagatatgtggaaaacttttaaatgtttcatggttatggacatcaatgtaagtttgaagcggttcaaagccctaaatgatgtaatgtttagaactgtagtttctacaaaaggacccaacaagatttgttatgaaagctttcgcaatacactgatttgtgagtaaagcgccatgattttgtgcatgttttctcgaaaagattctggcatgaaccatgcgaaaactttgaagcttttcaaagccctaaattatggggtagatttatagaatgatccaacatgttgtttcacacgctccaccatcaactaaaattcaacacaatcaataacttgagtacgggacccacataattagatggtcgcatgccgattaaacttcagtgttttaaagaatgaggtaacattaaaagtatttgaattgcaatatgcagatttttcaagataaactattttgcagagttacgacctctattaatggaaaattagttaatagaagaaaatttatatttccactttcatttgtcttttctaaaagacatacttgtttag

SEQ ID NO: 560 - DNA, 2306 bp, Zea mays
aaataaaagcacaattgcataaatatagctctcaactccggaaaattacagatctaaaaaatatacatgttgcactttaaacatttctaaagttacctcgttctccatatctaccaactctagtgcctgcattcgaacatctaatatcttgggccccaatctcatgctataagttatcttgcacttaggttgatgatgaaggaggtgaaacaacatgttggatagctcacgcctatagtaaattgatgatctgaaaaatatctatattttatgcttcaagcgcttctagagtcccctcgtcctttatacgattaaatccagtgctagcatgcgacaatctagggtcgcatactcatgttatggttgtcttgaaaatgggttaatgatggtgcacgcaaaacaacaagctgggtccatccataaaaactatctgtctaaacaatacaatattagggctttaaaatgcatggaagttgatgcacattagaaataaatatatcatgtagtaaacttgcacgaaattaatacacattagtcccatactcaagttttgatcggccttaaacttgggttgatgtgttcacaactgaggaacattgcaaataacactatatatgttttaaggtaacatgcctaaataagtatgtcttatagtacgacatttagaaaagagtaatgaaagtgaaaatataaattttcttccattaactatttttccgttaatagaggtcgtaattctgcaaaatagtttatcttgaaaaatctgcatattgcaattcaaatacttttaaagtaacctcattctttaaaacattgaactttaatcgtcatgcgaccatctaattatgtgggtcccatacacaagttattgattgtgttaaattttagttgatggtggagcgtgtgaaacaacatgttggatcattctataaatctaccacataatttagtgcttcgaaaagcttcaaagtttttgcatggttcatgccataatctttatcgagaaaacatgcacggaatcatgacccgttactcccaaatcagtgtattgcgaaaactttcatgacaaatggtccatttgtaaaaattaccgttctaaacattacatcatttagggctttgaaccgcttcaaacttacattaatattcataaccatggaacatttgaaatatctttacatattttatgagataacaagtccaaacaagtgatgtttatagtttggcaatgagcaatttgtaatgtaattttccttggttaagttgttttgtgataaatatctcccatacttgttttttgagtggcctcaaaacatgcattattgtctataaccaagaatcatttaaaataacactacatatggattaagatagcatgcctaaactagtattgtttatggtctggcatatagcaaattgtaattaaaattggaataaatttttttctatatttaattcttttgttataaatatcattgatatagttgtaatagattaaaagtagaattacataaatatagttgtcaactccagaaaattactgatctaaaaaatatacatgttgcactttaaacatttctatagttacctcattcttcatatctacaaactctagtgccagcattcgaacatctaatatcatgggccccaaactcaagctataggttgtcttgcacttgggttgatgatgacgcatgtaaaacaacatgttggatagctcacgcctatagtagattgatgaaacatgttggatcattctgtaaatctaccacataatttagggctttgaaaagcttcaaagtttttgcatggttcatgccacaatcttttcgagaaaacatgcacgaaatcatgaccctttactcccaaatcagtgtattgtgaaaacttttatgacaaaccttgttgggtcctttttgtaaaaactaccgttctaaacattacatcagttagggctttgaaccgcttcaaacatacattaatctttataaccatgaaacatttgaaatatttccacatatcttatgagataacatgcccaaatgtaacgccctaaaaattaaaccttgtttataatccaaatatggtgtatcttatggatgattggaggccgtagatgtatagatctcatcgagatgattccgatcaattactagtttgccttgtttggagtccggatgagtcttttcgagtgccggttgatctgagcaattggatattaggattgtggaagttttcttctatttatacctccctaaccctataagccacgtcctcccacccctagcagccatcacccttttatg

SEQ ID NO: 561 - DNA, 2194 bp, Zea mays
ggttttgcaaaatccagggctccgttgtaattactttataactaggtcagacgactggtttattctaacaaagtctaggggttcttacgcaaaacggcacgaccaaaagggtaccgaccgcaatgagccgtctgatctgggacgatcggcccagattagaaacatgcaccacataattctgcaatctgcccagaccgtcaaatccgatatcgatgacgtcgggcggccacaccccgatctgatctaaaccacccatcatcgagacgacgcccaatctcgcgaagaggtatcctacgatctaatctcgacagctccctaatacttcaacggccccgattatctcttccacccggtgccgaacgatggcgatggccgcgcctacacgacgacgccatcaccggcgtgagttggtttgccccgaatggtgcactaccgagatcctaatccgactcaaaacaaagcaggagatcatatgaacacgctggtcagggtattatcgagtataaggtagaaaaggtgctcacccacgcgctgggatggatccgcggcggcgccaatcttcgatgagcaattggtggacgataagccgtcgatttcgcccgtaggtgtcgcggacgacttcactcaggttctgagcaggctttcgctccgaacccagacactgagcgctggtagagatgaggatccgcggcggcgcaacgctttgctccctacgcaccggcgaattcgtacccccctcgcggctttggcgctggcctttggtgtgcgtgtggagaaaggggaaggcagggcccgacgccacaatttattatcgcccgagggccggcatggggtcaaccagctaggattccgcgcggcgacagacttcttggcagcggccattgcaggagggagaacccagccgacaagtggggcccatatggcagcggcgtcaatcaacacagcgcggggcgacttaatctggtagtggtcactgacgggtggggcaggtgcttgcaatcgtgggcgactgaccggttgaccccacacgtcggtgcctatcagtccacgcgggcggctgagatgggctgcgcagtgtagttcttttgtgggccgaaatcatgggtttttcttgcaactgccattcccttttgtttttctttttatattttttgttttattgcaaaatttaagattcaaactaaatttgaattgtggctttgaattttcagtttgcaaatatataatggaattctaatatgaatatgaacccctactgtttgcatcaattatttatttttttcttcctattatttaattctagaggggatatttaacttcattggaattttattttctctatttcttccttttgaatgttttttgaattcaagtagggtttaagtcttcagattcccattaagatgcacctcatacaagaacaccagcatgctatgcaagatttatttctatttactttacgtgtgatcaccaatgcaagcacattcatataggaattttagagcaagtccaatagactcggtaaatagtctctgctcggtaaaaaaatgaaaatcgccgtgaaaacaaattccaacagactcgccttcgtcctcacttctccatcgtgctcggcatcacctctccgtcgctagccatatttcccgagctgttgtgactcgccatctcccacgagcacgccctcccgctcccgcgcactgatgctctcgctcccgcgcacttgcccttgagttttgagaactcgcctccgtgacctagcaattccgccgcattcttcgctagccctcggtcatccatgtataggccgccgcatccccgtacaacggaggctggggatattgggtcgctgaccggatctgcagagaggcttcttccttcccagtttgtgccaggacgcctggaacaagagccaggtagaggtagaacagaggtcgactggatgccagacggtgtgtccaattctactccattcgacggtgagaaggcctacactgctgagatggtggtgcaattaattaatttttatccttgttgtttattttgcacgaacagaggaattgtttgtgaattggatgatgttgagatccctaaacttctgagatgcctgttgtattgcattgttaattaagatactcttgaattagataatcgcatattcatttctatgccaacatcaaaacaaagactgttggga

SEQ ID NO: 562 - DNA, 2302 bp, Zea mays
gtccatggcttgggtgtgacagtcacggtgattctagacccagaagaatgtagtttacttagaatttatgctgagttgtggttgtatggtggtcaatttatgattgatttttcttttttacgggtgctggaattaggtgtattttaagtggtcaatgggttattgagttggtgggtataaacagtattttatatttggcataaacagtcacatttatcttagctgcaaatggagttatatgcaaccttccatgtcatatctaacattatcataccgactcttctccatgctatgtgcaatatttctgacctttatgatgtatgcatgctttttatgaaaatgctgggtgcaatatttctgaccttttatttgtgcatgcttatgaaaaaggttccgtatatagctaagcagcatgtatgcttgtaatctaagttaagattagacatatagtttgctcattgcaatttagtcacagtttcatagtcaaggtgttctcattacagatagttgttaaaagtcaaatccttgctggtggccgagggctgggaactttcaaaagtgggctgcaaggaggtgtccatattgttaaggctgaggaagctgaaagcattgcacgtaagtgtactatagcaattacttgaattcaatatgtattgctggcatgctgtgatttgatgaaggaaaaaaaaactatagcagttcttcctagattttcttagatttctttcccgtcaactgttgctatttgcaataatgaaacttatttgtcattgcaatttgcattcccttgtttatgattaaagccaaaaaataaaaaaacatagaaggccaattttactttctatgaactggaaggacaagcacatacttaatttctgttctcatacattaattttattttgaattgatgggtgctgaaatttgctaccatgaaactctacttgtacgatgaagtgcgcatgattactttcttgtttaactaggtggatctgtatcaggaatattgctacgtggataaatctctgtgttcacacatttattccagaatttaagattgtttattcattgtgattggttgattggtttcatgcaagtcagtcatgtttcgggtatgtattttaatctctgatgagtcctactgatactgcaggtaaaatgttaggccagattctggtaacgaaacaaactggtccggagggaaagattgtgagcaaggttagaacttactaattgaggccatcttttgcttttattatatgtttctgtttgaaccgtgattggcttcatgtttgctctcagtctgttggtgtgtttacctgttagttcatttactctctgtagaatttgatatgctatttcttcgttcttggtctgtttgtgtttgtacccattactttcctttacgtcgagctgttaagaacattacaaatgttctccgtcgtgcgggttctccatcttccatttaccaagttttgacccttctgtacttgagttagtatgtcaataataggaaattcgtactcttatatgagaacacaaagtatcacatgcatccattttctcttcattctccattcttatgttcatgtgaaacagtaacagcaggattgcaccacattgtcataaaaaagtactccctctaatagtaaatatggtaattttacataaagtaggtaattcattttctcttcattctccgttcccatcaaagtttaagtttaactatgaccagtaatacataaagtaggtagattgacaacatgacttccatgttacgagatttttcatgtaaagtaattttacaatatgtaattcttattattttagcattgtcaaaaaactgaagtaaaatttctaccttttagacggtgtaaatgtccaagaatgcatagttgttgtagggaaagggaattagtgtacatgatatctgattgtttctgtcattcactcattctatgactttctccttaaccttatggttagatttatatttatttactatttttaacatgcaagactatcttaatgcttttcaattgaaatagttctacataattttgcttcttatgattattctgtatgaaagtcattacctcatacttttattgtgcaatatttccttgcatcgaagatttcgagagattgatactctattctcttcggcaggtctacttgtgtgagaaactgtctcttactaatgagatgtattttgccatcacccttgataggaaaactgctggtccggtatgccatttatctcagatattactttactttgctgttcattttataatttctatta

SEQ ID NO: 563 - DNA, 2300 bp, Zea mays
atacacaatttagtattggttgaatttgcataaaaaaatcatgcatgcttacaaggttgtaaacaacagcatctaagcatgttttaactatagcggaaacaactttttttgtcatctttttcaaaaatgtcatgcgtgtgaccaagtgcagggagctcggatcaccttggagctgcaaataccaaactgtagataccttctttcatactgaacattcactgaataaaaggttggcataagattgggatcttattttcccaatttatgagaacaaataattttaggaagctaagtgatcatagtgaaagacaaacctatgttttgctgtcataaatttttgttccctaattcatgtttaacctgcagaaatgataaattcatatattaaagaaaactacaaatatcataggaacacctagtacacaggaacaataaatcacaaacacccaccaacagggatagctaacttatggagctattatgatcagcaggaccacaagtagtttaatgagctaaactgttagctgaaaagcgaataaatgggtactgtgttctaatagcctagaaccaatgggatgtaaacagagtgcacaatctacacagaagattaatgattatattcatggattggaccaaaaataaaaagcaatacttgataggccaccacactcgagttcctctttgcacttaaggaatgcagaacatagttaaaaatcaggtggggaatcacatcaatcaggtggatgtattatcgtgattttagaactctaaaatattcaaagagaagtttccaatcaaactcacttctagagagtcaaaatgtgtctcattttttttggacagagagagcatgaaaaaagtactttgctctaccaacctgtttcatcttcccatggtaattaagcaattattggagaacctttaagcgagttaattagtggaagaacaacatccaagtaatctacacaagcatatgttgcaaaatatctgcaattaatcacgataggaaggctcaaaagttagcgcaatgctacataaaatatgctataatctaagcatactcagatagtaaaacagtggcaggtgttcccctttcatctattgatccatgtagcttgttcttgaacttttgaagcttttagttgtttctaataataaaactatgtatgttatgcgacaacatagaacataaatttactttttgcaaaacaagaatgactgtatcagaaaagtttggtatccaaggctcttgttcaatcaatttggtggaaagcagaaagcacaagacctatcacccgtgtggctcatggaggcacaaacaggatggagtctggaggttgcgcagtgttactgtgcgtgggtttggcagaagcacggcgtagcaaacaggttggggattggacgcgacctacatggactcggatcgaacgcgtgctggtccctgctcacgtccgtaggcgtggctccctgctgtctctgctcccttgttgcccatgcggctctaccgagcacacggcacagcagctagctagctatcgtcgggacgtgacttgtaaagacgcaaaatgatcacgcacaatatgtccttttttttcgaatacaagaaaatttcctattttctgtgtttttcctgcgaaaataaactaatttgacaatttctttgcattccaaaggggccttatatctggaagaaatccagccggtccaccaaaataaagggagcgcatccacaacctagacgtcgttttcttgctgttccggctcgatcgcccatgtcgccgtcgactgggatgtttcaactacatggaaatgcagagttcatttcaacgagaaggcatcgttgcaacatagagaaaacaactatattgaggaaaataccacagcccaaaattgacagttcagcctatcagttttctgtttaatgatgtttttaatgtaaaatagacatttcagacttatgtaatcctgaggtttgcagctcctttatgtagaacatttgatagaagagatgtgtcagttttatgatgttctaactcttgattttcaacatagagaaggtaagggataggctgacagaagaacactcagggctcattcggtacaatgggttccaacctgaacgattctaaggcaaggattcagtgaatccggtcggttcactcaaaccagtgctgtccgcgtcgttgccaagatccgatccggaggatagttagccgggattcgaaccggaccataaaagataggaaaaatcccaaaccaggtcactcccgtttttgattttggtctaaacgaatagctca

SEQ ID NO: 564 - DNA, 2300 bp, Zea mays
caatttgctctatgcgagactataaacaatactagtttaggcatgctatcttaaacaatatgtagtgctattttatatatttcttggttatggacaacagtgcatgttttgaggccactcaaaaaacaagtatgggactcatgatatttattacaaaacaatttaaccaaggaaaattatataacaatttgctctttgccaaactgtaaacatcacttgtttgggcatgttatctcataagatatgtggaaagatttcaaatgtttcatggttatggacattaatgtaagtttgaagcggttcaaagccctaaatgatgtaatgtttagaatggtagtttttacaaaacgacccaacaaggtttctcatcaaagttttcgcaatacactgatttgggagtgaagggtcatgatttcgtgcatgttttctcgaaaaggttatgtcatgaaccatgcgaaaactttgaaactttttgaagccctaaattatgtggtagatttatagaatgatccaacatgttgtttcacatgctccaccagcaactaaaattcaacacaatcaaaacatgagtatgggacccacataattaaatggtcgcatgtcgattaaagttcagtgttttaaagaaagatgtaattttaaaagtatttgaattgcaatatgcaaatttttcaagatcaactattttgcagagttacgacctctattaatggaaaatagttaatggaagaaaaattatatttccacttccattactcttttctaaatgtcgtattataatacatacttgtttaggcatgttaccttaaaacatatataatgctatttgcaatgttccttagttgtgaacacatcaatccaagtttagggcacatcaaaacattagtatgggactaatgggtattaattttgtgcaagtttaatgcatgatatatcgatttctgatgtgcgtcaacttcgaagcattttgatgccctaaatattgtattgtttagaaagacagcttttgcggatggacccaacttgttgttttgcatgcaccataattaatccatgtacaaggcaaccataacatgagtatgcgaccctagattgtcgcatgctagcactagatttggtcatatgaaagatgaggtcactctagaagcgattgaagcataacatgtagattattttcagatcatcaatttattatttgcgtgagctatccaacatgttgtttcacatgcttgatcatcaacccaactgcaagacaacttatagcatgagtttggggcccaagatattagatgttcgaatgctggcactagagtttgtagatatgaagaatgaggtaactttggaaatgtttaaagtgcaacatgtatattttttggatcggtaattttccggagttgagagctatatttatgcaatcatgcttttatttcggtccatgttttaagatactttgttattattctattacagttataccaatgatatttataacaaaagaatgaaatatcgaaaaaatttcatttcaattttaattacaatttgctttatgcgagactataaacaatactagtttaggcatgctatgttaaaccatatgtagtgctattttaaatgattcttggttatggacaacaatgcatattttgagaccactcaaaaaacaagtatgggactcatgacatttatcacaaaacaatttaagcaaggaaaattacattacaatttgctcattgccaaactataaacatcacttgtttgggcatgttatctcataagatatgtggaaagatttcaaatgttttatggctatggacattaatgtaagtttgaagacgttcaaagccctaaatgatgtaatgtttagaacggtagtttttacaaaaatgtcccaacaagatttgtcatcaaagttttcgcaatgcactgatttgggagtaaagggtcatgatttcgtgcatgttttctcgaaaagattgtggcatgaaccatgcgaaaactttgaagcttttcaaagccctaaattatgtggtagatttatagaatgatccaacatgtttcatcaatctactataggcatgagctatccaacatgttgttttacatgcgtcatcatcaaacctagtgcaagacaaactatagcttgagtttggggcccaagatattagatgtttgaatgctggcactatgaagaatgaggtaactatagaaatgtttaaagtgcaacatgtatattttttagatcagtaattttccggagttgacaactatatttatgtaattctgcttttattctattacag

SEQ ID NO: 565 - DNA, 2299 bp, Zea mays
aagtccgcactcgtggtcgagtagacgataaacacctggggtgttacaatcaccataccataatttttaaatctaaagacctaaaacgtttcttctgtacggggttcttatattttgacttcactaaacaaatatatttagcataatcgacaaagacaaaattcatcggataattctataaaatactaaatctatcttttacgtcgtcatctcgcccagatatcacctaaattaatctacctttcgcattattaaatccatcgtactacacatataattaacactaccacaacgcgcctgcgctaaatacgaggattattacgactaataagtctagttaatccaatcatgagataaacttacaaaaattataaatcagctcatcagtatcaaacgtgactcaatactcgtacgaacgttgataaatcctggctcgagcttgtcgtcgaacatctgacgggtgttgtgcggcttcacttctctacaccttccggtgatttctctcaaaccagcgacgatcgacaatgattgcgaacacgacgagagggcgaaaaccatccatcataacaactctctaccccgcaaacagcatctaaaacaaccatatgaagcagtgttgagatcttccggccccatgatctagatggggctgaccacgaggaggcgaagcacggtgaggcgcgtatcggaagagctactgagattaaagatgatgacacgcaccatagcgaggcagagatggaggatgagcacatgaagggaaacaacgatgttctcgcacacagcacgaaggcgaacgacaacgacacagatagtgctggacgtggccgaatccgttcagagcttcaaatcaacggccaccagatcgacatcgggactcgacgacagcgcaacacccccacaagacggaggcgaagtggcaacgatggcctaggacgggtgcagaggctaacagcagggaactccacgatgggcagcgaggcttgatgaagaatgacgtgacgacgggcaaggagagagcgcggactagggaaggactcggcgagcagcgacacgaggagcaaagcgaggttgtggccgggcggtctcggacacaagcacacgcagtgtttcatcgcgtccatcgcgcgcgtcacggactcgatgtcgcgcagcacgcgcaaacagctggccgagaggagcagggagggacaccatcgctgtgcggcatgccggcatccaatgagcagcagaccgtggttggagtagaggaagacgcctacgttgctagggagaaggcgcggcaggaagaggtcgcgcacatgggcgaggaggcaggttcggtgtcgagacgttcatgctccagtagaagcagaaccacgctatggcgagcaagaaacagggcgcgcggcggccatcagcgttggggcacgcgacgatgggagcagggaaggcgccgagcagagtgacggcggtgacttgggcgtagggagacgcgcgcaggggaaagaagaggcagtcgggtgccatggcagggagaggaataagctctgaccaaggagaagcagggggagcaagcagcgggcgcggccagccatggagggacgcgcggttgggggagagatgtgggaggagagagagagcggagccctgagcactggactagagctggggagctcggtagggcgccatgggagaagacacgagcagggacggcgcgggcgcgtccacggctgctccagactcccacgaagcaggacttcagcgcggctaggaagatggggcagccggcagagggagcgctggaagccgcggtgctggagagcgagctgaggggcgcggtgtgctgggagatgctccacggagggggaagcagggaggcagggacacgcgtggcaccaggaagatgaagacggcggggactcggctagagataagggagaaactcggttggaagaaaccagagaagggggcagcgggatattttttgttccaggaactgagcggcggctgggaacagtatggtgactgagataaaaatccgacatagggagacccatgagcggtggctgagatacatgcagggatgtaagccccgtgtaggaggaaaaatcaaggccgcacaggaaagaaaaatcaaagacctatggtcggctacagataaggccaatggatgaaaaaatcagagaaagatatttttcctctctaatttttgttacaaaagactacacagataatttagttttcagattatgtctgtgcgagatgtagaccggatgaaacagaagataccagtcaaactagtacaaactgcgcttga

SEQ ID NO: 566 - DNA, 2297 bp, Zea mays
caatccgatttcagaatcaacatcggcaatgattttaaatgtcgcgatttgtctctttcaatcataaatccgaaagccggtcatatcctttttgaatcaggcgtgaggaattattttcgagcaaattcaaaatagactctcgaccgagttaatcgcgcaaccgtccgttcgtccgaactctagttcacgctgttttgcgtacaaatgaattccacgagagcatttttattccagaaaataaattagcgcagcccgtttgaatgtttgggccaagctcattccagcccaataagcctactaaggaaaccctaaccctagcacgtgtctataaatacggacccctttccttgtacttgggctattttgcattcccaccctccttttttttccagccgccacaacctctcctccctgtcttcttctccctctggcagcagtcctcccacacggcagcaggcagggagccaagctccaagctcccatggcacccttcctcctcggctccaatggtgtggccgagcagcagctcccccagccttccctgggcgcgcacccctcctcccccttcttcttcctcaaaccaacaggcgcccagaaattccagcagggcctccatggcgccacccctccccctcggctatggctccctcggggctcccttccagcgtccgagctcgagaaggtgtgctggcgcgccctcctccatggatgcagcccctcctcaccatggatgccctcccctccagcagcgacggggccagggcaccggacacgcaagactcgcccagaccatcggcctctgcttttcccagcgccctgctcaaggatgaaactcgatgctccagggccccccatggccaggaaattgatgccgtccagctccagtccaagttccctgcgccttcagccatggcgcagcgcccctgctatctcctccccatggcgtcgagcttctccgtcgcacctctgtgacgtgcccagcgcgcctgccatccatccctgtgcacggcgcccttcctcccctctgttccagccatggtgcggcacatcctctgatccgagctcgagcagtgagctcgccgtcgctcatggagcccccactccctgctacactttctcctgacctcctctgcctagcgcccctttttccctattggccgtggatgccggtgccctccccaaaacagcaagtttctagcgccccctacatctcccatggaaaacagcaagccaccaccgcgtcctgatgttctcgctgctcagcttggcctcgccagctcgttgtcaagacaccctaaccattgctccaccgcgcgtactacctgctcgacgatatgcacaaccggctgcatgtggtcatgctggtgttctgcgcagcgcttgcgtgatgccgtcgatctgcgcagcgcctacgcgtcgtcgtcgaaacccacggtgagctccctgctatcctgtgcttttcgtgttcgattaaaaagccgcaccaatgaatcacataataaattgtgtaatgattgtgtatgtcgtttaatcgcagcccttgtcgacgtcatgcctcatgcatcgcgcgtcggcaaagagcccaaactaatggcatgcatgcgcgacacgagtcggccaggttgttcgccttgaatgattgcgatttgttttatttgcatattcggtcgatgatgtgcctgcgtgtttatatgcgtgtgaaaatatatttgtatgaatggacgcgtgtagagaaggaaatgaagtggaaaaagaactcgagaatttttattttgataggaaatgtgcgatgcgttgtttgatgcgaaaactaagttacaaaatgcggattatgttttggaaaatgcattgatatgtgtttgtgtgaaaagtgtaattgttttatgaaatgtgatgggattcgtgattatatcaggagtatatttgtcgatgcaacgggtaatttagaaaatgctagttgcgtagaggatgaattattaagacatgagtgtcggagttcatatattagtgttacgctacgatgattgaagtgtctcaagtgcaagccacaatatggttgtatgcgagacagggtttgtgcatgacgagtttagtaaaaatccatcggtgtcacatgtgttaagttgaagattatttgtgcacggaaagtaataatgtgttaatacttagaactcttagtcgatggtagaaattgtctcggcttaaatggaggggtggtgacatgccaaggtagtcatcattttctctatgtttataagttgagtcgagtcgatgcgcattatgtgtttgttaaatta

SEQ ID NO: 567 - DNA, 2296 bp, Zea mays
tttgtgatgggctaactaccttatcgctgtagactttgtctgtcactaaaatcattctgtgtgtgaagttcaacctttgttaaggaggcatattggtctgtattgctgaacgacattagcgtccatgacttaagggataggagttattaccccaaagtcaagctgaatatatagcgatattttgtattttgcggatcaaattgaattcattttgtatttttctaattttgtctgaatatatagcgatattatttagtcatcacctaggtcatctttgcggatcaaattgttatactttgtgtcattatgaactcctaggcccagtttcgaatcacgagtctcttgctgcttcggccactttgtcttttttgcctaatgctggaatccttcccagctccattataacacatgctccaagtcttgcattatctttatgggactgtgtcatgtcacttgttgcttgttcttccatcattctacacttcacagctttattcatattgtgatgctacttgggctattgattcctctaatgattattgtgtttttaatgattattttattgcttggtagactaagtagacaacactttcttgttcaagtgcatagggtgatttgcatgctatgactattgtgatggctaaggtgatttgtgttgattgcttgtagatttatgtgtttctatataggtgctataagtatcgtacgtcctccatgagcgtagtaacaaagtgaggttggtgaatgactaatgtttgccatgtggccaaatcatacttaagaatttaacctctctaaatcaaccaagaagaagagtctgttccccacatttatgccttggccatcttccaataaagaagaatttcaaataatcgaccttacaacatgataaagatgattaacaggtgagacaagtccattttgggattgttgtgtttttctttgctagtggacgtacccgaccaagaacatttctcctcatacccaccaatagttttaatttcctcaaagggtcatctttagtatcagagaactggcaattagaatagcgtttgtggtgaattttatctattcttcctaatcgttcatcttccctatcaatgtcaactaaatcatacacaatcactaggtagcactcaataccacaagagaagagagcaactcacgctcatgacaaactctacccatgaattatttttctaagctctagtaaacgaaagcacatcaccacatgattttttttagaggaacatgtccacaatattaagaaactaatattacatgttatggaaaagtcttgaataatggaagaaaccgctttctatagtaaaggtgaaataaaagattaaagatgataagaggcatggtgaagtctaaagctacccatgattctataaagccaaatacaccagcataaaggatctaggtgacaacgagagtaaatatgattgtattgtgtggaataggtcaatacaaaccacatgtgtcataccttgttcgatacacattgaacaactaaaaataacatatattacattagcatgtatggacaaatttggggttagtaagaaaaaatacaatttctagcttctcagctgattatggtatacaacacgaccaacataaaattacactaggaaaaaaaggtaagattagaggagccatcacagagcatgtgaaccctactagtatgaacaatataaattttggtacttctttctagtagggaagcgagggaaaagattttgtgtcttctcttgttctcgaaacatatttctttataaagttacaaatcagctaaaaagatacaaacgtttagatgacaagttagcccatcataaggtcagaacattgttgatgatacgtaactttataaggaaaaatgttttgaggagagaagatagagaatcatgttttgaggaggtgggccagtttgttgtctaaacttttacagccctttcagatgatatgtaacattataaggaaacatgttttaaggatagaaaatatataatctgttcccacatttctctacccgaaagaagtgtcaaaagttctattgttcggactactaggcttcacatgctctgtgttgactcatatgatcttaccttttctcctggtgtacttttaagtgggtcgtgttgtataccataatcagatgagaagctagaaactttattttttttttcttacttgccctaaatttgaccttacatgctaatgtaatatgtgtacgtgtatcaaataagggatgtcataggtgatttttattggccaattgcacacaacacaa

SEQ ID NO: 568 - DNA, 2295 bp, Zea mays
gagatgcatggtgcacatgaatagatataagcaagaatagcacaaacctaattaatgctacatgatagcgaattaaacacttagctacgaggcacataatagcacttaaaagcaaatactagttgtcgagatggtactaaataccatgtccacgctattttaatttaactgagtccaattcgaacaacaagcgataataaactaagcacaagtattatatcaaccttagctatagaacacaccaaaaagtgaacgagacttaggctcattattttgggacaccaaactagaactatggacagaagcaacttaactaactatttaaaccactcttttgaattaacctttataatatccaaactaataaaacatcacactatacttaatctatcaagtagacaatcatcacaccacatatatatttaccaatatacttatcacataaacctaaaattcaactttaacctccgcatcaagtaatagacaagagaatcatcgcaatcgatacatctatttaatcgaaccatctatctagttgacgggaataacgaatcaactcaccataactaaactcgacccgaatccgcgaggtcaacgacgattctgcggatgaggacaacgaacttgaagggcggcgcggtgaaattattggaacggctgagtcatggacgtggttctgtcgaggcgagaacaagaaacaacgacgacgtccaaagcacgacttatgaagaacagaatggcgaccggcctaggcgcgatgggtgagttgagcgactccgacgacgtgcgcgagctcgttctgggcatggacgtgagttggagcagaggagaacacggccgaaggtccggagtggcgctgcgtggtggagattggcagccgggtgtcgacgagtgcgtggagtcctgcagaactgtgatgctgaagatggcgtggtgacgagtgaacacggggctgagtgacgacagcggtgtccgagtgctgtgaggcaacgacgaggtcgacagtcggtgtcacggatgaaaccgagatcggccatgacagcggagctacgacgactggatcgatgtcagttttgagcttgcagacgacggtgttgtccggcgaggccacacgcagaggtggccagcccaagtgcacgacgcgcagtgcggcgatggcggccaggatcgagtgttgctggccagtagcgtgacggcgaggtagtggtgaggcccggcgagctcggaacaggggctcgacgaacggcggtagggaggtcgagtacagctgaggataagatcagcgtgtgagggagatacccagcggcggctaggagaacgatgggaagggcacgcggccaggcacctaggcgaggggagcacgtggcttgctgggggctcctacagcctggacatgatagggagatgagcaggaaacatgcacgcggataaggaagaggatgtcgtaggaaagtttctagcgtctaggagatgtacgtgacctgtgaacttgtaccggctgaagataatatcaacagaaggtaaggctaaaagccttgggaggggatgacgtggggttgagaagaaaaggggattatcccccattttcttaaatgaatacataaagataattagatcataggaatagagggctgtgggatatttccggagaaaagcacggactcaagataaggaatgaagggagatgaacacgtaatttttttagcgatgattaaagggtcgatgatacgggctacatatctcattctaatgttttagcaaactaaatcatttaccaattacttgctgtcagtactaattatagtggtttggtttgcttcggacaggatgcaaatagaccgaattagacagattttggcgtcagtatttagtcggggcttaactcgtctaacctaataatctcatccactaatcaagcactcgattactctgccgaagacaacacactagaaaaaagaggcccaattattactcttacgctcgccaaaacaacgtgctggaggaaaaattgggtcatgcataacctcgtgcaagatttcacgcgattcgaattattttaccccgaacattttagttgtccagttcaaactaatttgctcggaataaaatcatcaaagtggggcgggcttccgaattcgtattcgcgcgagcgatgaattttaaataaccatcggacgctccgattttcgaaatgactatgttccgaacatcacaaaaatttaggaagagcccggatagataaaaataaaaacgatatctcactcgcgacaaacgaaacagatgcgatattaaaat

SEQ ID NO: 569 - DNA, 2292 bp, Zea mays
cataaacatcacttgtttgggcatgttatctcataagatatgtagaaaattttcaaatgtttcatggttatgaacattaatgtatgtttgaagcggttcaaagccataaatgatgtaatgtttagaacggtagtttttacaaaaatgagccaacaaggtttgtcatcaatgttttcgcaatacactgatttgtgagtaaagggtcatgattttgtgcatgtttttctcgaaaagattgtggcatgaaacatgcaaaaactttgaagctttttgaagccctaaattatgtggtagatttacagaatgatccaacatgttgtttcacatgctccggcatcaactaaaattcaacacaatcaataacttgagtatgggacccacataattagatgatcgcatgccgattaaagttcaatgttttaaagaatgaggtaactttaaaagtatttgatttgcaatattcagatttttcaagataaactattttgcagagttacgacctctatcaatggaaaaaagttaatggaagaaaatttatatttccactttcattactcttttctaaatgtcatactgtaagacatacttgtttagacatgttaccttgaaacatatattgttctatttgcaacgtttcctcagttgtgaacacttgaacccaaatttaaggccgatcaaaacatgagtttgctacatgatatatcgatttctgatgtgcatcaactttgatgcattttgaaacccaaaatgttgtattgtttagacagacaatttttacggatggacccaacatgttgtttcgcatacaccatcattaacccattttctagacaaccataacatgattatgtgaccctaaattgtcacatgctagccctagatttggtcatatgaaggatgaggtgactcgaaaagcgcttgaagcacaacatgtagctttttttagatcatcaatttactataggtgtgagctatgcaacatggtgtttcacatgcttcatcatcaacccaagtgcaagacaacctatagcatgagtttgggcccaagatattggatgttcgaatgctagcactatggtttgtagatatgaagaatgaggtaactttagaaatgtttaaagtgcaacatgtatattttttagatcggtaattttccagagttgagagctatatttatacaattctgcttttattctgatccatgttttaagattctttgttattattctattacagtaatatcaatgatatttataatagaagaattaaatatagaaaaaaatgcattccaattttagttacaatttgctttataccagactataaacaaaaatagtttaggcatgctatcttaaactatatgtagtgctattttaaatttatgcctcgttatggacaacaatgcatgttttgaggacactcaaaaaacaactatgggacacatgatatttatcacaaaacaatttatccaaggaaaattacattacaatttgctcattgccaaactgtaaatatcacttgtttggcatgttatctcataacatacgttgaaaattttcaaatgtttcatggttatggacattaatgtaagtttgaatcggttcaaagccctaaatgatgtaatatttagaacggtagtttttacaaaaaggacccaacaaggtttttcatcaatgttttcgcaatacactgatttgtgagtaaaggggtcatgatttcgtgcatgttttcttgaaaagattgtggcatgaaccatacgaaaactctgaagcttttcgatgccctaaattatgtggtagatttacagaatgatccaacatgttgtttcacacgctccaccatcaactaaaattcaacacaatcaataacttgagtatgggacccacatatttagatggtcgcatgccgattaaagttcagtgttttcaagaatgaggtaactttaaaagtatttgaattgcaatatgcagatttttcaagataaactattttacagagttatgacctctattaatggaaaaatagttaatggaagaaaatttatatttccactttcattactcttttctaaatgtcgtactataagacaaacttgtttaggcatgttaccttaaaacatatattgtgctatttgcaacgttccttagttgtgaacacatcaacctaagtttaaggccaatcaaaacatgagtatgagactaatgggttttaatttcatataagtttactgcatgatatatcgatttttgatgtgcgtcaacttcgatgcattttgaagccctaaatgttgta

SEQ ID NO: 570 - DNA, 2287 bp, Zea mays
  misc_feature (1589)..(1590): n is a, c, g, or t
gttttagatctagcggacaacttattagcaacttagtagaattccataagattatagcgttaacacctaaaaacctagaaacactagtaaatcctgtcggccagccgtttaaaatacttaacctgcctttcctattataaatccaatcacacttgatttatacattcagtaatacactcctagcaaaatatgcatttaaacctaagctttacacgacacaattatttgttaatcacgaacacagttgcaacaatacatgtaacaaggcattttatcaaacatataataaaaccacagcgtgcctatgctatagacaagatatccgtcgcataatttttttatcaaaattctagaccttaacccctgacccgactactttataattctaaaaataattatatcaccatggaacagcatatcgacgcaacaacggatctaaacataatcacttagcgcatctatgctaaataaaaaggatcgtcgcaacctacatatctatgaatccattaattaaaacaaaataatatagtagcgaatcagctcacccatgattaaattcgacgcgaactctgcaagaaccacgatgatttatagttcaggcttttcgtcgagtacttggtgaatttcacgctgctagcttcgtcttcactcaactcttgggatttcttgataacgcacggaacgacgacgagatcgagtctggagcaagctagtgaggtgtggtcgagcaggttagtgcgagctctggcgaggacacgaatccagtgaggactccgatgtcggcaaggtcacgagctctagcgacacagggtcaagcggcgaatgcgtttggcgtgcatacgtgagccgaaccaaaagcgaggaaccgatgaagcgaagttcatcgacaagcaccatggaggaatcagcgacgttgttgcacacacgacgcgacaacgaacgatgacaatcggcatggagacccgacgcgattgaggaaggggttcgacgattcgacgacaccggcgaggtcaacgacgagccgaccaaacaaaactccacgacgtcgaccggcacacggaccagagaacggcggctggcaaaatccgagctggggaaaacggcgcgcgaccatggtgaactggagcaggggccagggacgcggcgaccatggcgagcctgaggctggaggagggtgtcgatgctagcgagcagggatgcaaggtccgagcataggggcaagctcggggcggccggcgaaccacgcgtgcacctgagaagagctcgcgccggagcggctagtggcgtagagggcggagcacggccagaagaacataggaagcttacatcggcgtctggcaagcacacgccatggatggagcatgggggcgaggagaatgagaacttagtgtggcgagcgtcctggcgctagtagggagcaacgtcccgcgagagagaatgacgaggtgatagagagagtgtccaagaagaactgagaggcaaagaagatacgactggcacacttgtgcgttgcaaaaatatcaactaccggatacgaacaaagatctggtatccacgtatgaagaaaaaaatatcaatgcatatcaacnngaagtcagattaattcgtacccattatttctatttgaagatttagatcaagacaagaaacacacagaatgaaccaaactgatttcggcttcgatattttagacaatatttaatctagccaaatttttacgagtctcacgtgctttcgatcatttgactacaaaacgatttgattaatgagctggcatattatttttctcgagcaacacgtaaacaaccagatccaaaataataccggcttcactacttcagatgatatttgatgcagctaaaatcggacaaatatttatctgccatttaaacctgtttgatttctctgtcaaggataaattgttggaaaccgaccacgattataattcctcagacacgatgtctcgcttgacgagaagggactaaattatttggcattgaaaactttagtcgtcgacttttaataaatctcgttttggacaaagttggaggactaaactaagtttctaaattcgtctttgcgcgagcgatgaattttaaataatcaccaggctcaccgattttcggaacaattatgttccgaacatcacgaaaatttaggacgagcccggatagataaaaataaaaacgatgtcgaactcatgacagacaaaatagattaagacagagagactgttattcactgctatcacatgttaaagtctgcactcgtggtcgagaagacgata

SEQ ID NO: 571 - DNA, 2287 bp, Zea mays
ttgtaacaccccagatgtttatattccgctcgacaacgagtaaggatttaagcacgtgacattagtgaataagacggacactaaggtctaattatcgtcattcatcgcgattttaatatcgcatctgtttcgtctgtcgcgagtgtgacatcgtttttatttgtatctatctgggctcttccgaaattttcgtattgttcggaacatcgtcgttccgaaaatcggtgcatccgatgattaaattaaattcatcgccgcgcgaatccgaattcaaaagctcgacctccttttacgccttttttttatcccggacagattaatttgaactcgacgactaaaatactcggtgcaaaataatccgaatcgtgcgtcgtctgagtaaaatcgtgtgccaggatataattcaatttattcttcggcacactgtttggcgacgaaatcgtgtatgcatttgcggatctggtttcggctaatttcggtcaaatcatgcagaacaaattatcagtgccgaaatcaatttaattcagtctgttgtttctcgcccaggtctaaatcttcaaaaagtaaattaatgatacaaattcatctggtttcaaagtattccttaaatcaaactatgtcgtaattactgtcgatcctatagttatcactaaaaatcatctctacaaccgttatcgcattcgttgatcttttgtgtactccttcaatctttatctatttcactcgatatttcctggcgtcatcgttcctatcttcacgccctgatttttctaccgccgcctgtacttatcttcttccacctacgtgctcatcctcagccgccgttccgccgttcagttcgtggacagaaaaatcccgccgtcgttcttcttcacgcgcagctggccttcttccatctctatccccttctccgatttttccagccaccgccgttcactgatttttctcaccgccgagctgaccttcttatcccgacgctctctcttctcccattcggatttttcacagccgcgctctggatttctcttcttccacacgctcctctctcctcccgagctcctccagcctccccaacgcccagttctcctgctcccttcctctcgcgcccatggcgtccagccatctttctcttccccacctctggctcgaccgcgcgccgtccctgcttgccctctgctccatagagcttctgcgcgttccatctccagcgctcctctccctgatttctgtgcgcgtcagcatctctctggtacgctcgctggtacccatggccgcgcttcttcctctgtctgctcggctccatggccgccgcgctgcagctctctggtgctcggtcgtcaagtctccctgctctctgtgttcttcttcctccctggctcctgctcgtccaacgacgccgtcggccggaccttcccctgctcagatctcgctcgtggagctcccttcctctacctcccgacagcgcctggccccaagctccgtggctggtcgcgcccagccccggcatctgccccagctcctctgctcgctcggcgctcaagctccctcgcgccggcgccctgctcccagttttcccatggccgagcgccctcccggcctccagctcgctcgcctctgcagcttccttcttcaccgcgccctggctgagctcggcgtcctcctctgccgcggctcccagtccttctctgcgcggcgctcctgtgttccaagctcgccgtggagctcctctatgtgcgcgcggttctctgctcccccgcgctcgttctgttgctttttcccaattcccagcacgccgcgcgcagctccctcgagctttgtccatgccgcgcgttgttccagctcccgcgcgcagtcacgtcttcaagctcgacgtctatctctgctgctggcccctgctgcgggttgtcgagctctctgtgcacgcacaactcgctctttctttgtttgccgcgcgcacgaattttatctgctcgccacagcgtgtcgagctcttctattgtgcgcgcgaagttctctgcttgcaacgacgtgtcgagtttccgcgtcgagctcccgcgctgaatcaagccccatattgccgtgtccctgtttcagtttgtcgtcccgcaccatcatcgcttctgtcgcaagctcgttagccacagttatcttgaccgcgtcagcacacgaccgtggtcgtgtttgtcgagttcgccaacactctgttgccaattcgactgtcgtcacggttgtgtgcctcgctacgcgctcgccgagtgttgttagttgtgtcggcgtttcgaccccg

SEQ ID NO: 572 - DNA, 2286 bp, Zea mays
ttatccataaccaagaatcatttaaaatagcactacatatattttaacataacatgcctaaactagtattgtttatagtctggcataaagcaaaatgtacttacaattggaatgaaaatttttctatatttaattcttctgttaaaaatataattggtataactgtaatagaataataacaaagtatcttaaaacatggatcgaaataaaaccagaattgcataaatatagctctcaactctggaaaattacagatctaaaaaatatacatgttgaactttaaacatttctaaagttacctcattcttcatatctacaaactctagtgcctgcattcgaacatccaatatcttaggccccaaacacatggtataggttgtcttgcacttgggttgatgatgaagcatgtgaaacaacatgttgggtaactcacgcctatagtaaattgatgatccgaaaaaatctacatgttatgcttcaagcgcttctagagtcccctcgtcctttatatgaccaaatctagtactagcattcgacaatctagggtcgcatactcatgttatggttgtcttgaacaagggttaatgatggtgcatgcgaaacaataagttgggtccatccgtaaaaactgtctgtctaaacaatacaatatttcgggcttcaaaatgcatcgaagttgacgcacatcagaaatcgatatatcatgcagcaaacttgtacgaatataatacccattagtcccatacatatattttgatcggtcttaaacttggattgctatgttcacaactgtggaacattgcaaatagcactatatatgtgtttatggtaacatgccgaaacaagtatgtcttagagtaccacatttagaaaagagtaatgaaagtggaaatataaattttcttccattaactatttttccattaatagaggttgtatctgtgcaaaatagattatcttgaaaaatctgcatattgcaattcaaatacttttaaatttacctcattctttaaaatactgaactttaatcggcatgcgaccatctaattaggtgggtcccatactaaagttttgattgtgttgaattttagttgctggtggagcgtgtgaaacaataagttgaatcattctataaatctaccacataatttagggcttcgaaaagcttcaaagttttcgcatggttcatgccacaatcttttcaagaaaacatacacgaaatcatgaccctttactcccaaatcagtgtattgcgaaaactttgatgacaaaccttgttgggtcgttttataaaaactaccattctaaacattacattatttagggccttgaaccgcttcaaacttacattaatgtccataaccatgaatcatttaaaatctttccacatatcttatgtgataacatggccaaacaagtgatgtttacagtttggcaaagagctaattgtaatgtaattttccttggttaaattattttgtaataaatatcatgagtcccatacttgttttttgagtggcctcaaaacatgcactgttgtccataaccgagaaatatataaaatagcactacatatggtttaagatagcatgcctaaactagtattgtttatagtctcgcatagagcaaattgtaattagaattggaatgaatttttttctatatttagttgttttgttataaattgatataaatgtaatagaataatcaaaattaccgatcaaaatatagctctcaattcctgaaaattaccgatctaaaaaatatacatgttgcactttaaacatttctaaagttacctcatccttcatacctacaactctagcgccatgattcgaacatccaatatcttgggcccctaactcatgctataggttgtcttgcacttgggttgatgatgaagcatgtgaaacaacatgttggatagcaaacgcctcatccttcatatgaccaaatcttaaaaaatacatggtgtgcttcaagtgcttctagagtcacctcatccttcatatgaccaaatcttgtgctagcatgcgacaatctaggttcacatactcatgttatggttgtcttgaacatgggttaatgtgggtcccatactcaagttattgattgtgttgaattttagttgatggtggagcatatgaaacaacatgttggatcattctctaaatctaccacataatttagggcttcgaaaagcttcaaagttttcgcatggttcatgccacaatctttttgagaaaacatgcacgaaatcatgaccctttactcacaaatcagtgt

SEQ ID NO: 573 - DNA, 2285 bp, Zea mays
atattatgcttcaagcgcttctagagtgacctcatccttcatatgaccaaatctagtgctagcatgcgacaatctagggtcgcatactcatgttatggttgtcttgaacatgggttaattatggtgcatgcgaaacaacaagttgggtccatccgtaaaaattgtctgtctaaacaatacaatatttagggcatcaaaatgcatcaaagttgacgcacatcagaaatcgatatatcatgcattaaacttgcacaaaattaatacccattagtcccatactcatgttttgatctgccatacacatggatagatgtgttcacaactaaggaacatagcaaatagcattatatatgttttaaggtaacatgcctaaacaagtatgtcttacagtacgacatttggaaaagagtaatgaaagtggaaatatattttttcttccattaactatttttccattaatagatgtcgtaactctgcaaaatagtttatcttaaaaaatctgcatattgcaattcaaatacttttaaagttacctcattctttaaaacactgaacttcaatcggcatgcgaccatctaattatgtgggtcccatactcatgttttgattgtgttaaattttagttgctggtggagcatgtgaaacaacatggttgatcattctataaatctaccacataatttagggcttcgaaaagcttcaaagttttcgcatggttcatgacacaatcttttcaagaaaacaagcacgaaatcatgacccttcactcccaaatcagtgtattgtgaaaactttgatgagaaaccttgttgggtcgttttgtaaaaactaccattctaaacattacatcatttagggctttgaaccgcttcaaacttacattaatgtccataaccatgaaacatttgaaatctttccacatagcttatgagataacatgcccaaacaagtgatgtttatagtttggcaaagagcaaattgtaatataattttccttagttaaattgttttgtaataaatatcatgagtcccatacttgttttttgagtggccgcaaaacatgcattgttgtccataaccaagaaatatataaaatagcactacatatggtttaagatagcatgcctaaacaagtattgtttatagtctctcatagagcaaattgtaattaaaattggaatgaaattttttctatatttaattttttttattataaattgatataaatgtaatagaataataacaaagaatcttaaaacatggatcaaactaaaagcagaattgcataaatatttctctcaattctagaaaattaccgatctaaataatatacatgttgcactttaaacatttataaagttacctcattcttcatacctacaaactctagtgctagcattcgaacatccaatatcttgggccctaaactcatgcgataggttgtctatttttaaggtaacattcctaaacaagtatgtcttacagtacgacatttggaaaagagtaatgaaagtgaaaatataatttttcttccattaactatttgtcctttaatagaggtcgtaactctgcagaatcgtttatcttgaaaaatctgcaaattacaattcaaatacttttaaagttacctcattcttcaaaacactgaactttaatcggcatgcgaccatctaattatgtgggtcccacactcaagttttgattgtgttgaattttagatgctggtggaccgtgtgaaacaacattttggatcattctataaatctaccacataatttagggtttcgaaaagcttcaaagttttcgcatggttcatgccacaatcttttcgagaaaacatgcacgaaatcatgacgctttactcccaaatcattgtattgcgaaaactttgatgacaaaccttattgggtcgttttttgtaaaaactttcattctaaacattacaacattaagggctttgaacgtcttcaaacttacattaatgtccataaccatgaaacatttgaaatctttccacatatcttataaaataacatgctcaaattagtaatgtttacagtttggcaaagatgtgataccccaattttctgaaaagaagttaaatttccatttcttttttctttcatgttctgtggcattggggtttggagtttcaggaggcattcctcagggaaacagtagatcttttggctttttttccgccggggtcgggagctcagatgggagagcgagttcgggccattgatctcgatccgatggatgggagcccccctctgctccccaac

SEQ ID NO: 574 - DNA, 2282 bp, Zea mays
ttaaacttgcacaaaattaatacctattagtcccatactcatgtttttgatctgccctaaacttggatagatgtgttcacaactaaggaacattgcaaataacactatatatgttttaaggtaacatgcctaaacaagtatatcttacaatacgacatttggaaaagagtaatgaaagtggaaatataatttttcttccattaactatttttccattaatagaggtcgtaactctacaaaatagtttatcttgaaaaatctgcatattgcaattcaaatacttttatagttacctcattctttaaaatactaaactcccaaatcagtgcattgcgaaaactttgatgacaaatcttgttgggatatttttgtaaaaactaccgttctaaacattacatcatttagggctttgaccgcttcaattttacattaatgtccataaccatgaaacatttggaatctttccacatattttatgagataacatgcccaaacaagtgatatttatagtttggcaaaaaaattgtaatgtaattttccttgcttaaattgttttgtgataaatatcatgagtccaatacttgtttttgagtggtctcaaaacatgcattgttgttcataaccaaaaatcatttaaaatagcactacatatggtttaatatagcatgcctaaactagtattgtttatagtctgacataaagcaaattgtaattaaaattggaatgaaattttttctatatttaattcttttgttataaatattattgatataactgtaatagaataataacaaagtatcttaaaacatggatcgaaataaaagcagaattgcataaatatagctctcaactccggaaaattaccgatctaaaaaatatacatgttgcactttaaacatttccaaagttacctcattcttcatatctacaaactctagtgccagtattcgtacatctaatatcttgtgccccaaactcatgctataggttgtcttgcacttgagttgatgatgaagcatgtgaaacaacatgttggaaagctcacgcctatagtaaattgattatctgaaaaaatgtacatgttatgcttcaagcgcttctagagtgacctcatccttcatctgaccaaatctagtgctagcatgcaacaatctagtgtagcatactcatgttatggttgtcatgaacatgggttaatgatggtgcatgcgaaacaacaagttggatccatccataaaaactgtctgtccaaacaatacaatatttaggacatcaaaatgaatcaaagttgacgcacatcagaaatcgatatatcatgcagtaaacttgcactaaattaatacccattagtcccatactcatgttttgatcggccttaaacttggattgatgtgttcacaactaaggaacaatgcaaataacactatatatgttttaaggtaacatgcctaaacaagtatgtcttacagtacgacatttggaaaagcgtaatgaaagtggaaatataatttttcttcgattaactatttttcctttaatagaggtcgtaactctgagaaatcgtttatcttgaaaaatctgcatattacaattcaaatacttttaaagttacctcattttttaaaacactgaactttaatcggcatgcgaccatctaataatgtgggtcccacactcaagttttgattgtgttgaattttagttgctagtggagcgtgtgaaacaacatgttggatcattctataaatctaccacataagttagggcttcgaaaagcttcaaagttttcacatggttcatgccacaatcttttcgagaaaacatgcacgaaatcatgaccctttactcccaaatcattgtattgcgaaaactttgatgacaaaccttgttggctcgtttttgtaaaaactttcattctaaacattacatcatttagggcttcaaacttacattaatgtccataaccatgaaacatttgaaatctttccacatatcttataagataacatgcccaaacaagtaatgtttacagtttggcaaagagcaaattgtaatgtaattttccttggttaaattgttttgtaataaatatcatgagtcccatacttgttttttgagtggcctcaaaacatgcactgttgtccataaccaagaaatatataaaataacactacatatggtttaagatagcatgcctaaactagtattgtttatagtctcgcatagagcaaattgtaattaaatttggaatgaaaattttcccatatttaattattttgtta

SEQ ID NO: 575 - DNA, 2281 bp, Zea mays
tcccatcctactttcatccctatggctgatccaccttgagtttgagggtgaggggagcattgtggatataatagatctattgtattttcacatgtagtctaatggggtttgtgcatatttctcctcttgtactagtgtctaatattgaaaacatatggtcaaagtaggatgtggtcctatagattacatatgggcactaggaaccggaagtttggttgtctcgtccagtatcacgactccaagtctaccattctttatggaatactagtccacaatcctctatgggcattgtaacacagtgaggttggtgaatgacaaaagtttgttgtgtggagaaatcaaacttaagaattttaactctacaacatcacatatatagttaatgggtgggacatgttaagaggaaagaatttgatgtaatcgacattgcgacatcacagatatggttaatgggtgagacctgtccttttgaggattttcagaggtttctttgctagtggacgtactcgagctagaacatttctcctcggcaccaccaacaatcttaatttcctctaagggtacttcttcaatattaaggatctgggaataagaagaatggagtatgtggtgaatttcctcccttcttcctaattgttcatcttccatatccgtgtcaactaaatcttgcaaaatcacaaggcaacaataaatgccataagagaagagatcttgcaaaatcacaaggcaacaataaactctagccatcaattattattttatgctctagtaaacctagtcacatctccacatgatcgttttggaaaggaacatttcacattatattaacgaactaatattacctttgttggaatagtcttgaataacagaagactctttctatagtataagtgaaatggaagagtagagctgataagaggtatggtcaagcatagagctacccacgactctctagtgtcaaatacactagcacagaggatatgggtgagcatgagagagaatataattgtgttgtgtgcaattggccaatacaatcctcctatgtcaaaccttgttcgataaacattgagaaactgaaaaagaacacatggtacattatcatgaatggacaaatttctaggttctcacttgattgcggtatacaacacggccaaggtaaaagtataccagcaggaacggtaaaatcataggagccaccatagagcatgtgaagcccaatagtccaaacaatagaacttttggcacttcctgctgataggggaatgtgggaacagattctgtatcttctctatattctccctttctcaaaatatatttccttataaagctcattatcagattatagaactgcaaaagttcggatgataaactagcccatcccgaggtcataacataggtgatgaagaaggtagcctgcaataaaaaataaaatcacagaaaagaaacagaaatggtagatgaaaattaaatacacaaaaccaatatattatctttccataaagaaaagggaaggtgtgttaaacctgtctagttaaagctctagcaagcttgacaggaatgtcctttgggcttaataacaaattcaattgactcatgaatgtaccggatagtacattaacaaagaatatgttccaaactatgaagcacaacagtttaaagcaagcactcctcttccttgcactgtgagatgtggcaccttccaatttagaaactttcatcatcaatgtcccaacaatatatagaataatttgttggatcacattaggaaggtatcccgttactaggttagtcatgtagtttttcctgcaaataggacgggtaatatatatttaataggtgcaacatgcagacaggtcaaatggatagtatatatatttgtagtgacataagaacacacatctatcgagatagcccaactgaagtttcagtacttacttctccaacctttcttttaaggaagcaggcatcaactgttgcagctgctctgggtcagatagtgattgtatacacaccatcggcatcaaaagtaagaatgcaaaaataatacagcctggaactagtgttgatttacgacacctgttggattgccaaagattggaccaatacacgtcttctggttctggagccagactagtaacccatttcagtgggttagatgtctgcaccatatttgaggcagtaactgcatcatagcgagttttgaaaaatacaaaagcagttgcgcattcctgctgcatgtaattccacatagaaattactatccatattattactgctaaat

SEQ ID NO: 576 - DNA, 2277 bp, Zea mays
aaactaggagagactcccaatcactagatgtggatcgacagctcacagcccctgctccccattgagctcccggtcccagcaaataaagcctgaaaaactacagtacaacggaggtattcgcctccccgaactacaaactccagagacacagagcgcgaaagaagagggaaaagaaatttaactttttttaataaaaattcgggtatcacagtcgtactataagacatacttgtttaggcatgttaccttaaaacgtatattgtgctatttgcaacgttcctcagttgtgaacacatcaacccaagtttaaggccaatcaaaataggagtatgggactaatcagtattatattcgtacaaatttgctgcatgatatatcgatttctgatgtgcgtcaacttcaatgcattttgaagccataaatgttgtattgtttagacagacagtttttacggatggacccaacgcgttgtttcgcatgcaccatcattaacccatgttcaagacaaccatacatgagtatgcgacccttgtcgcatgctatcacttgatttggtcatatgaagaatgaggtgactctaaaagcgcttgaagcacaacatgtagatttttttcagatcatcaatttactataggcgtgagctatgcaacatgttgtttcacatgcttcatcatcaacccaagtcgagagctatatttatgcaattatgtttttatttcgattcatgttttatgattctttgttattattctattacagttatatcaatgatatttataacaaaagaattaaatatagaaaaaatttcattccaattttaattacaatttgctctatgcgagactataaacaataatagtttaggcatgctatcttaaactatatgtagtgctattttatataattcttggttatggacaacaatgcatgttttgaggccactcaaaaaacaagtttgggactcatgatttttatcacaaaacaatttaacaaagaaaaattacattacaatttgctcattgccaaactgtaaacatcacttgttttggcatgttttctcataagaaaagttgaaaattttcaaatgtttcatgcttatggagattaatgtaagtttgaattggttcaaagccctaaatgatgtaatgtttagaatggtagtttttacaaaaaggacccaacaaggtttgtcatcaaagtttttgcaatacactgatttgtgagtaaaagggtcatgatttcgtgcatgttttctcaaaaagattgtggcatggaccatatgaaaactatgaagctgttcgaagccctaaattatgtggtagatttacagaatgatccaacatgttgtttcacaggctccaccatcaactaaaattcaacacaatcaataacttgagtatgggacccgcataattagatggtcgcatgccgattaaagttcagtgttttcaagaatgaggtaactttaaaagtatttgaattgcaatatgcagatttttcaagataaactattttgcagagttatgacctctattaatggaaaaatagttaatggaagaagatttatatttccactttcattactcttttctaaatgtcatactgtaatacatacttgttcaggcatgttaccttaaaacatatattgtgttatttgcaatgttcctcagttgtgaacacatcaacccaagtttaaggctgatcaaaacatgagtatgggactaatgggtattatattcatacaagtttgctgcatgatatatagatttctaatgtgcgtcaacttcgatgcattttgaagccctaaatgttgtattgtttatagacagtttttatggatggatccaacgtgttgtttcccgtgcaccatcattaacgcatgttcaagacaaccataacaagagtattcgaccctagattgtcgcatgctagcactagatttggtcatatgaaggatgaggtgactctaaaagcgcttgaagcacaacatgtagatttttcggataatcaatttactgtaggcgtgagatacgcaacatgttgtttcacaagaatcatcatcaacccaagtgcaatacaacatatagcatgagttccgggctcaagatattggatgttcgattactggcagtatagtttgtagatatgaagaatgaggtaattttagaaatgtttaaagtgcaacatttatattttttagatcggtaattttccggagttgagagctatatttatgtaattcttcttttatttcgatccatgttttaagattctttg

SEQ ID NO: 577 - DNA, 2169 bp, Zea mays
tttgttcccatgagtttttggacgctttgtgatgagcatcatcttgttctacatcatcgctaatgaactggttgaacttttggttgctttgggtgtgatactgggaattaatccttcaatatttgggcatgcgggaactcaatgggtgacttgatgtcaaatgtcgctttagcaatgaatggaggcgacattgctatgcctgggatgttatgcaggacctatgtttaatacacttgctggtttgggtatatcgatgctgcttggagcttcaatggcgcccaattcacatgttcttccgtaagaccacttttatttacacaatgggctttcttgttgtcggattgatctgggctcttgttacgctgccaagaagtgacgggcagcctaataagatacttggggttggcctcattgctcgttactcaatttttctttttttatattagggtaagcaattgtagcatttatttttatatatgtcgagttatattccactcgactaattagtacattataaattctcacattcactgtcatttaaccttactgtgtatttgtactcgataaactaagtgttaagaattttttctgtttacttgaattgaatcttaggttttcaagcgatgacagctgagctccgtgccaccacaccgtagctgcccagctagccgggagctttgcgtccaccgccccgccaccactagcgcaatcacatggtgagcgcggatgctggctataaatcgcttgtattgtttgtggctgcataggtcggtaggtcagtttggagggaacgttgggaatgaccagcatgtcctctacacgcttagcgccatgtaggtcgtttgcctcttagatcggatcgatgtccttgacgtcgacaaggttgctgattatatccttttttcccagattttgaattggttttgtattgttggtgtgtataaatttgatattaccgatgataatatatattgctcatttttattaaattgttgtgtaatattattttatcgaatacttttgtatgtcgtcgcaacgcatgtgcattgtaatcgataagctgagtgggtgcgtttactctgttcactaggtcagataacatgactaatcatgcactttgcctcttctttacaatgtcactttggtattgctatctagacctaaaaccttgaaaacttttactcatggtaatacttatctgaaggttttcggctgagggcacgtggatttgtcagttcacctgctgcaagcaagtatagctacaaggttcaccagtgcagaagtatgaatccttattttgttgggattctgtccccatcgtggtctccctgctgctccgcaagaggagaaaagtggaaagcaagaggggagtgtcagttgaggttggcggggagcctggatatgcagtccataactatcgttttgaacaacctgttaagactcacactcactggaatggggtccccacacttgctgatctgtttgagcaatcttgcaaagagtatgtctacatgccactcctaggcacaaggaagctcatttcaagggaaactaaagcaacacctggtgggagatcatttgagaaattgcatctgggcgagtatgagtggaagtgttacatatagtgcttcaagagcgtctacaacctttcatctaaactaattaaagtaggtcaccagaagaatgaacatgttgctattatttttgctgggacatgggctgagtggcagattgggttacatgtattctttttttacctatcattttacatatagatttatggaccaatttatgggctttgtttctcttcacttgtgactgccacatgtttcttcggtaaattgaaggcaccagtcacttcacatatgtaatgatctaatgcagaaaagcatggacaatgcaaattctgagttccctagatcagattacttataattgtaggttactaggtgacatgcatagctaagacttgttaaaacatctacagactgaattgttatttagattatatatgatttcctacatcgtactgtgttgtattttattatgagatttgaatcatgcgtgtgttctttaccaacgtactttattaagaatgttgaagcttgattgacgtccgtcgcaacgcacgggtattgccctagtgtataaataagcataatctggtga

SEQ ID NO: 578 - DNA, 2276 bp, Zea mays
aatatgggccaggctaccacggtctgaaggtgagcctgggccgggcatcaaatttcggcctgtcggacccagcacggcacacgcgcatggacagggcttgagctaacacgaaccaatgaagtccatattgtttaatttctttaatttagtaaggtatagacttaatgtggttataatatttggactttatacggtcaaatgctgctcacattgtttaatatttttaatttagtaagctatgaactttatgtggttgtaatatttggattttatgttgttcaaatatatggttcgtgcttgggccagcacggcgcaacgaaggcacggcgtgctttaaggttaggctggaccactgtttctatattttgggctggcacgacacgacccaaaaaatttttgaaccttcttggcctgagctcatttagtccgaagcatgatgagctcgggtcgggccgagccgacccaatccaattccactaccttcaggtacgacataacgtttggaccattctgcgtggacacttctaagagtttcattctcgtacatgccaagaaaaatgacaagacataatttaatactctcttcgtcctaaaatatagttctttttaacttttttttcttcactatccccattcaaattaatgataataaatctagttatatttaccaaccatattcttgtatttactaataaatatatgtttagtctaaaaagaatactattttgggatgaaggggtaggagatatatgagcgagatttacaggagatgtgaaggttgacttgacaactttagaaatagcgtgatgaaactgtgcgttaagaatggtcatatgagccgtgaaggccggtagtgtaaatgtgtgtttggttggatgtataagaatgaatagaaggggatggtcacagtttttatattgtttggatgagagttaagtgtggacaaggtaaacaacgtagtaatttttttgatggcgtgattccaaaaaattgagagaacgatgtcagtctgcctcatcctactttaaccttaaaccaaacacaatataattgatttgttgaaggaagctcaatctcttacatgccagtttgatgtgttaagtcgttttgttggtaggctcgctcaaccacctcatagttatgcacttttcaagcatcaggtaacggttctatatgcacctccattgttatcaaatgacttgcttcagcaactggaccagcctcgaactggcggcattcaggcacggagatcccaaacctatggatttatggaatgaagaaacaatttgaagattctgacttttagtagtacattgatcggcggaacaagagcatcgatccgtccatgcgatcgaagcatccaaattattttgtctttcttgaaggcgatgacgaagcgtgagagcgacgtccactagggtagtcgagcacgcacgcaggcattattaattgggttgcggtccggcaccgggcggcggcggcggcgtctcccactctctgctctattcgcgcgcgaatcgcgatgacttgactagggtctcgttttctccctgctccgacggatcgaggataaggtatttttccagtgcaaatgcaaaaaggcagaagcgggaacagcttcggaggaggctttcagttcagctcctcaaccgagacagtagccggcgtccatgggaaagagtgtgcctgtatggccggcgtccatgggaaagaggcttcgcaggaggaggatgcatgacgagttgacgacggggaagatggaaagcgtcgccgaccgacggagccagcggagttatccgggccggggcgaaggcttcggcgctgggccagacgccatgagccgtcgctttctctcgtgggccgttgggtccagccacgcatgccgcctcgtttccagtaggtgcggcgcattgttagtttaccgtttcatcttccaaactggcatacttgtgtccctgctttttaattgtccgctttaatcgcgtaatgaatcctactccacagaaagggtgtcatctagacatctacccatacccgtattatctctacactttatgaagtggagtttcgaagaattaatatgtctacaatgaggattaattaaactaatctaaaatttcttgtaataattaaattctatataatagcttactttatccctcggtgtctagtagcgagaaaaaaagttaacacccaaagttcaaactctattatatcatagtatttctgataatctaaatataagagtctaattacataaacgtaaatattcaaaa

SEQ ID NO: 579 - DNA, 2275 bp, Zea mays
tgcaagatatagttgtagtccagattaacaatccaaatgaggcctaactatatgaacaggtggttagcaggttactgggttctttttctgcgagaaacttctgatgttggtggatttttctatgtgggtaaacgtaaatcatgtcacatctactcttctagagactaaacacaagagttaggtgcagtttagtttaactaatccaattgaggttagcaggttactagggtgttattggttgagaaacttctgaggctggtcgattttttatgtgtgtaaaacctcaatcatagcacatccactcgtaagaagattcggttgtattcctattaatagaaatgggtgtttcctctcaaaaaatgtggactaacttgatatttatagacaagtttagtggtcttgtgggcaatttactctagcaggccccaaaagtcaaacaacaagttacttctccacaagaaagtggcaaccaataacatgcatgtttatcaaactgaccactgagacccgattgcagcaagagtgcacgacagttcttgacccacgagacccaattttcacgatacaccataagggtgaaaattaagtcagatgtatgatcgcatgtaaatgcgagattaatttccaggcctgctcggacggtgtaaacaagcgacactatattttttagacctgctaaccacatgtcataaagttgatatagttagacctcatttggataagctaaactcgactacagctaactcttgtgttttagtgtcttgttgatcttcatttttattagtttcaagatctttatgcttaacaaaagagaacactttttgcagcgtatccacaacaaatggcatactatctttggcatttctcgccactacttgtagtctaacaatttcatcatcctttatttgggctcccacttgcagctcatcagtatgcaaaagcttttgagttgcttcagtaccccgttttacctgtaagttcttcctcttaatggtcccaccgtaacattcttccattgtcttaagttgtttccacacataatttttttcatttgttatgctgaaatttcattatgcttctctaatcttaggatctagtaagctttctttagtttcttaatctcttccctaatatcttttctaattttctggggatccaaattgtcaaaactaatatatgaaataaagtttagtcccaacaattcggatcaccaaaaaagtgaggaagatattaggtaagagataagaaaactaaagaaagcttccaagatcatgagatcagaggacagtgaaaattcagcataacatgcaaaaaagaattttgtgtggaaccagcttaagacaatggaagaagattacactgggaccattaagaggaagaaaatagaggtaaagcatgctactgaagccgctaattttttttttgcataatgttgatgagttgcaattgggtgcccaaaagaaggatgatgaaattgttagactacaaatagtggcggcaaatgccaaagagaggatgtcgtttcttgaggatgagctgccaaaattgtcatctttggttaaggataaagatcatgaaactttataaaaattaaatcgaccagagactaaaatgcaagattcaattgcagtacagattaactaatccaaatgagtcctaactatatgaataggtggttagcaggttactatgttcttattgggtgagaaacttctgatgccggtagattttgctatgcgggtaaaacctgaatcatgtcacatccactcttctagagactaaatacttgagttaggtgcagtttagtttaactacggcctatatataaaaaatgtggactaacttggtctttatagacaagtttttagtgatcttgtgggccaaaagttagacgaaaagttaccttcttctccatgagaaattagtaatcaataacatgcatgttggtcaaactatccactgagacccgattgcagcaatatctggcacacggacgaactgcagacagaaatgcaccgtcaggactcacaaaatcaataggcttgctctctctctctcacctgagaagacacgtgcacaactctctatcttgtgactatcaggagcatcgtcttgctagatttctcctaccagagcaccacactttcacagagtactagatggaacatcatcgatggatccctacatacaacgctagcacccattaaataatgaacacaagtagaggatgacaggcctagaactgtctcttatacacatctgacgctgccgacga

SEQ ID NO: 580 - DNA, 2273 bp, Zea mays
  misc_feature (747)..(751): n is a, c, g, or t
atcaatagtaaaaatagtaaatcggctcaccgttccaatagctgactcgaatccgcgagatcggtaatgattctccgatttaggcaatttgtcgagcgcttggcagatactatccgaacttcacgcatcccaccatccaacctttggacatcttctcttggggcttcttttgtcagcatgactccaacgtactcggaggcatcacgtagggaccgacatcaagatagggtgaccgaacgacgacggcaagacaaaggttggagacgaccggatatcaacgacaagcactagagttttatgacgggaggttgtaatgggacgtcgatacacgatccatggcaattaggagatcgacgtaggcagaaccgatagccgaacaggaactgcgcagatcgacgacgcgagactcgatctggcgagcactacgcaagggatcgcagcagctgcttcgacatgaattacttgctgccgagcacgacgaaggccggggagcaggaacgctgcgcagcgaaacccacggttgcgcgcaggggtaaactcagctgggcgcggtgattggagcaggcggccactggggcagcgcccaggcgcgcacggcgagaatccgagcagggccagtgacagcgaccatggaaaagatctgagctaggctgaatccgagctggaacttgcggcaacggggagcagggcgagccagacactggaagacgccatggcgagcagcagggagcttcgacggagagaggnnnnncaggaaggtggagcagggagacagacgtgcatgggaggcgcgcgccatgggagatggctgtgcgagcgcgtcagggagaaacgccggctgcgcgcagggcgaactcggcacggcagccatggatgaggtgggcgagcggaggaacgaagtgatggaggagcgaggtgggcgagcggaggaacgaagtgatggaggagcgcggcttgcgatggagagcaggtctgaccggctgtcatgggagatcgacttggcgagcactggcggctggagaaagtcgaggggaggtcaaggagctgagcggctgcaaagtggagcaagcagccatggaagagcagagagtcgactaggagggaggagatgggatggtgctgggatgtccgggaccagggcgcggcttcaggaggaagatgtgagaatgagcgcctgctaccgtgtggagaggagagataatgctgaggaaaaaatctgcagaagaagataaggctgggagaggatgcgcatgtagaagaagatattctaccggttacccacttaagcggcgacggagacaaggaaaaaatgcatcgaatacgattccttgcaaagaaaatatcgatgacggccaatgatattctaggaagtttacgtacatgagaagaaaacaactatagagagatattttctatagtgaaaaatccaattacgttgaaaatcataccatggaacggtggaaatatttagagaaggattttccctattttccttctttttttaaaacaacaaaatacgcatattttagggtatgaaattagagtctaaaaaatatacaaaaggatcaaattaaaatgagaccgacaacaatatttagataggatttgatttggtgaatactctcggaattagatgaattttcacctgttatttatatccgaagttttggatctggccgagaaacacaaggaccaaaacactatctggatacggtacttgagactctattaatttagttgaactcagaaaaaaattatctgttttccgaatcgatttgatttctctacctagaatagcacactaatgaataataccaattgttaatcttgtgcactatttcttggtaacgcaagcgatccggagtattctttcggacccagtattatctgctataaaatcaaacattaatctctttgtctcggataatatcggtttcggatagtatgcaaatagaatgaacccaaacgagatcaagactaatattttaaactatatttgatacgacttgaaatcagataacttcgtctgccactcgaacacctgatcactctgccatagatgatttattggagaatcaaatctcaattataattccttggttagcaatcttgcacatgatttttctcagacaatgcgtgattcagattattttgccccaaacattttagtcgtcgagttcaaattaatttgttcgggataaaatcatccgagtgggtcgagcttacaattcgtattcgcgcgagcgatgagttttaaataatcaccggacgca

SEQ ID NO: 581 - DNA, 2269 bp, Zea mays
atttgtaacaccccaaaaccatgtttttgggatctagagaaaattcatctcaggaactaaataaaagtggtttctaagaaaagatgggagaatataatcatcgtaagactagaaatacttttgaataaactatatagataaaatacttgtaaagaaatatatccaacctaaagtaattctctatattaaaccttacttttcacaaaaaaatataatgaatatttttgaatttctaaattaaacttttcacattcaaaattatttctgtattgcatatgtcaaccaatacttagataaataatttggcgaattttatactggtgtttttgtttgtgtattaaaaacctaaaggtaaaatctcaaatgcagatttgaactcaattttgaaattggatagcaaatagaaaaaaaacaaaaggaaagatcatacttgcatttaggctgatttgcttctgccgacccatcttcttttctccactcgaagctcgcgcggcccattaaacccttgtttttccccgtgaaggcccatcattttcccctctcctttctttctgcgtgtcactaatcttgtggggccgcgggggtcagcttcatagttacttggctgggcgcgcgcagtggcttcgtggtgggccccttgcaccagaagcgtcttcctccccgtgaatgtcgctggttgttgtaacaaccgcaccccagtttgccgagttcccctcccgcaagaccatgatctatggtccctataaattggtgaccgtgaacctcctctcgtccacccgattgcgccatgaagcaatactgagagcagggggaaatcgggagatccctggtaagagagagagacccagatgccgccattgacaaccgctgctctgtcgttgttcctcctattactcgtcattcagcacgcgccgtatggttgaggatggtcgtctggacgtatgcgaactcgatgtggcatcatcaggcgggggtgatgggtgcgggccggattgatggctgccgctgtcaacctatgccggcgttgccgcttgggtctagggagcagcccggaggaaaatggaccgagggccgaggcgctcaggatccctcgccgtgcacctagctctaccgcgggggtcacgccagcgtgctcatctcgggggttgcgcgggtgcctctgtactcagagcatgggaaagaagacaacctcgtgaacgtctgatcggggtcgtgcggatgggaatagatccggggttaatccaatgtgaacagtcgatcgtcagtttgtggggtcagatttgatgcaaggtgccccattcactcaaatagatccagaccgttgggatgtcatcggatggctgagggtagataccggttcgtaaacgtgtgatgcgatctggtccacccaagtgtgatcggatggctcagggacctccataccccttcggtcgttgagtttttataaaagagtccctcggcttttcctgaatcaagccgcgtccgagtaagagttaagatcatttcagagaagtcctcgaatttacaaaatggtcgttttcatcggcttagagtcgtagatgagtaggcctagtaatcactttctgatgtctcgtctttttttaataatctggataatctgatgttgtggcaatataatattttccaaatacacgtgctttggatcatctgccgtggtccacatggagtttaggatgttctttaggttttataggttggtgatgtattttaccagcggtgtgtgtttcttttgttctgaatctcgcgtccgcagatctgaagtcatccgagcgatccacgcatcattatgtatacaccatgattagcttcggacactaagatacaatattacatactgtgtatttatagtgtttttttataaaatttgtaccccaaaatattgttagtctcgcgtccgcagatcccgaagtcatccgagggatccacgcatcatttttaatgttacagtgatattttgccacacatatttataccatatcatagtacttataataatattccatatttgtaccatcaatataatattaatgttacagtgatgtctattgtccggaatctatgttttatacaaatttttaactcgtataacaacatatgagcatatacctagtatttctgttatgattactagactgccacgccagctaccctgctcccttttgacgcatcttacactagtagaaagtagctcaaagcttgacatggagtttaatttttacagtcggtttaagttatcaagcgttagtga

SEQ ID NO: 582 - DNA, 2269 bp, Zea mays
taatgaggctgctaatcaagcgatttccaactacagtagcgtctactccttacttcccgaagaatttagagaggcgtaccgggccttcctcctcgctttcactgcctctgcgcttggactttgaccggctcttcttttccttccttgttctctttgatctcgaccgtgatctggacttccttgaactctcatcgtcgctgcttgaagattctgaagatgagctggaacttgactctgatgaacttttgtgttgttaaagatttaaaggtgagggcgtcaaacaaattttaagtaagcaaagtacctagaacatagttatcataactaaatatatttccattaggtaaatcgcaacaatttcacaaataggcagcaggtcataagctagagtatacctttctcctctttttacttcttttctttgcgtccttatccttcctctctgttttcaaacttcttttgtcagaagagccatataatagatgcaatatatttatatttgaggaatggcaagtgatggaaatactcttttgtcagcatctagttgtttgaaaacaaaagaatgttacctgtgaacctaagcctacaatagggtcgctaccacgcaatccatcaacaagctcatcataaagttgttcctttggtgttggggctggtgcaccataataagaaaattcaacaacatcaacatcacaccacacacccccaggtccctgtttatggaacgcaatgaaactgaatatgtggtttcagatggcttaaataacattgtaaactacatgaaacaaacatcatgcctacctcaagggcagttggaagacattgagtagcgctgagcaacttcctgtgaacctttcgagcaacaaacacaaggatggcaggtgtgtcagtcaatgttcctttcctaattctaaagcctattgttgtacgaagactaaaccggcggaggatcttgctgtggaatgctcttataatcattaaatcaagtaaggtggtagcttgttggccctttggcaagcgaccaagatgtcctggtagtacacccttctgtaggttcccaaagtaattagcacggccttcagctgacccgtgcattagagtagatgtaggccaagaaaagtatgcagcgctgctttcagagtgctgaccagctgaggcaattggttggaaaggagatggacaataaatatgattgcatccgttcctctccatatccagacccgaaccctctgactgtgatgaaccaacatgcgccttccaaatatctgagggctgcattatgcaagtatcatctagttctgtagatttttgaatccttcaacgttataaaattgtggcatgggagatcagaaccttgaaaatgaaaaaaatgtattaattctgttttaaaattgatgcaggactgaccacaagaaaaaagaatccataagtcatcaacagaagatggaccatcaagaattaaacctacaagttcacgaatcagagaaaatataaaactaatatcacatcaccacatccattgtttaagaaaataagtaaaaaaaggttgtgtgcagccagcatcaaaaggcattgcaataggatttttaaaagaactttgcggagaaaaagtgcaaagttctctagaggtaccattcctccaagtataacaacaacatgtggaagaatgatatatcaagaagactagtggtcattttttccataatgaaaacagattaccagtaaaagtacacaaaggaagcatggattcagtagaaacatgcacaataccaaggacccacatcgtctcctatttttcagattaatcaatgttcaacttgggcagacaaggcatgcaacgatgagctgctggaaggacagtggaggaaagcctaaatagtttcatcatcgttggctcctggatcatatggaaacacagaaaactgtatgttacctacaccgaataacatgcacctaaagaaccctaaactgactaaacagggctgcagttacctacaccgaatatcaatgtgataaacatgacgaataactgtcggctataaccagtttcctgatcgtgtgtttatcgcttcttatatcgacagcacaactgaatagcaagtgtctaatggagtattgatttcatcattttttatgaagtggatactggatacagatttcagcgcttaccaccaaacatgaggcgcactgaaaaatccctttccatcataaacaataactttatcctggttttttatatctagctcagaaattgctgttgtgaatgctg

SEQ ID NO: 583 - DNA, 2268 bp, Zea mays
  misc_feature (1352)..(1353): n is a, c, g, or t
  misc_feature (2064)..(2071): n is a, c, g, or t
gttaggtgcagtttagcttaactgatccaaatgaggcccaactatatgaactttgtgacatatagttagcaggttactggggtcttattgggtgagaaacatcttaggctggtcaattttttacgtgtgtaaaacctcaatcatgtcacatccactcgtaagaagactcggttgtattcctgttaatagaaatggttgtttcctctctaaaaatatgttgactaacttggtctccatagataagtttagtgacctcgtgggcaatttactctagcaggccccaaaagtcaaacaacaagttacctacttatccataagaatgtagcaatcaataagatgcatgtttgtcaaactgacaactaatacccaattgcagcaagaccgcgtgacagttcctaacccacgagaccaaatttccagtagaaaagcatgcataagattttgttgacacaaagttgatatagttaggcctcatttggatcagctaaactcgactacagctaactcttgcgttttagtcttttgttgatcttcatttttattagtttcaagatcttcatgcttaacaaaagagaacaaatttcccagcgcatcctcaagaaatagcatattatctttggcatttatcgccactacatatcatctaacaatttcaacacctttatttgtgctcccacttgcagctcctcaacattatgcaaaagcttctgagctgcttcagtagcccactttacctgtaagttcttcctcttaatggtccaaccgtaacattcttccattgtcttaagctgtttccacacataattctttttcgtttgttatgctgaaatttcattatgcttctctcatcttaggatctagtaagctttctttagtttttaatctcttccctaatctcttctccaattttttgggatccgaattgtcaatactaatatatgaagtaaagtttagtcccaacaattcggatcaccaaaaaagtgaggaagatattaggtaagagataagaaaactaaagtaagcttcaaagatcatgagattagaggacagtgaaaaaagaattttgtgtggaaccagcttaaggcaatggaagatgattacactgggaccattaaggggaagaaaatagaggtaaagcaggctactgaagccgctaaaaagtttttgcataatgttgatgagttgcaattgggtgccaaatgaaggatgatgaaattgttagactacaaatagtggcgacaaatgccaaaaagaggatgttgtttcttgaggatgagctgcaaaaattgttgtctttggtcaaggataaagatcttgaaactttataaaaataaaatcaaccagagactaanntgccggtggattttgctatgtgagtaaaccctgaatcatgtcacatccactcttctcaagactaaacacaagagttaggtgcagattagtttaactgtggcctatataaaataatgtgtactaacttgttctctatagaaaattttttagtgatctcgtggaccaaaagttagacgaaaagttacctacttctccacaagaaagttgcaattaataacatgcatgttggtcaaactgaccactcagacccaattgcagcaagatttggcacacggacgaactgcaaacataaatgaacagtcaggactcacaaaatcaataggcttgtgctattgctctctctctctcactcaccgagaagacatgtacacaactctctatcttgtgagtattaggagcatcgtcttgctagctttctcctaccagagcaccacactttctcatagcactagatggcacatcattgatggatccctacatacaacgctagcactcattaaataaatagaagtagacgacgacatgcctagaaactacacctctcgtctcgtctgggccacatgatgcacgcgtcttaccatgagaagtggtcactactgcaggccaaccgtacgtgtctctccaaacataggctgcactagagcgcgttcttcaactagtggacgcaagactcgcactaaatggaggcatggtctgcatgcacaaggcgcnnnnnnnnacgcctcctccattgctccatgatatggggcgcgtcctttggctctgcaatccacctgaaccgctccactttttcatgtactcatcgttaaactccagcaggtttcatataaactcatgcatagtactagtatatggcatggcactccggtcgaaatccaggactgatggtctgatgtgctgcacgcatgttaggta

SEQ ID NO: 584 - DNA, 2268 bp, Zea mays
actgagtcatgaacatataataactgagtaggcacattacaataactgaggtatgacacgggataactgagggattggagtagaataactgagttctgtcactcgaataactgagtgatgaacatggaataactcaaggcgcgcattagaataactgagtaccaacattagaataactgagttaggaacataactgagtgggcacattacaataactgaggtatgatacaggataactaagggattggagtagaataactgagtgcgtcgattagaataactgagtaatgaacgcacaataactgagtaacaaacatagaataactgagggatcagaaccaaacaactgagtgccgacaccagaataactgagtctacacaccataataactgagttagcccacaagaataactgaggtattggaacagaattactgagttctggcaccagaataactgagtgcgtccattagaagaactgagttgttggaacggaataactgagtcatgaacatataataactgagtaggcacattacaataactgaggtatgacacgggataactgagggattggagtagaataactgagttctgtcactcgaataactgagtgcgtcgtctagaataactgagtaatgaacgcacaatacctgagtaacgtacaaagaataactgagtgttgaacatggaataactgagggcgcgcattagaataactgagtaccgacattagaataactgagttaggaacatggaataactgcggtattataacataataactgagggtttagaataactgagttaagaacatggaataactaaggtattataacgaaataactgagggattggagtagaactgagttggcccacaagaactgaggcatgagcagagaataactgagttccatcactagaataactaggtgatgaacacagaataaccgagtactgaaccgagaataactgagaaatgaacatggaataactaagtgcgcccactagaattactgagtaccgactccagaataactgagacatgaacatggaataactgagtgcgcccactagaataactgagtcatgagcagagaataactgaggtattagaacggaataactaagggatcggagtagaataactgagttggcccacaagaataactgaggtattagtccagaataattgagtacgtccattagaataactgagttgttggaatgaaataactgagtggcgaacatggaataactgagttaatagaacgcaataactgactgtgaatagagaataacggagtccccactaccgagtgattacaaagagaataactgagtaatgagcagagaataagtgagtaggcacacgagaataactgagtcatcacaccagaataactatgtgcgcccattagaataactgagttctgacaaaagaataactgagtgacgaacatggaataactgagtcggcacatctcaataactgaggtattataacataataactgagggatcagaaccgaacaactgagtgccgacaccagaataactgagtctgtacacaataataactgagtgggcacattccaataactgaggtatgatgataactgagggatcggaggagaataactgagttagcccacaagaataactaaggtattggaacggaataactgagttctgtcaccataataactgagtgcgtccattagaagaactgagttgttggaacggaataactgagtaatgaagagataataactgagtagtgaacatggaataactgagtgtgcacaacagaataactgagtaatgaacaatagcataactgagttacttgaacgcaataactgactgtgaatagagaataactgagtaataaacaccgcataactgagtgggcacattacaataactgaggtatgatacaggataactgagggattcgagtagaataactgagtaatgtcacacgaataactgagtgcgtcgattagaataactgagtaatgaacgcacaataactgagtaacgaactgagaataactgagggatcagaaccgaacaattgagtgccaacaccagaataactgagtctgcacaccataatcactgagttagcccacaagaataactgaggtattggaacggaattactgagttctggcaccagaataactgagtgcgtccattagaagaactgagttgttggaacagaataacagctgtctcttatacacatctgacgctgccgac

SEQ ID NO: 585 - DNA, 2267 bp, Zea mays
atggcaacatctacattggactttggaaatctggtaaaatgaatggcagaggagtgatgcaatggacaaatggcgatactcttgactgtaattggcttaatggactggctcatggaaaaggtttttgcaaatatgcatcaggagcatgttacattggtacatgggacagaggacttaaggatggacatggtatgttttatcaaccaggaagtaaaatgccttgtaaccttgaagtgtctgagtgtgtaacagaccacgatgtttcaagttcttcaagctctggtaatgaaaatatcaatagtagcttattgtttttattccaaaaactttgcaacacatggagactacacagcattttccattggcccagacgtatttcaaatggcaccacaccagtttttgatgataattctggaaacaatttgtcacaagattcatctactgtacccttgacaactgataattgtgtccaagatagtggagttgataaagtattggtctatgaaagagaatatgtacagggagtacttatctcggaaaatccaaaatgccatgattccggaatgctggatagtggtaaaacacaagagcatacatggcaaatgcaaactggagggcccatggagaccatttacaaagggcacaggagctattacctgatgcttaatttgcaacttggcataaggtaagtgcttaattgtattagtgtcttccattttttgtcatctgaattcatttttgtcaataataaattcttgtggtggttttcttcttctgggtcgttacatttatactgtgtgtacctatttaggacagttgtactttcagcacagatatgctacatctggaagaagcatatgcgtagctttcagacacagagctcacattatttatgagcaaagtattacttatgcaagaattattagcagtgggtagggaacattttgtttcagatgcataataagttctgaaaccttccaatatttgaacgacaacttaaagaatatcttttcaagaataatttggatatgctaaaactatgattttctttctttagtagtagcgatgttggatatcgtgtggcattatctacatacagtaagagttgccatggcatatttccaacacttcctgtactaattgtacgctgagcttttagggcatgtacacggttccagatctaaaaaaccatgtaggtagtaaactcaaacttaggaaaatttggtgaatccttagctcctctcaaaaagtgagcgatggttcccatactaaatcaaataacaggtttcctcacaactcccagcacgtttatcatgtgccagcatgacacagaggtggtacacctttttgctttccttattctcttggagctaaacctggattacttttgtttcaaaaacttttctttcacgaccaaaccaattcttagctcttctgcccgcaatggtatgcaccatggttttgcgagactaacaatccttagctcctctttggggcatgggttgcacatgccctatgatatatttagggaactgcataatacttatactaaattcaaacatggtatgcctcggtaaattaatctagtgaatgtccacacatcggtacctagttccctgttgctattgaggtatgcacagtcctttctaaccaccctttaatattgctatccaggtacacagtaggtaaaatcacccctgtgcctttgcgtgaagtccgttcaaatgattttggacctcgagcacggataagaatgtacttccctactgaaggctcacagtatacccctccacactgctctgtcaatttcttttggaaggattattgtcctatggttttccggtatatctctttcctgattgctaattgtattaagaatccagtatttccatacttgttttttctcgaatgtgtattgttctgttagtgttgaatgtgattcaatattgaaactatggtccatctatttctaattaactatgttgatctattatgattcaaccatctaatttactatagaagatatcaagtgtcaactaaatgaatgtggagtggttgatttgttcaacaaaaggaatttatgattagattgtctatgtttttacttgcagaagattgtatttcagaatgaattagaaactagcaagaatcttatgatcacacctctgaatcagttgtttgatttagcatgagtctgccaaacagcatcactcaaagcctcaacttgatttttttatggaagtcatgtttctctgttttactatgtt

SEQ ID NO: 586 - DNA, 2150 bp, Zea mays
ccttacaccacctcaaacatataatatcatttcttctcaactactaatccaagtaaactctcaagcacatttcatcgaacaccattatgcgtagccaatggcgcgctttgcagccaaaagatgggctccactagtgcggcggtaacggtagcggcaacggccatggtttgcaggcggctgtatcgaaggcggagtgaccgattttccctatgatttcccttataccacgtcaaacatataatatcatttcttctcaactactaatccaagtaagcaatcacgcacatttcatcgaacaccattatgcgtaactaatggcgcgctttgtagccaaaagatgggctccacgagtgcggcggtcacggtagcgacaacggccatggtttgcaggcggctgtatcgaagacagagtgaccgattttccctatgatttcccttacaccacctcaaacatataatatcatttcttctcaactactaatccaagtaaacactcacgcacatttcatcgaacaccattatgtgtagccaatggcgcgctttgcagcccaaagatgggcaccacgagtacggcggtcacggtagcggcaacggcaatggtttgcaagaagctgtatcgaaggcagaatgaccagttttccctatgatttcccttacaccacctcaaacatataatatcatttcttctcaaccactaatccaagtaaactctcatgcacatttcatcgaacgccattatgcgtagccaatggcgcgctttgcagccaaaagatgggctccacgagtgcggcggtcacagtagcggcaacgacgaaggtttgcaggcggctgtatcgaaggcggagtgaccggttttccctatgacttcccttgcaccacctcaaacatataatatcatttcttctcaactactaatccaagtaaactctcactcacatttcatcgaacaccattatgcgtagccaattgcgcgctttgcagccaaaagatgggctccacgagtacggcggtcacggtagcggcaacgacaatggtttgcaggaagctgtatcgaaggcggaatgaccggttttccctatgatttcccttacaccacctcaaacatataatatcatttcttctcaactactaatcaaagtaaactcccacgcacatttcatcgaacaccattatgagtagccaatggcgcgctttgcagccaaaagatgggctccatgagtgcggcggtcacggtagtggcaacgaccacgaattgtaggtggctatatcgaaggcggagtgaccggttttccccatgatttcccttacaccacctcaaacatataatatcatttcttctcaactactaatccaagtaaactctcacgcacattttatcgaacaccattatgcatagccaatggcgcgctttgcagccaaaagatgggctccatgagtgcggcggtcacggtagcggcaacgacaatggtttgcaggaagctgtatcgatggtggagtgaccggttttccctatgatttcccttacaccacctcaaaaatataatatcatttcttctcaactactaatccaagtaaactctcacgcacatttcatcgaacaccattatgcgtagccaatggcgcgctttgcagccaaaagatgggctccacgagtgcggcgttcatgaaagcggcaacggctatggtttgcaagcggctatatcgaaggcggagtgacggttttacccatgatttcccttacaccacctccaaaatataatatcatttcttctcaactactaatccaagtaaactctcacgcacatttcatcgaacaccattatgcatagccaatggcacgctttacagccaaaagatgggctccacgagtgcgtcggtcacggtagcggcaacggccatggtttgcaggcggctatatcgaaggcggagtgaccggttttccccatgatttcccttacaccacctcaaacatataatatcatttcttctcaactactaatccaagtaaactctcacacacatttcatcgaacaccattatgcgtagccaatggcgcgctttgcagccaaaagatgggctccacgagtgcgacggtcacggtagcggcaacgaccatggtttgcatgcggctgtatcaaaggcggagtgat

SEQ ID NO: 587 - DNA, 2266 bp, Zea mays
agataacatgctcaaacaagtgatgtttacggtttggcaatgagcaaattgtaatgtaattttccttggttaatttattttgtgacaaatatcaagactcacatacttgttttttgagtggcctcaaatcatgcattgttgtccataaccaggaatcatataaaaaagcactacatatgatgattcttgtgaaacaacatgttgcatagctcacgcctatagtaaattgatgatccgaaaaaatctacatgttgtgcttcaagcgcttttagagtcacctcatcctttatatgaccaaatctactgctagcatgcgacaatctagggtcgcatactcatgttacggttgtcttgaacatgggttaatgatggtgcatgcgaaacaacacgttgggtcaatctgtaaaaactgtctgtctaaacaatacaacatttagggcttcaaaatgcttcgaagttgacacacatcagaaatcgatatatcatgcagcaaacttgtacgaatataatacccatttgtcccatacacatgttttgatcggccttaaacttgggttgatgtgttcacaactgaggaacattgcaaatagcactatatatgtttttaaggtaacatgcttaaacaagtatgtcttatagtacgacatttagaaaagagtaatgaaagtataaatataaattttcttccattaactatttttccattaatagacaccgtaactctacaaaatagtttatcttgaaaaatctgcatattgcaattcaaatacttctaaagttacctcatcctttaaaacactaaaccttaatcggcatgcgaccatctaattatgtgggtcccatactgaagttattgagtgtgttgaattttagttgttggtggagcgtgtaagacaacatgttggatcattctgtaaatctaccaaataatttagggcttcaaaaagctacaaagttttcgtagggttcatgccacaatcttttcgaaaaaacatgcacaaaatcatgacactttactcccaatcagtgtattgcgaaaacattgatgacaaatcttgttgggtcatttttgtaaatactaccgttccaaacattacgtcattaagggctttgaactgctacgaacttacattaatgtccataacaatgaaacatttaaatctttccacatatcttatgagataacatgcctaaacaagttatgtttacagtttggcaataaaaaattgtaatgtaattttccttggttaaattgtattttgataaatatcatgagtcccatatttgttttttgagtggcctcaaaacatgcactattgttcataaccaagaatcattcaaaatagcactacaaatggtttaaaacagcatgcctaaactaatgttatttatagtctggcataaagcaaattgtaattaaaattggaatgaaatttttttctatatttaattctttttttataaatatcattgatataattgtaatagaataaaaacaaagtatcttaaaacatggatcgaaataaaagaaaaattgcataaatatagctctcaactctggaaaattaccgatcttaaaaatatacatgttacactttaaacatttctgaagttacctcattcttcatatcaaacaaactctagtgccagcattcgaacatccaatatcttgggcccaaactcatgctataggttgtcttgcacttgggttgatgatgaagcatgtgaaacaacatgttggatagctcacgtctatagtaaagtgatgatctgaataaaatctacatgttatgcttcaagcgcttctagagttacctcatccttcatataaccaaatctagtgcaagcatgctgcaatctagggtcgcatactcatgatatggttgtcttgaacattggttaatgatggtgcatgcgaaacaatacaataagttgggtccatccataaaaactatctatctaaacaatacaacatttagggcttcaaaatacatcgaagttgacgcacaccagaaatcaatatatcatgcagtaaacttatatgaaattaataatcattagtctcatactcatgttttgattggtcttaaacttgggttgatgtgttcacaactgaggaacattgccaataacactatatatgttttcaaggtaacatgcctaaagaagtatgtcttacagtacgacatttagaaaagagtaatgaaagtgcaaatataaattttcttccattaactatttttccattaatagaggtcataactct

SEQ ID NO: 588 - DNA, 2263 bp, Zea mays
tagcgaaaactttgaagcttttcaaagccctaaattatgtggtagatttacataatgatccaacatgttgtttcacgcgctccaccatcaactaaaattcaacaaaatgaataacttgagtatgggaccaacataattagatggtcgcaagccgattaaagttaagtgttttaaagagtgagataactttaaaagtatttgaatttctatatgcagatttttcaagataaactattttgcagagttacgacctctttcaatggaaaaatagttaatggaagaaaaattatatttccactttcattactcttttctaaatgtcgtactgcaagacatacttgtttaggcatgttaccttaaaacatatataatgatatttgcaatgttcctcagttgtgaacacatcaacccaagtttaaggccaatcaaaacatgagtatgggactaatgagtattaatttcatataagtttactgcatgatatatcgatttctagtgtgtgtcaacttcgatgcattttgaagccctaaatgttgtattgtttagacatacagattttacggatggacccaacttattgtttcgcatgcaccatcattaaccaatgttcaagacaaccataacatgagtatgcgaccctagattgcagcatgcttgcactagatttggtcatatgaaggatgaggtgactctagaagtgcttaaagcataacatgtagatttttttcagatcatcactttactatagacgtgagctacccaacatgttatttcacatacttcatcatcaacccaagtgcaagacaacctatagcatgagtttgggcccaagatattagatgttcgaatgctagcactagagtttacagatgtggagaatgagttaactttagaaatgtttaaagtgcattatgtatattttttagatcggtaatttaccggagttgagagctatatttttgcaattctgcttttattttgatccatgttttaagatactttgttattattctattatagttatatcaatgatatttataacaaaagaattaaatatagaaaaattttcattccaattttaattacaatttgctctatgcgagactataaacaatactagtttaggcatgctatcttaaaccatatgtagtgctattttatatatttcttggttatggacaatggtgcatgttttgaggccactcaaaaaacaagtatgggactcatgatatttactacaaaacaatttaaccaatgaaaattacattacaatttgctctttgccaaattgtaaacattacttgtttgggcatgttatgtcataagatatgtggaaagatttaaaatgtttcatggttacggacattaatgtaagtttgaagacgttcaaagccctaaataatgtaatgtttagaatgaaagtttttacaaaaacgacccaacaaggtttgtcatcaaagtttttgcaatacaatgatttgggagtaaatggtcatgatttcatgcatgttttcttgaacagattgtggcatgaaccatgcgaaaactttgaagcttttcgaagccctaaataatgtggtagatttatagaatgatccaaaatgttgtttcacacgctccaccagcaactaaaattcaacacaatcaaaacttgagtgtgggacccacataattagatggtcgcatgccgattaaagtttagtgttttgaagaatgaggtaactttaaaagtatttgaattgtaatatgcagttttttcaagataaacgattttgcagagttacgacctctattaaaggaaaaatagttaatggaagaaaaattatatttccactttcattagtcttttccaaatgtcgtactgtaagacatacttgtttaggcatgttaccttaaaacatagacaacctatcgcatgagtttggtgcccaagatattggatgttcgaatgatggcactagagtttgtaattttctggattgggagcaatatttatgcaattctgcttttattttgatccatgttttaagattctttgttattattctattacatttatatcaatttataacaaaagaattaaatatagaaaaaatttcattccaattttaattacaatttgctctatgcgagactataaacaatactagtttaggcatgctatcttaatatgtagtgctattttatatatttcttggttatggacaacagtgcatgttttgaggccactcaaaaaacaagtatgggactcatgatatttatt

SEQ ID NO: 589 - DNA, 2261 bp, Zea mays
ccaaacaagtgatgtttacagtttggcaatgagcaaattttaatgtaattttcctaggttaaattgttttatgataattgttttttgagtggcctcaaaacatgcaatattgtccataaccaagagtcatttaaaatagcagtacatatggtttaacataacatgcctaaactagttttgtttatagtctcgcatagagaaaattgtacttaaaattggaatgaaattttttctatatctaattcttttgttacaaatatcattggtataactgtaatagaataataacaaagtatcttaaaacatggatcaaaataaaagcacaattgcataaatatagctctcaactccggaaaattacagatctaaaaaatatacatgttgcactttaaacatttctaaagttacctcgttctccatatctaccaactctagtgcctgcattcgaacatctaatatcttgggccccaatctcatgctataagttatcttgcacttaggttgatgatgaaggaggtgaaacaacatgttggatagctcacgcctatagtaaattgatgatctgaaaaatatctatattttatgcttcaagcgcttctagagtcccctcgtcctttatacgattaaatccagtgctagcatgcgacaatctagggtcgcatactcatgttatggttgtcttgaaaatgggttaatgatggtgcacgcaaaacaacaagctgggtccatccataaaaactatctgtctaaacaatacaatattagggctttaaaatgcatggaagttgatgcacattagaaataaatatatcatgtagtaaacttgcacgaaattaatacacattagtcccatactcaagttttgatcggccttaaacttgagttgatgtgttcacaactgaggaacattgcaaataacactatatatgttttaaggtaacatgcataaataagtatgtcttacaatacatcatttagaaaagagtaatgaaagtgaaaatataatttttcttccattaactatttttccgttaaaagaggtcgtaattctgcaaaatagtttatcttgaaaaatctgcatattgcaattcgaatacttttaaagttacctcattctttaaaacattgaactttaatcgtcatgcgaccatctaattatgtgggtcccatacacaagttattgattgtgttaaattttagttgatggtggagcgtgtgaaacaacatgttggatcattctataaatctaccacataatttagtgcttcgaaaagcttcaaagtttttgcatggttcatgccataatctttatcgagaaaacatgcacggaatcatgacccgttactcccaaatcagtgtattgcgaaaactttcatgacaaatggtccatttgtaaaaattaccgttctaaacattacatcatttagggctttgaaccgcttcaaacttacattaatattcataaccatggaacatttgaaatatctttacatattttatgagataacaagtccaaacaagtgatgtttatagtttggcaatgagcaatttgtaatgtaattttccttggttaagttgttttgtgataaatatctcccatacttgttttttgagtggcctcaaaacatgcattattgtctataaccaagaatcatttaaaataacactacatatggattaagatagcatgcctaaactagtattgtttatggtctggcatatagcaaattgtaattaaaattggaataaatttttttctatatttaattcttttgttataaatatcattgatatagttgtaatagattaaaagtagaattacataaatatagttgtcaactccagaaaattactgatctaaaaaatatacatgttgcactttaaacatttctatagttacctcattcttcatatctacaaactctagtgccagcattcgaacatctaatatcatgggccccaaactcaagctataggttgtcttgcacttgggttgatgatgacgcatgtaaaacaacatgttggatagctcacgcctatagtagattgatgaaacatgttggatcattctgtaaatctaccacataatttagggctttgaaaagcttcaaagtttttgcatggttcatgccacaatcttttcgagaaaacatgcacgaaatcatgaccctttactcccaaatcagtgcattgcgaaaactttgatgacaaatcttgttgggacatttttgtaaaaactaccgttctaaacattacatcat

SEQ ID NO: 590 - DNA, 2260 bp, Zea mays
gtaagttcttcctcttaatggtcccaccgtaacattcttccattgtcttaagttgtttccacacataattctttttcgtttgttatgctgaaatttcattgtgcttctctcatcttaggatctagtaagctttctttagtttttaatctcttccctaatctcttcaccaattttttgggatccgaattgtcaatactaatatatgaaataaagttagtcccaacaattcggatcaccaaaaaattcaggaagatattaggtaagagataagaaaactaaagtaagcttccaagatcatgagattagaggacagtgaaaatttagcaaaataggaaaaaaagaattttgtgtggaaccagcttaagacaatggaagaagattacactgggaccattaagaggaagaaaatagaggtaaagcaggctactgaagccgctaaaaagtttttgcataatgttgatgagttgaaattgggttcccaaaagaaggatgatgaaattgttagactacaaatagtggcgacaaatgccaaaaagaggatgttgtttcttgaggatgagctgcaaaaattgttgtctttggtcaaggataaagatcttgaaatttataaaaataaaatcaaccagagactaaaatgcaagatttagttgctgttcagattaactaatccaaacgaggcctaactatatgaataggtggttagcaggttactaggttcttattgggtgagaaacttttgatgccggtggattttgctatgtgggtaaaccctgaatcatgtcacatccactcttctcaagactaaacacaagagttaggtgcagattagtttaactatggcctatataaaataatgtggactaacttgttctctatagacatttttttgtgatctcgtgggccaaaagttagacgaaaagttacctacttctccacgagaaagttgcaattaataacatgcatgttggtcaaactgaccactcagacccaattgcagcaagatttggcacacagacgaactgcaaacataaatgaacagtcaggactcacaaaatcaataggctggtggtattgctctccctctctctcactcactcaccaataagacatgtacacaactctctatcttgtgagtatcaggagcatcatcttgatagctttctcctaccagagcaccacactttctcatagcactagatggcacatcattgatggatccctacatacagcgctggcacccattaaataaatagaagtagacgacgacatgcctagaaactacacctctcgtctcgtctgggccacatgatgcacgcgtattaccatgagaagcagtcactactccaggccaaccgtacgtgtctctccaaacataggccgcactagagcgcgttcttcaactaatggacgcaagactcgcactaaatgcaggcatggtctgcatgcataaggcgccagcccgcacgcctcctccgttgctccatgcatatggggcgcgtcctttggctctgtgatccacctgaaccgctccactttttcatgtactcatcgttaaactccagcaggtttcatataaactcatgcatagtactatatatggcatggtactccggtcgaaatccaggactgatggtctgatgtgctgcacgcatgtttggtaggcttcacacatcagtcgtgcttgcttgttcgtggagctagcttgctagcctttccctttctggtgttcttgcacctagctacagcaaatcatgagagctttcaagcccgttgtacgtgctagaggccagaggctctccctagctccatctgaaaaaggctgcaacaggtaatgacttttgatcgagccgctactgctggtgcttcatctcttaggctctctattgatccatatccatgtttggtactagaacagcgtggtcgtcagcaccacacacaacattgttcggtcctagtgcaatgatggcaccttgatcgtctttcttcgtctccgtcaaaaatgaactaataataatattcaagaaaaacaaactttatatacggtcggtcgtacttaattaaatctaatagttaatgtaataaataaagcaacaaattcaaaaaagggattacattatttgagtatttagttcatgaataagttggtcgccatcaagtcggccgtgatcttgttatcaatgacgactgtctaaacgataatggactccaacgtggtcgagtatgtcattttattccacagaatttattaggggactgttga

SEQ ID NO: 591 - DNA, 2152 bp, Zea mays
actctcaaacaaaatactcaaagtgtcgttctctaatcagttttatccgattcggcttaatatctctttatccaatccgattgcaaaaatcaacatcggcgatgatttttaaatgtcgcgatttgtctctttcaatcataaatccgaaagccggtcatatctcgagacgatttattttcgaatcatgcgcgaggagttatttccgagcgaattcaaatcatactctcggccgaattaatcgctcaatcgtccgttcgtccgaactctttttcgctctgttctccatagagacaaattccgcaggatcatttgtattccagaaaatatttagcgtggcttgattacgtgttttgggccaagcccaacctagcccatttggctcatttgaaaccctaaccctaccacatgtctataaatatggaccccttccctttcccttggccatttttcactcccacccctattcttttgcagccgacactctcttcttcctcctctcccccacacgcacaactctcttcttccctgttcatggcgcagaaaatctcccagccgatgctctccccctgctgcccatggcgtcttatccacctctctgcttgggtgctggccgagcccccttggagcaggcgcctccagcagccatggcgtccatccctcctccccttcttcttcctcaagcaagcagcgcccttccctgtgctccagccgacctcctctgcccgcgctcctcatcccacacaacaacacgcagggagcttcctccatccatggcgccctcctttcttccttctctgttccagaccggcatcagggtagtgcgcgcaaggctctcctagccgtggatagcacccttccctccctcggattccctgctcgccccagccatggaccatcgcgtagagcgccatcggcctcttgagcacgctctccacggccccggcgtttccccctgctatctcctccccatggccgcccgcatttccttgctgcggctccttcccaaggccagcgcccctctcctggttggctccctctccacatcagcagctctggatttctgtacgccgacatggaactgcgcagtgccccgtggtgcttgcagggtgctcgacaaaatgcgcagcagccccgacgtctccgtgcactgccggctcgctgttccgtgaagcacagtggacagcacgccgtcgacgctcaccgatggtttgctgtttttgcgcagcctcaaatatcgacgccgttcaccccggtgagaccgcgatgctccttgttcgattccgcatcggcgttattttcatatgattaattgtgtatgtgtgttgttttttttgtttgtggaggaggggaccccgtgttttgcgtgcaggagaaggcaagccgctcgacgctcgtcgatgttcggagtgatgcacaaatcggaatcgccatcattcttacaaacgtcgattgggtttgtttatggtgagtcgatgcatgtcgctctcaactgactcgattaataaattatatagatgtggtttaaatgtttcggcggtaggtcgtagtatggttgtgttcatgatttcgagttagagattggtggttgatgattcgtataaattggtcgatgtggtgcatgtgtaaaaattgtattggtatggattgaagtttgtggcgaaaaaaaagaagtagcaaagaactcgaatgtttttatattttgataggaatatatgcgatgtgttgttgatgtgtgcgatttgtagtttgtacaattatattttagttgatgtggtgtacattggtgttggagtgtgtgtgggtataaaatgttttggttatatgtcgtagcaaggttgccttcacgttttggtaagcaaacatgttgtgttgtttaatgtgatgaataaattggaaatacatgggatgcgaggatttaattagtgcacgtaggtgtgtgtgtgtgccgtggtgtgatatagtagtggtggcgtgagatatttgtttgaggtgtgcgggtatatgtcgtgatatggttatactcgcaacgagaaaagatgtacacattgggtaacacgacacttaggtcgctgttgtataatcgaataaaggatgtattattgagcttaagtcaaaatgtggggtactagtagttatgctttttacaaattca

SEQ ID NO: 592 - DNA, 2257 bp, Zea mays
tccttctcccatggcgctcggcgcccctgcagcacggcacccttcttccctagtgacgcctctgctctagccggccttcttcctttccaccatctgagcgcccaagtctgcgcccttccctgctccatgggcacgagctccaccccctgcaatggacgctgcgcgagctcaccccatgggcgcgttccctgctccacggccagcaggaagccagcgcccctctcctgctcggacacatctgcgcacagagagttcttgcccacgccaccctctttctttcccatgaagcaagcagggaacacgaccaatgttatcttcctcccatggctgcctccctggcgcgtctcacctctggtcagcgccctgcacagcgccctctctccaatggcgagcagctttcctccccatggtcatggtctgcgataggaagtcgcgtgctacatgtttgaggttttgcgcagcagccctgacgtctccacgcactgcctgctcgctgttttgtgaagcccactggacagcacgccgtcgacgctcaccggttgtttgctatttttatgcagccccaacatcaacgtcattcacccccggtgagacacccctctacccttgctgctatcatatttttgtgctcggtaaaatgttgaactgttgtgtgtgtcgaatcgcagctagccgtcaatgccatctgtcgtgcacgcgtgttcgatacaaggccggtcgggtgaaccacatgcatgcacaactcgaatctgatctagtccaggttgattgatttatagtttaccatacgtatgatttggttgatgtcatgcagtgcatgtatatgtgtggatgtgtgtaaaatgtttcggttatacacactagtagggtcacatttgcggttggagaacaagaggttgtttgatgtgtgcgatttgtagtttgtctaattatgttttggtcgatgtggtgtatattggtgtttgaatatgtggctgtgatggttcatttatgtgtcacgaggatggttcgtggaggtattaattgtttgttaaaatacttcgtcgtaaagcagtgtgttaattgtggtaaatctaataaagcgtaaagcaggcttggtggtttccgcagtcggctaatgagttagtctatgttaaatatattttatgtattcatcgtggtgtgggttagggtgcattgaaaatataaattatgtgacatgtaattagtattttaaagacgagatgtgcgaataatcagttggtgtttcactcgtctagtcgataagtgttgtcataaataattgtcctaaaatttggttataagaatgtagtggtcacgtggtgttggttggatgtgataagttgattggaagtgtgggtttgtctgagcactgtgttgtcgaacgtgtatgtcgaagtgcattgtagtaatgattgcgttaattaaacagtaatgtctcaagtgcacgccacaatatggttgtatgcgagacggggttacgagcatggtgagtttagtaaaattccatcggtgtcacttgtgttaagttgaggtttatttgtgcgtggaaagtagtaatgtctttaatacttagaactcttagtcgatggtagaaattgtcttggcttaaatagagaggtggtgacatgtcaaggtagtcatcatttcttctatattaataagttgagtcaatacgcgtatgcattcattaaatttcacatcgcccatagtgtatggttgtgttcatgacttcaaatagatgtttcgagtggacaagtaggtttgtaatgcaagatgtgtgatgaagttagtttgttgtagaatatttgttgaaatgctccattcatgtgatagacatgtgtggttaattcaaatcgagtcgatgtgtgtgatgatgatattcatgaattaagtagatgtcctatataattgtgtagtgaagcttaggttaagttgcaagcgatgtggtaatgtttggtaatgatatatgtgaaatgtgaacgagacatccaatgtattcggtatgttgcgtagtggtggtatgcaaaatggtttagaaatcgatcggctaaatgccaagttcggttagagtttttttgttacatgggattgtgtggtgaagcgatggcatgactgcgtagccatcatgtcatctattaggtgactatgcttaattatgtcttgatataagttagaataattccagtctctagaacatggcaattcttgaattatacaggagctgaaaattattaattgctgttttgggctgcac

SEQ ID NO: 593 - DNA, 2252 bp, Zea mays
aaaacatacaccaataaataaacatacaccattcaacaaacaatgaaatatacactttacaaatcgtacttaatttgtaacatctactataatttgtaactataataaaacacatcaacgatcatctcatttgctacgacataacatactatttattttgtttacatatttcattagagagatctatgtggcaaatttgactatggaagtgtactatataaattcattaatatcgatatagcgctaaaccaaactctatggagttagtttaattagctaatcaattatttctaccggatagtatgtggggtatatttattatttctttctaaaataaaattatagtagatgttacaatattatttaaaaagtcacgtaaccttgatatttaagagaactaaattaacctaccaatttaattccactatttagtttatagtggacatagtcgctatattattttaatattaatcaagactccaacatgactaatgaataagcaatttgtgtataatcgcacatacgcacgcatacagtttgactaaaaatctatagtccatcttaagcaacgataacagtagaattatgcatataatatttttgttacaaatatatggtctatctatcccttaatcttttactctaacaaactatatttaaattaatgtcaacattcatactcaaattaaaatacacaagggcaaacgatagcatacactaattagaatagatcatcacatacatatgagattaatcattcggtatatacacttaattttcaaactcaaaaatatacaactaaaattacataacgatacagaaattagatcgtgatagcacataaaatcacgtgggcttattttctcttcttttgaggtggaaaattttgtctaaataatttttacatagtgttaggggctagattcaatcgtgttcaccttgttgtttcttgcgccgaggtggatgggggcacggctggcggttggactaccgagagggcgaggtcagcaggcgtcggcgaggaaagtcaccggagctttgggttctggcagcggtcgacgaagggctccggtagccactagtgatggcgcacggtggctgcaagcgcagacacggcaacgagcaacaagcagcagtgacacagcacgcagaggcgagtgtacgaggaagagagcagcaaggatgagcaggaaaagaaagaggctcgcagacgcagcttttatagccggaggtgggtagagcttcgcgactgccgttgaacgtggattgaagagctttgaaatccattaatggtgatttacggagcgacgccagaaacgccagaaacgtccgatgcaatgactcggcttggtgtaatggagggaggcgagcaggtcgcgagaaagggaggcgcgagggcgcggctgcgtgcgatagcgaagggctggccggcggcgctccagcctaaacagcggcggcggcatgtgttgactttcaacgtgttagaataaaccacgtcatatgtggttgtgacgtgtgtgttagctagccgtggcatgcaagtgtacatgtgtgcacgtgcaagtgagtagctagctagcaccaagttgagtcagttgttagtgcgtgcgtgtgctctgtttagttagatttagtcagcagcttggggcgtacgttgcgccgatgagttgcatgcaggagggcatcgtgatccgtccggtaaagcaggccgagtcaagcgcgtatgtcgcgtcgtgcgccgtgccatgcggatcagcaggtggaccggcaacgaggagttcgtgctccatcgtgcgttgccgtgggcctataaaatggcatgtaatcttggaacaaggtgcggcaaggagtgaagaacgagcgtgtgtgcgctaggtgcgtttggcgccattgtcttgtgtccagctactgttcatctatgctcttggcattccagcgagtgtgtgagcgccggtagattctaacacaacgatcatgagaaaaaaatcaagagagagaagagatgagctggacaagcccacatgtcagcctaagtgagaaaggatggaacgtgggtaccgagcctggcactcacgctcacggcacaagcattttttaactgtttttttgtatatttagttatacgtttaagaatataaatgaatacacgtttaaatattgggaacgataaatccaataataatatatattcttttcctagtgaaagtgaattaaattagattgttttaaatagatggatttgaggtgttaca

SEQ ID NO: 594 - DNA, 2252 bp, Zea mays
catcctgacctgccttaccgcgctgtccaacttgcagttcctcaccatctcccacaccatgttcagcaccatctcggagtcactggaatctgcatactatctccaaaatatgagaaacactaaagattgcagtattcttttaggtcatgtttttttagagtgcaggtttacatggaattataaaagagtagatcatgataatgtagactaagtggtaccttttggaaaagaaagctctatactaatatcctttctttagttgatgaaacaattgtgtcctcataaagatgataagatataaaatatggttaaaacaatctttatgtttaaaagcaaaacaatccatgacaaaagatagtaaattaagaattccaactacgaaaaaagacagttgcaaagcagtactctagtattcttaactccacaaagcaataatcttagttgtgattaatcacaaccgaagtcagaactaacaaattccattagaaagaccaatcatctccagaaagaataactacaaaattaactcaatgttatcttttttcaatccagtgatagaagggaaagtgcagcatccaaatttgattggtgtgctaaaacgaaagaggctttgaattgttttgtgtgttgtcatgccatatctatgatgacatactgagtttagtgcttgggtggccttgaaggcaagaggggtctaagagcatctccaagagctccctagaagtctcccctaaatcatgttttttgggaaaaacacaaaaacgtgtcaccaacggttcctctaaagtgctcccatctttttcatagcccttaaaactccctcatttgtagctacaaatggggtttttttgggctccccaaaaacaatctatcgctttaagagatgtgttggagaaaggattaaaatctaccccactaattttttagatgtccttaaaactgattttcaggagtcattttctagggagctcttggagatgatttaaggaacatgttttgcagtagcctagaatggtggtcctgctatgtcattttctagggagctcttggagatgatttaaggaacatgttttgcagtagcctagaatggtggtcctgctatccatctgcatcattattaataactagccaagtgctcgtgagttgcaatggcatataaaaccagattctatcacagagctctaatttagatatacatggctacaaattgcaaatcaattttctaagtgacgagtttataaataaaatatacttggaattgagcaaacgtcttattcatcacgccagaactcgcaatatcagatggcctataggtatcacaaagcgacaaaggacaattcttgatatctattttttaaacgagtatatatgcaggttagcttatcattgtttggtgacgatttggtagcaatgattggttttcaaacgactttgataatgagatgttaaatataacaatgttgagtcaaagtcacctaaagaggtatgacgacattttatttatggtaagcaacgacagacaaaacacttgatgcaatattttgaccaccgatagaaagaatttcatatccattacagactatgttagtatataaaactaaaattattcaataaactgcaaccgaacgcaaaggctccctgcatacttggacctctgccggcacttccacttaagccgcctcttccactgcataccagacaaacaagaataccagatggtagagtttcatcaaaatgaagcctttattttgaactggatcaaaatgaagacaaggcaaaagggaaaaaagaaaaacaaatagcgacacaaactgttattgtagagtttcatggatctaatcataatgaagcatcaatcgcccctcttcatctctaaatgatcacaagtactacatcccaaaaaaataccagattatgacaaaccacaaaaaaaggtcaaagaggaggctacaacattcaaaatgagtaggaggtatttctcgtcacttagatcagacaccaaatattcaccaaatattttagaaacctagatcagaatgattaggagtctttggatggattgtgaatctggctacagaaaagtaggcagtagcagagggtaggtagcttatctttatatttacaactaattaagaatgtagtgtaggcgtgcacacacggttctgcctccactcgcacccgcgacatccacggctccgctccgctccctcccatgcccgcgcatggatgccctcgcccccagatctcgcgca

SEQ ID NO: 595 - DNA, 2310 bp, Zea mays
attatctagtttaatatctgatgtggattttgcagtagcccttaaatttaaaacatgtttgtaagattttgatattatgaaaataagtgacaaagtaaacccaatagactaacaacagaaatgccacaaccttatacttttttcatgggaatgtttgtacatacataaaaagtttagttgtgttgtgaacaattaaatatacatcatttgtgacattggaccactaatgataagcaaaattagagcatgaaaagtatgtatttattattttaaattgcaagtatgacaaaccgttaaacaaataattaaacacttgtaaaaactattataagattacttatagaaacattacccacccctagtctttttatttacgagaagttttaaattaattaattaagtagatgatagttaagacatcaccagttgcagcaacaatgagatgaatcggaagtagtacaatcctacagtatacaaagatcaacaacattggaatatcaagtacacaattttaaaaaacataataatttgttaatagttgaagaaaatcgttaaaaaaatctaccaaaccccaaccaccaaactaaattttaaatgtatttattttggtttggtgcttggtgtttgatattttttgttgaaagtttttcttcaagtgtcaacaaattatgatttttttaaaaaatttgtcattgatgttcttgtgttgtcgatgtaggtgtactctgggattgttttgcttcggttctcctctatttgctataactagtgttgctctagctattatctctaccaataaatctgcctaattgattcatgacttgtcatcaatataaagactagaagtggtcaatgttcgtataagtgtttaataatatatttaagagtttgtcttaattgcaatgaaaaactctaaacacatgcttttcatactctggttatgcctatcattaagtgtttattgtaacgaatgttgtatattcagttatttacagtacaactaaactctgcacgtctttataaactttactagaaaaagtatgagattgtgatcatttcttttgtcagtctatttgattttctttgtcacctattttgtactatagaaatcctacaaatatgtataagtttgggagctactgcaagatcaacaccagatgttaaaatagatgagtttgtagtgttggtgagagatgtacttagaatgtttccatttgactataaaatattttgaagtctcataatttagcgcttaacccaaatactttctatagatcagtggttgtgacaaaccacacaaagatacttctcttgatatatacagtgagggattgttttctttacctttttgttatgttttcctatatgcttacaatacatgtctaaaaaaatactacccacacaaaaagaaatagaaattttttctatcctgatcacattgcacactaataaagtataccaagaaatcgaaggtcataagcacaaaattgtttgtcctgaaatcatatatgcaaactcgaattgaatgtaattttgagggcattaagcttactcataggactcgagtctttagtcttattggtaaaaaggttgatacaattcaataatataatgagtagattaaggaattattactaaaatggaggctgaacagaacactatacttcatgacaaacaacattgtgctaccattgtcctctcgaattggagattcgtcgccacttcttcatctcagacttcgcatgctcaagtatatgataaatgcgcatttatggaagctcaaataatatgatctaacctttaaggaaatcatatgagaagcaaatcaaacaatttgtggtttatgttgttgtctttgtcattgtttttttatatggtacatctcactgctatctatactgttacattttagaaaacctagaggagaagctgctcttgctcaaagtagtgctggaccaaccaaaaatcaagacggtcttggacacctatctttctcaaattccactcattgtattctttgcatcgctatctactgttcttattgttagagtacccgttagggttttggttatctcttgtgcatttaccctctcgcccctactgttctagtacgaaaatactagatatcgatatcacattattttatgacttagcaggtagagtatttttaagcggatcacaccatgcctacaattctattaacatattcttcacgctactaattctcctcattccacaacaaagaaccaatttaaacctaatcgacatatgcatccaccacaacattcctttgtatgactcatatttcaa

SEQ ID NO: 596 - DNA, 2247 bp, Zea mays
  misc_feature (2101)..(2101): n is a, c, g, or t
attcgctaaatcaaaatcgtgactgtgcgtccgagaattataattgagcttcgattctcgggtaaattaccgtgaccatggaatcatgtattctaaccgcagatcaaatatctcgtgcttcgaatcgaatcaaaccatgtcacaaatactatcaaccttttgattatcgctacaaattgtgactcaaaatatcagcgattttctttataaaaaaagagaaatgagaaaaaaatatctcccagccgtcttctactctatcttctccaccgctcacgttctcagattttctttcactgtgttggccgtcggcctcatccctggccattcttatctgctggctggcactgccttctttgatattccccaccgtgtacagctaatgaccttatccggttatcccaacgtgagctcgtcttctctccatcccctgcctttatcttctccagccgtcctctgtttggttattttccagcgcgtgcagctccggctcgttccccatggtggccgcggtcgcctctccctggcgtgctctgcccccatcgccgcgcaccccttcctcctccagctcggtgcccatctccatggcttgccctgcgcccagccgccgcccctatgtacttctctgctcgccggaatccctttgtcattgccatggcagccgtccgaccgagctcaaaccctgcccatctccctggtcgcgacccccctcagcttcttctccgtggagctcgcctctgcgcctggctcctactcgtcgaatctccagcggcgccgtcgccttgctgctcaccagcgtcttctctgcccctgcgcatccatggcgatttcccctgtggcagcttcctcggcgcgcagcctccctcccagctcggcctcttccccgcgccaacttggagcttccacggccgcaccaaattccccatgcgcgctgtcgtccgctgctcgaagcttccatgtcgcgcgtcgtgcttctctgctcgccatggtggcgcgctctgctcgcccatggagttgcccagcccctctgctctccgttttctttgtttgccgcgcgcacgaattttatctgctcgccacagcgtgtcgagctcccgcaccatcatcgcttctgtcgcaagctcgttagccacagttatcttgaccgcatcagcacgtgactgtggtcgtgttcgccaggttcgccaacacgctgttgccaattcgactgtcgtcgcggttgtgtgcctcgctgtgtgctcgtcgagtgttgttggttgtacctcagcactcgtgtttgcctctggctcgcgttaacgctcgcgcgtctgctcgttgtcactgcgggcactcgctctcctctatcgggtttcgcgcgtgctcgtgtttgccgtcaagtcatcgaacccgtcatcccctgctcgacccccaccccactagctcgctccaaacacgatctcgtcgtcgttcgtgcatctccaagaaatcccaagcgtcgggtgaagacgaagaccagcagcgtggtgttcaccaagtgcgcgacaaaaagctcagccatcctgtgcgactcaagttcggttcgacaaaattattcagttgaggaaaagatcttcagtaattgattaccaaagaaaagaaggcctctggataacgtcaatcggaacccgtagtcgtgtttgcgactatcgcgttgaattattcagggtaagtaaatttgttactcgtgttagtggattggtggatggtttgactaggtttaatatttattgtttgcctgagtcgttttagtaatttggtcgatgtcgtaagatgaaaaagatctcaataggtctcagtggttgcgggactataggtgttaaaaatgaaaagttttattaatatataaggtacacagtttaaagagttaataaaaagttaggaatataaatagatgttctagttttattatttcaatttggttaatacatgtaatcgatgccctgctgtaatatccatggtgcttaatgcttgattttaagtgtttcatcctttttagtatagagtatctatcttatactccttatactcgtgctcatacatgtgcatcgtgcatctcatgaggtacgataattaatcgcgtgatgcngaagacaagccaagtcgacccaagcgcaggctaattcgcaggatgatgctgatggattaacctgaagatggataatcagaacaatgcgaagacaaaggatggtcgtcaagtggacgccacctaacaacactaaactagtgttattc

SEQ ID NO: 597 - DNA, 2247 bp, Zea mays
cttgcttttctatttttggaaataaaagcatgaaagtgcaagcagaaaaactatctagtctggccaccccccgcaacgcgcgcgcggccctcctcgtcctcctcctctcgcctctcccagcaggccgggcagacccccggccggccgcctagcttgtcgcccgctccttgtagctcggatcccgcgcgtgcaataatggccggcttcatcaaccgccacatcctcccgccgttccgccggccgccgctgccattcttccgcccgggtggcgcggggtcggcgttgcccgcgggccggcggccatggacgccccgtcgcatcctggacccgggcgacgacgccgtgctccggtggtaccgcctcttcttggtgacctgcctggtgggcctgttcgtggacccgctctacttctacctgctgcacacggatgggctggcggcgtgcgtgtccatggacatgggcatcggcgtgctggtcaccgcggtgcgcaccttcgccgacctcttctacctggcgcacatgatcctcaagttccgcatcgccttcgtggcgcccagctcccgcatcttcgggcgcggcgagctggtgagggaccccgaccagatcgccatccggtacctgaagaacgacttcatcatcgacctggcagccatgctcccgataccgcaggtccctaataactatagctagctagctagtcgatcgattggattgggaattgggattggatatatagcttagctagctgatatgatgcatggtatacctatattgtatgcatgcagatgatcatctggtttgttataccagctgtgagtacatcctcggccaatcacagcaccaacaacacgctctccatgatcgtgctgatccagtacataccaagagtctatctcataatatccttgaactccaagatcgtcaaggcaagtggagtggtgacgagaactgcctgggcgggggcggcgtacaacctgcttctctacacgctggcaagccatgtcctcggtgctctctggtatctgctctccgtcgagcgccagtactcgtgctggaaggaggtgtgcacgagcgagaacggcaccacggcagagatgcctaccaggtgcttgttgagctttctggactgcaagagcagggacaaccccatacgccagacctggcataaccacagcgcgatccagaagcagtgcatgcttccggacgccgaatatgactacggattgtttggcgatgccctcaacctggaccgcaacggggtcggcttcatcgataagtacctctactgcctctggtggggatttcggaacttgagttcctacggccagaacttgcagaacagcacctacaagggcgagaccgtcttctgcatcctcatctgcatcatgggcctcgtcttcttctcccacctcatcggcaacatgcagacctacctgcagtccatgacggtgaggctggaggagtggcgcgtcaagcgccgggacatcgaggagtggatgcgccaccgccagctgccgccggagctccaggagcgcgtgcgccgcttcttccagtacaagtggctcgccacgcgcggcgtcgacgaggagtccatcctccagtccctgccgctcgacctccgccgcgagatccagcgccacctctgcctggccctggtccgccgcgtgcccttcttctcgcagatggacgagcagctgctggacgccatctgcgagcgcctcgtctcctcgctcagcaccaaggacgcctacatcgtccgggagggcgaccccgtcagcgacatgctcttcatcatccgcggcgagctggagagctccaccacggacggcggccgcaccaacttcttcagctccatcacgctgcgcccgggggacttctgcggcgaggagctcctcacctgggcgctcatgcccaaccccagcctcaacttcccgcagtccacgcgcacggtgcgcaccgtcacggaggtggaggccttcgcgctccgcgccgaggacctcaagtacgtggccaaccagttcaagcgcctgcacagcaagcgcctgcagcacgcgttccgctactactcgcaccagtggcgcagctggggcgcctgcttcgtgcagggtgcctggcgccgccacaagaagcgcaagctcgccaaggagctcatgaagcaggagggcatctgctacgacgaccaaggcggcgccgcggcggacggccacgggacggacaccgatggagacagtacgccgctgctcggct

SEQ ID NO: 598 - DNA, 2246 bp, Zea mays
  misc_feature (2205)..(2206): n is a, c, g, or t
ggcaatttgtcgagcgcttggcagatactatccgaacttcacacaccccaccatccaacctttggacatcttctcttggggcttcttttgtcagcacgactccaactcggaggtatcacgtatgtaccgacatcgagacggggtgaccgaacgacgacggcaaggcaaaggttggagatgaccggatatcaacgacaagcactagagttttacgacgggttgttgtaatgggacgtcgatacacgatccatggcaattaggacatcgacgtaggcggaaccgatagccaaacaggaactgcgcagatcgacgacgcgagactcgatctggcgagcacgacgcaagggatcgcagctgctgcttcgacatgaattacttgctgccgagcacgacggaggctggggagcaggaacgctgcgcagcgaaacccacggttgcacgtaggggtaaactcggctgggcgcggtgattggagtaggcggccactggggcagcgcccaggcgcgcacgacgagaatccgagcagggccagtgcacagcgaccatggaaaagatccgagctgggctgaagccgacctggagctcgcggcaacagggagcagggcgagccagagactggaagacgccatggcgagcagcagggagcttcgacggagagaggcgcgacaggaaggtggagcagggagacggacgtgcaggggaggcgcgcgccatgggagatggctgtgcgagcgcgtcagggagaaacgcaagctgcgcgcagggcgaactcggcacgacagccatggacgaggtgggcgagcggaggaacgacgcgatggaggagcgtggcttgcgatggagagcagggctgaccggctcccatgggagattgacttggcgagcaccggcggctggagaaagtcgaggggaggtcgaggagctgagaggctgcgcagtggagcaagcagccatggaagagcagagagtcgactgggagagaggagatgggacagcgctgggatgtccgggactagggcgcggttgcaggaggaagatgtgagaatgagcgcctgctgccgtgtggagaggagatataatgatgagtaaaaaaaatctgcagaagaagataaggctgggagagtatgcgcacgtagaagaagatattctaccggttacccacttaagcgacgacgaagacaaggaaaaaatgcatcgaatacgattgctggcaaagaaaatatcgatgacggccaatgatattctaggaagtttacgtacatgagaagaaaacaacgagaaaacaacgatagagagatattttctatagtgaaaaatccaaatacgttgaaaatcatactaagaaacggtggaaatatttagagaaggattttccctatttttccttctttttttaaaacaataaaatacacatattttagggtatgaaattagagtctaaaaaatatacaaaaggctcaaacaaaaatgagaccgacaacaatatttagatttgatttgatttgatgaatactctcggaattagatgaattttcacctgttatttatatccgaagttttggatctgtccgagaaacacaaggaccaaaacactatccggatacggtacttgagactctattaatttagttgaactcagataaaaatttatccgttttccaaatcgatttgatttctctacctagaatagcacactattgaataatcccaattgttaatcttgtgcactgttgcttggtaatgcaagcgatccggagtattctttcggacccagtattatctgctataaaatcaaacgttaatctctttgtctcggataatatcgggttcggatagggagcaaatagaatgaacccaaatgagattgagactgatattttaaactatatttgatacgacatgaaatcagataacttcgtctgccactcgaacagctgatcactctgccatagatgatttattggagaattaaatctcaattataattccttgtttagcaatctcgcgcatgatttttctcatacaatgcgcgattcagattattttgccccgaacattttagtcgtcaagttcaaattaatttgttcgggataaaatcattcgagtgggtcgagattccaattcgtattcacgcgagcgatgagttttaaataatcactggatgcaccgattttcggaacaactatgttccgaacatcacgaaannttaggaagagcccggatagataaaaacgatgtcgaactcg

SEQ ID NO: 599 - DNA, 2246 bp, Zea mays
attagtccctagaaactaaacacctccttagtttcaagctttgatgtttcgtatgtgattttgtgctcagtagttccacactcaagttttgctcagtttctgggtaggggtcggggtcggggtgttcaaattaagaaataaactgtaaatgctttgtccattgtttatgctaaactttttggcactcttaagaaactgaactgatattattatttgtatcagaactgaacttagcatgctggggcgagcggggatgattagaactgaacaaggtttctagagcggggggtggggttgcaaattaagaaataaactgaaatatacaataaattagtgttcaatgcagctgtcgctgatctgaattgaaaattcattggttgtgctgaactttttgacacctttaaggaactaaaatgaatagtttccgcgggaacaaagattaccaatctcttttcaaagaagtgctttcatggtcaattgatgatattttgaggcagaaacaacacccttttaaggtaatgggcctcttagaactataaacattccttattttgcacatggacatctctattttaaggttatcatgttgttacaggtggagacgatcccaaatgaatttgaaacctgggtgggttacacgcaagcatttcgcaatccaacattggaggaaatatggtatcaaatcaactcgggcatggatactatttccagaggcctacatattgattgctatgaaaggaagccagattctaaatggaaaaataagtacaaaatcaagttagaagtaccaaaggggaaggacatgccaagaaaaggagatctcatgttattatcagcaagggaattagaacatagagaccaaattatccaggagggctccttttgtgccatccttgtggttatgtccgccaaccatggtggttattgtaaagcagattgtcgtgcaacattgatggatgtcttgctttcgcaatcaccatacggagacaatctgagtcaatcaagttcctaccaagttatgcatctaactaatatgacaacttatgaacgtagttgggaagtgatgatgcatggttccattgaaagttcaatactaaccaatctcatattatctaaaaataataatcgtgtatgtactaacacttctctttcttatttaagaaagttttgattttttaattgtacaccatcgtgtttgaatatatgtttcagattgatggagattgtggatattttacaaataaagaaaatatttccaagtttgctagtgagggattgaataaatctcagattgatgcagttggaagttgtgtctcagaaagtaaatattctaaggcttctgtgcatctaatttggggcccacctggcactggtaaaactaaaacagtctcaatgattctgtgtgaacttctaatattaccatggaaacacaaaactattgtatgtgctccaaccaacgcagctttggtgcaattggcttctcatcttgtttccctggttaaaaagtcctctgagaccagttttttaattagagacattgttatgtttggtagtgagaagcttctgaagcatactgataatgacctttcagaaatatttgtgaaatatagtgctgaaaacttacgagcagcaaaacttgtattttgcactccttgcatgtcctctaagttgaaaaatcaacaatatgacaccctggttatcgatgaggcagcaaacctgaaagaatgtgaatcattgattcctctttcaattaatggggtaaaacatgtggtgcttgttggggatgacaagcaactacaatcagtgactatgagcccggtatgtctttgttttaaaaccatttatccttatgttactaatgattatttcctaatttctagattgctcatactttctcattactgctaatttactactttctaggttgctaaagaggccaagtatggacgaagtctctttgagagattgtgtgaaattggttatcacaagcacttactaaatgtgcagtatagaatgcacccttacatcagcaaatttccaaatgaaaatttttatgatggaaaacttatagatggtactaaacacaacagctctatggatatttttctcggtcatatttttggtatgtattcattcattcatgttgaagatggtgtagaagagcaaattggtcagagtttacacaatttggttgaagcttatgtagtatccaacattgtaggcagacttgttgaaggtatagtatg

SEQ ID NO: 600 - DNA, 2240 bp, Zea mays
caatccgattgcaaaaatcaacatcggcgatgatttttaaatgtcgcgatttgtctctttcaatcataaatccgaaagccggtcatatctcgagacgatttattttcgaatcatgcgcgaggagttatttccgagcgaattcaaatcagactctcggccgaattaatcgctcaatcgtccgttcgtccgaactctttttcgctctgttctccatagagacaaattccgcaggatcatttgtattccagaaaatatttagcgtggcttgattacgtgttttgggccaagcccaacctagcccatttggctcatttgaaaccctaaccctaccacatgtctataaatatggaccccttccctttcccttggccatttttcactcccacccctattcttttgcagccgacactctcttcttcctcctctcccccacacgcacaactctcttcttccctgttcatggcgcagaaaatctcccagccgatgctctccccctgctgcccatggcgtcttatccacctctctgcttgggtgctggccgagcccccttggagcaagcgcctccagcagccatggcgtccatccctcctccccttcttcttcctcaagcaagcagcgcccttccctgtgctccagccgacctcctctgcccgcgctcctcatcccacacaacaacacgcagggagcttcctccatccatggcgccctcctttcttccttctctgttccagaccggcatcagggcagtgcgcgcaaggctctcctagccgtggatagcacccttccctccctcggattccctgctcgccccagccatggaccatcgcgtagagcgccatcggcctcttgagcacgctctccacggccccggcgtttccccctgctatctcctccccatggccgcccgcatttccttgctgcggctccttcccaaggccagcgcccctctcctggttggctccctctccacatcagcagctctggatttctgtacgccgacatggaactgcgcagtgccccgtggtgcttgcagggtgctcgacaaaatgcgcagcagccccgacgtctccgtgcactgccggctcgctgttccgtgaagcacagtggacagcacgccgtcgacgctcaccgatggtttgctgtttttgcgcagcctcaaatatcgacgcggttcaccccggtgagaccgcgatgctccttgttcgattccgcatcggcgttattttcatatgattaattgtgtatgtgtgttgttttttttgtttgtggaggaggggacccgtgttttgcgtgcaggagaaggcaagccgctcgacgctcgtcgatgttcggagtgatgcacaaatcggaatcgccatcattcttacaaacgtcgattgggtttgtttatggtgagtcgatgcatgtcgctctcaactgactcgattaataaattatatagatgtggttcaaatgtttcggcggtaggtcatagtatggttgtgttcatgatttcgagttagagattggtggttgatgattcgtataaattggtcgatgtggtgcatgtttaaaaattgtattggtatggattgaagtttgtggcgaaaaaaagaagtagaaaagaactcgaatgtttttatattttgataggaatatatgcgatgtgttgttgatgtgtgcgatttgtagtttgtacaattatattttagttgatgtggtgtacattggtgttggagtgtgtgtgggtataaaatgttttggttatatgtcgtagcaaggttgccttcacgttttggtaagcaaacatgttgtgttgtttaatgtgatgagtaaattggaaatacatgggatgcgaggatttaattaggacatgtatgtacgtgtgtgctgtggtgtattgtagtagtggttgcgtaagatatttgattgaggcgtgcgggtatatgtcgtgatatggttatactcgcaatgggggaagatgtatatattgtgacatgacgcttaggtcgctattatataatcgtgtgaaggatgctcgtgatggttgtgtgtttaagggtgatgtagtggcaggcgagaagtaagtttaattttcaaacgattcgtgggtagtatctcggtgttgccatgatttttgtggtatggcaatgtgatgctttgctttgtcaattatcacattccatgcccctttggataaataaatgtcttgttgatcgattagaggtcttatacgagcgttatcgcagcccaataattat

SEQ ID NO: 601 - DNA, 2238 bp, Zea mays
cgacgcaaattatattgaataaatagcatttctcgaatttaaactacgtggcacgattttattggtcgaaccgaagccacgcgaagggccacatgggacacaaccacataggatgaaaaggagtgggatctagtgtggctagcatctcctcgaactgctcactcacacgcacctgaattggtggctccttcttcaacctcaagaacgcagggagaggggcgaggctagcctggccggggctcgctggacagggaccgcgccagcagcgtacctcgccggacaagggcagccgtgcagccgccatggattcggccatggggctggctcggctcggtgaaagagcgaaggcagagtagggcaagatccagggaggggctgcaggtggccatggaagctgagagagatggagacgaggacgactgctttagagcttcacagtgtcgacggtcgagaagggcgaggtgggcgcgcgacttgtggtggccaacctccatgcaggatcaagcagggaagagcagggctggacatcaaggatcagctgaaccagccgacaaatcaactcctcctgccaagaggatgactcggcaatccatagccaccaagtcggatgtcacagccctcgcatatagtaacggagctgccggcgagaaggccgagaagccggcctcagcttctcctgccaagaagatgactaagcaatccaaagccaccaagtcggatgtcacaacttctccagttgcgatgcctactcctctggtattaatcttatcatgataaacctttgtattgcaccattgcgaggagtctacccaattccacaaacccgtagacgttcaaccaatttcccgacgtccacctccggcaaaccctaaggtgatgacttgtgactcatcgtagccggaaaagcttcagctacgaccaagcctgcaaagaaagagtcgaccaagaagatgccgacgaagaaacatcaagcatcagctgaactagccgacaaatcagctcctcctgcaaagaggatgacttggcaatccaaagccgccaagtcggatgtcacagcccccgcagatagtaacagagttgccggcaagatggccaagaagccagcctcagctgccaagaggatgactcagcaatccaaagccgccaagttggatgtcacagcccccatagatagtgagggagctgccggcaagaaggccaagaagcagcccattagtggtcctcgagtgcctgttgtggtgtgttagtgcagcaagtaagtcccatcctacacaactgatcaatcctatgtctttgagttctgctaaactatgtcgctttactccgagcgggacttgaaatgttgctagcccacaagtcggttaccgactcctcttcccttgagactcccgtgccaccttctcagcctccaagcccaaaagctggtgcacaagctggccatgatcctacggggcataagatattgcaaagttggatcgagaaggggataacgaccaccaacgagttacaatcgctcaagctcttccaactattttgataggttttgcatgattcatggactaaaaatgcttaaacgatcctctatgtatcgataggaaggtctgcaatatagatacacgtaccattggtctagtgtgtttgattgtttgtgagaccattggagcatcttgcgttgcgttgcagcataccagaacatccaacttccgtatatgaaatgcaaaacaattcaattcttacctcataccgtaccataaattagtgcgcctctccacgctagtcttcttaaacctagagaaacgcatattagaataactgagtaccgacactagaataactgagtcgccacactagaataactgagttactgaaacggaataactgacttgtgaacagagaataactaagtgatgaacacggaataactgagtgggcacattacaataactgaggtattagaacggaataactgagtaatgaacaagagaataactgagtgcgcacattataataactcaggtattagaacggaataactgatggattggaatagactaactgagtgcgtccattagaataactgagtggcacataaataacttgcacatattacaataactgagttgccataactattcagaataaaataaatgagtggcacatacaacaactgagcgttcatcgtagaataactgagtttggaacataaataagtgagcatccagtacaatacaatcgagt

SEQ ID NO: 602 - DNA, 2236 bp, Zea mays
ctattcaccctctctaggcgactttcaagactgcggataaaattattgggttttgaatcgaatcaaattaagcacagtcttaatatatcgactctgatgtcgtttggtttggtccatcgacatctcgtctaaaacactatctcatgtatcgcctgcatttctgtccatttggactattctaaatattttatgaagtttgaaaattaagaatctcccgagacgtcgagttctatattgtgtgaatcactcgagtgggtgcaaataaatttagagagtgtctaaactttataatctgaccgtgcacattattggagaaaattcatgtgcgaggtttatatttgggattattcttccagtatgttattcacgtcagagaatcagggtttggatggcgggtgatatttatctgaattcaaccggatcaatagtctacaatatcgaagctgatctcgtttggtttggtccatgtatttctcgcccacatccaaaacttcggatataaataactggtaaaaattcatctgattccaagattattcatcaaatcaaattccatctaactttttatatccaatactattctgatccaacttatttgtgcctcttttaaactttaatcctagaatacatatttatttgtgctaacaaaaaaagaaaataatttttcccttgctgcaagcgttccgctgtgagaaaaaaaaatccatttccctcaacgccacgagcatttgattttatcttttccaccgctcaagccgccacctcagtcctctggtttttcaccacgtacggttgattgcctgaaaagctagcacgtggctggacattatacaggaacgggtatttcatgtgcactagcgcacgtatcattctctctcagtacacgacatgatgcaccagccgccaaccatcggccctcatatcccttgtccccatcgtgaccttctctggcgtggccgcgcatgtctcttcttggcagcgctcgacctttgcctcggcaaaccgcagcccttgtcgaacctcctctcgctcgctgccggctaatgcctacctcgcccgtggccatcgatctgcccatgttcggtgtccttccctccacgtcggtcatcctcgacatgaacccctccatgctcggcatcaacatcagccgcaccgtcatctgcagtagagcagctgagcccctccgccaacgccctcgtgcctacaactccatggcctcacctgatgcacagtcgtcgcttcccttgacagcgccgttgccggccaccatgttgctcatctcggccatgttcctcttcgtgctcagcacctaagcatcgtgttcgaccccagcacctagcatcgtcctcgctgtcaaatcatcagcagtctccttggctcctgcagccgagtccgtgacgtgctcgtcatccccagcgactcatttccctgctgcgcgctacctacgctgagcccagtagtcgtattccatcaacggtaaggaccagttgttcgtgcctctatttgttttcctcggcatcagcttattaggtgattaatgctgtatttttgtgtacgattgaggaggagagaaatcaccgaaatgcgtggagaagaagcgtcgtccaatacgagaccctccaagtgctcgacaaaatctctaaacatgggatcgctgtttctgtagatttcgggtcgagtttagttattgtgagttcattcgttatttttgtcaactagatagatggttggattaaatagaagcatccaatgattctcttgtctattacttgacttggagattaaagttgaatttagatttatgcgataagtatattggtagatatatgttgcgtgatgatgctctacttgatagattaagtatattgtgatgttttattagttgggatattataaaggttaattcagaagcgtggtttaaataattagttaagttgcttctgtccatagttcgagtttggcgtcccaaaataacaagtcttagtaattagtcttttggtgttatgctttagtcaaatagaggtggaactcatatggtctattgtttccaaataaatgagctagatccttttaaacaaaagccatgtgatgcatatgctcgttaattgcaaaaaaaagtagctctggcgttctaattggtttggaacgttaattagtaaattagttatatgaagattgatgtttggtctagaattcctgattttgttgcacatctcactaggttaatgaattaata

SEQ ID NO: 603 - DNA, 2233 bp, Zea mays
ttgtctcgtgggctcggagatgtgtataagagacaggcctcactagacctctgccgccatgttgcgcccatggatccagttgtgcatcacctccctacacagccttgtcgtggctgggtccggcgtgtcgtcgtgggggcgctcacttcgccgtggccctgcgctccctgctcgacgtagccctaccctgctctagtgccggtcatgctctgcgttcttcctctcgtggaacagctcgctattgcccatggtcactggtctcgtcctcacctcctgtgcacgcttgcaatgccatctccactgcgattgtcggtcatcacgacgtccctagtctatcgcgtcgtactcagatctcaccgatttactctcgccatccaccgtgctgtgtgtcggtgttccctcccggcagaccacgccgtcgtctaaccttgttcgctttgctgcagcaccatcatcacctgccagctccgttcctattatttttccccaacaccgagcctctctgaccttgctgctcgtcggtggttagtggtgtccgaagctaccaagtttaatcctatgtgtgatggtgatgttcgtgcgatgctcattaaatgtttgacaaaaatcccgaaccaggagtggctgctccatcttcttcgtcgaatggaaatcatcgtgctgacacgtcgatgtcatcgatcaccatcctcgtctacgctaagtccgtgtctgtgtagctcattgccacaccctattgccgcttccacgacgttgtcgtggggacttctttgcgtcacgtgtgcttcctctcgtcacgctaaatcaacctgcttccatttgtgtcgacaacaagccgtgaagacactcttgtgctgaccacgcgccaccagctcgacaaaatgaatcccatgagttgcatcgctcgcaaggtgtgtgcggtcaaagacgtcaagcaaaaaccatcgtcgttcttccgactattgtgtcggattggtcatggtaagccaatttgttatttgtgttagttggattgatgaatgatctgactaggtatattaatcatgatgattctgtggtgagtcgaatttctatttctgttattagttcgatgaagggatttgttagatgtactaattatatcggtcctcttgcctttagcatatgtgtgtcgtggttgtaggtataatatttactggaatatccgagtcgtttgcagtggtttggtcgatgtcgtgtggtgaatcgctagtttgagatataggttttgggaagagtgcttgggggtatacttgtcaagcatgtttaaaccggttgtaagtttgaagtgcgtggtatattggtggtgcgtaggttaaatttagtgttttaagcaattatcgataagtctatcgatgttaattatatttagtgtgtttgtacgatggagtcgatgccatgtgctagtagtcattatattctatgattggtggtcgatcaaatgtcgtgattaaatgttaccggctaccataagaatttggaagcgagtagcgttagcgagccaatttcagtcgaaatacaagaaacctcatagtagaagaggtataagtgctttaaaatctagattattgaggatgtagtttcacgagactataatccttttgataatgtcttatctattagacataagattaacgtgctgatttgcttagttggcatactattcaggttagattatattattaggttagaaagttaattaagggtttttatccttagactgagttaggtgtccctaaataataagcctaagtctggtccgccattttggtgtgttctctagcttaggaatatatatagaacttatgtttcgtttattatcgcttctagttcaaatcgggttcggttaagttaaaatagagtagaggttgtacttagtaatatatcggcatttggtaattgcttttaagtgttactatatgcctcgccgttaaatatttaatcctcttcggtgtagcaataattagtcgtgtgctattcttgtttatattcattcatgcacattatgcatttcatttaggtacgttaattaatcacgtggtgtggaggacaagaattgagtcgaccccaagatgatgtaatgagttggctactccgcaaggtgatgatggtggacgaacctgaagatggacagattgagtgagtgccagaacaaaagctgattgccaagagatcgtcgtctaaccaacactaacctagtgttattccaggcaat

SEQ ID NO: 604 - DNA, 2232 bp, Zea mays
tatttatactttgttctttttatgctgagaagggcttggggtgctagtgaccaatgtgctggtggttacctccattgtggcaactacgcacaagtagtagcacggaggaagtaaccatcagcatattgggcacacctccaccatccgccgtgacgctctcctggccaaaaggttggtcattgctgcaaggaggactagtcggctcagatgacaggctgcctcagctgctaccaagtcaggctacttagagtttgtagggtgatgtcatttggacctcgacgagatccaccactcgattatattgtactggatgctcacttatttatgttccaaactcagttattctatgatgaacgctcagttgttttatgtgccactcagttattttattctgaatagttattctaatatgtgcaactcagttattgtaatatgcgcaagttatttatgtgccactcagttattctaatggacgcactcagttagtctggtgtcggaactcagttattccattctaatacctcagttattcttgtgggccgactcatttattttcttctcgtgactcagttattctactccaatccctcaattattccgttataataactcagttattgtaacgtacccactcggttattctctgttcacaagtcagttattccgttccagtaactcagttattctagtgtggcgactcagttattcttgtgtcagtactcagttattctggtgacggaactcagttattacgttctactacctcagttattctaatgtgcacactcagttattctgttcaaataactcagttattctactaattactcagttattccgttctaatacctcagttattctagtgggcgcacttagttattccatgttcatttctcagttattctcggttcagtactcggttattctgtgttcatcactcagttattctggtgacgaaactcagctattctctgctcgtgcctcagttcttgtgggccaactcagttattctactccaatccctcagttattccgttataatacctcagttattctaaaccctcagttattatgttataacaccgcagttattccatgttcctaactcggttattctaatgtcggtactcagttattctaatgcgcgccttgagttattccatgttcaccactcagttattcaagtgacagaactcagttattctactccaatccctcagttatcccgtgtcatacctcagttattgtaatgtgcctactcagttattatatgttcatgactcagttattccgttccaacaactcagttcttctaatggacgcactcagttattctggtgccagaactcagtaattccgttccaatacctcagttattcttgtgggctaactcagtgattatggtgtgcagactcagttattctggtgttggcactcaattgttcggttctgatccctcagttattctcagttcgttactcagttattgtgcgttcattactcagttattctaatcgacgcactcagttattcgtgtgacattactcagttattctactcgaatccctcagttatcctgtatcatacctcagttattgtaatgtgcccactcagttatgcggtgtttattactcagttattctctattcacattcagttattgcgttcaagtaactcagttatgctattgttcattactcagttattctgttgtgcacactcagttattctattgttcactactcagttattatctgttcattactcagttattctgttccaacaactcagttcttctaatgcacgcactcagttattatggtgacagaactcagttattccgttccaataccttagttattcttgtgggctaactcagttattctcctccgatccctcagttatcatcatacctcagttattggaatgtgcccactcagttattattgtgtgcagactcagttattctggtgtcggcactcagttgttcggttctgatccctcagttattatgttataatacctcagttattgcgatgtgcgactcagttattccatgttcgtcactcaattattcttttgtcggaactcagttattctaatgggcgcatatagttattctggtgtgatgactcagttattctctgctcattactcagttatttcgcagtcataactgaattattcagttattctctttgtaatcactcgatagtggggactccgttattc

SEQ ID NO: 605 - DNA, 2231 bp, Zea mays
acatgttgcactttaaacatttataaagttaccttattctgaatatctacaaactatagtgtctgcattcgaacatctaatatcttgggccccaaactcatgttataggttgtcttgcacttgggttgatgatgaagcatgtgaaagtaaattaattatctgaaaaaaatctatatgttatgcttcaagcgcttctagagtcccctcgtcattcatatgaccaaatctagtgctagcatgcgacaatctagggtcgcatactcatgttatggttgtcttgaacatgggttaaggatggtgcatgcgaaacaacaagttgggtccatccgtaaaaactatctatctaaacaatacaatatttagggcatcaaaatgcaaggaagttgacgcacatcagaaatcgatatatcatgcagtaaacttgcatgaaattaataaccattagtcctatactcatgttttgatcggccttaaacttggtttgatgtgttcacaactgagcaacattgcaataacactatatatgttttaaggtaacatttctaaacaagtatgtcttacagtactacatttagaaaagagtaatgaaagtgaaaatataatctttcgtccattaactatttttccgttaatagaggtcgtaactctgcaaaatagtttatcttgaaaaatctgcatattgcaattcaaatacttttcaagttaccacattttttaaaacatttaactttaatcggcatgcgaccatctaattatgtgggtcccatattcaagttattgattgtgttgaattttaggtgatggaggagtgtatgaaacatgttggatcattctgtaaatctaccacataatttagggcttcgaaaagcttcaaagttttcgtatggttcatgccacaatcttttcaagaaaacatgcgcgaaatcataaccctttactcccaaatcagtgcattgcgaaaactttgatgacaaatcttgttgggacatttttgtaaaaactaccgttccaaacattacagcatttagggctttgaacggcttcaaacttacattaatgtccataaccataaaacatttgaaatcgttccacattttttatgagataacatgcccaaacaagtgatgtttatagtttggcaatgagcaaattgtaatgtaattttccttgcttaaattgttttgtgataaatgtcatgagtcccatacttgttttttgagtggtctcaaaacatgcattgttgtccataaccaagaatcatttaaaatagcactacatattgtttaatatagcatgcctaaactagtattgtttatagtctcgcataaagcaaattgtaattaaaattggaatgaatttttttctatatttaattcttttgttataaatataattgatataactctaatagaataataacaaagtatcttaaaacatggaccggaataaaagcatgattgcataaatatagctctcaactccggaaaattaccgatctaaaaaatatacatgttgcactttaaacatttccaaagttacatcattcttcatatctacaaactctagtgccagcattcgaacatctaatatcttgggccccaaacgcatgttataggttgtcttgcaattgggttgatgatgaagcatgtgaaacaacttgttggatagctcacgcaaatagtaaattgatgatcggaaaaaaatctacatgttatgcttcaagcgcttctagagtgacctcatccttcatatgacccaatctagtgctagcatgcgacaatctagggtcgcatactcatgttatggttgtcttgaacatgggttaattatggtgcatgcgaaacaacaagtagggtccatccgtaaaaactgtctgtctaaacaatacaatatttagggcagcaaaatgcatcgaagttgacgcacattattaatcgatatatcatgcattaaacttgcacaaaattaatacccattagtcccatactcatgttttgatctgccataaacttggatagaagtgttcacaactaaggaacatgttttaaggtaacatgcctaaagaagtatgtcttacagtacgacatttggaaaagagtaatgaaagtggaaatataatttttcttccattaactatttttccattaatagatgtcgtaactctgcaaaatagtttatcttgaaaaatctgcatattgcaattcaaatacttttaaagttacctcattctt

SEQ ID NO: 606 - DNA, 2230 bp, Zea mays
attaaaatatttcatcaacacataggtctactaatattttactcggtacactaattcagctaagtgactggaatagcgaaattagctcatcatagctgaatctagctcgataatcgcaagaattgtgaattcgacgagagtttcgtgacttacacaatttatcgagcaccttaatgagcattgcactagcacattaattcattcaatgatcgaattattctgaataatttatcagcttaccttttcaacagctgactcgaatccgcgggatcagtaatgattttccgatctaggcaatttgtcgagcgcttggtggaatatcgcactgctatcttcatcttcatccgattcttgggatttcttgatgacgcacggaacaacaataaattggagacttgcagggtcgaacacgacaaagagcttcggatcccaacgccagtagcaggcaattgaaagataaaccgtcgggggccacaagcatgtcgcggacgcgacgggtattggcgacaagaagcaagggggttgctgttgcaatggtgaaagatgaagggcactatggagcagggagacacgcctgggagccgagtattgagaggtcctggccaacggccagaccgaggcgatggccggggaactcagcataggcgcgacgatttggcagacagggagaacatgacgacaaggggcaaggtttgcagatgccgcgacggagctgcccaaacacaaagacgacgacgtggagcgaatagcgcacacacacgtcgcaacaaaacgatggctgttcaaggcttgatatttcctggagcagagcaaaggtgctgggagttcacagcggtgctccacgacggccatcaccggcgtcgagcaaggggcgatctagcgaggtcgactgcaaacaaggcgactacgagctggaacaccagggtgacccgagcacgacggatgagccgtagccaagcagtgggacgcggctgcgggcagaggagtaacagaggccgagcagagaaacgcaggggacgcgcgcgggatgaaagaatcgagccgcagcgcgcgcagacttcacggcgctcggcgcggcgagaacgcacgagcacgagaagatggagcagggagggagtacgcgcgcgcaaaggagctcgacggctgggcgagctgggaggagcaccatggctaaactgtggagtgcgcaaggacagagacgcgctatggcgacgagcaggagaccgaatgtgggcaggtgctagcagcggagagccgcgaccacgaggttcgttgacaacggccaggggtccgactgagcaggctggagcagagagggcagggccgagctgcacggccggcgagctggagcaccggtgagtagcaggcgcgggcgaactccatgggaggaaaatccgagctggtgcagggaggagcagagagaagcggcaatgtctgggaagaagtctgagccccatgggaggacgcgcacaggaaggctgaagcttgcaggggacccggcgcggttggggaagagagcgagccgcagggaaatcggctgggagggagcgcgcgtccacaggaagaaaccgagcggctgaggagagagagcaggaaatattccgcgacgggatgagaccgacggctggaactcggttgggggcttccgctggcgagctacgcgcatataaaacgaacaggggcggcggcaaaaatatcacatagtcaggtacggtggctggggagaggatgagaacgagtgagacacaggaaaatcttgcgccggctgaacggatgaaggagagaagatgagcacgacgtcaggaaatatcctacgaagaggataaagattggagagaaaacaaaaattcaacagaggaaatatttctcagtccttttttttcaacacaaaaatacaaatgacatgcttcggattagcgaaccaatttaatcgctaattacttatatccgaaaattcagatccgggcaagaaacgacggcccgaataagactgatttcgtcttcggtaatttgttcggtgggattcgactaaaattagccgaaaccaaatccgctattgtatacgcgattttgtcgccacaacagcaagctgaaggataaattgaatcatattcgcgcgcacgatttcactcagacgacacgcgatcctagatattttgccccgaataattctagtcgtcgagctcaaattaatttgcccgggataaaatcatccgagtgagtcgggctt

SEQ ID NO: 607 - DNA, 2230 bp, Zea mays
cgcctctgctccacccggccttcttcctttccctgctccatgggcgcgagctccaccccctgcaatggacgctgcgcgagctcaccccatgggctcgttccctgctccacggccagcaggaagccagcgcccctctcctgctcggacacatctgcgcacagagagttcttgcccacgccaccctctttctttcccatgaagcaagcagggaacacgaccaatgttatcttcctcccatggctgcctccctggcgcgtctcacctctggtcagcgccctgcacagcgccctctctccaatggcgagcagctttcctccccatggtcatggtctgcgataggaagtcgcgtgctacatgtttgaggttttgcgcagcagccctgacgtctccacgcactgcctgctcgctgttttgtgaagcccactggacagcacgccgtcgacgctcaccggttgtttgctatttttatgcagccccaacatcaacgtcattcacccccggtgagacacccctctacccttgctgctatcatatttttgtgctcggtaaaatgttgaactgttgtgtgtgtcgaatcgcagctagccgtcaatgccatctgtcgtgcacgcgtgttcgatacaaggccggtcgggtgaaccacatgcatgcacaactcgaatctgatctagtccaggttgattgatttatagtttaccatacgtatgatttggttgatgtcatgcagtgcatgtatatgtgtggatgtgtgtaaaatgtttcggttatacacattagtagggtcgcatttgcggttggagaacaagaggttgtttgatgtgtgcgatttgtagtttgtctaattatgttttggtcgatgtggtgtatattggtgtttgaatatgtggctgtgatggttcatttatgtgtcacgaggatggttcgtggaggtattaattgtttgttaaaatacttcgtcgtaaagcagtgtgttaattgtggtaaatctaataaagcgtaaagcaggcttggtggtttccgcagtcggctaataagttagtctatgttaaatatattttatgtattcatcgtggtgtgggttagggtgcattgaaaatataaattatgtgacatgtaattagtattttaaagacgagatgtgcgaataatcagttggtgtttcactcgtctagtcgataagtgttgtcataaataattgtcctaaaatttggttataagaatgtagtggtcacgtggtgttggttggatgtgataagttgattggaagtgtgggtttgtctgagcactgtgttgtcgaacgtgtatgtcgaagtgcattgtagtaatgattgcgttaattaaacagtaatgtctcaagtgcacgccacaatatggttgtatgcgagacggggttacgagcatggtgagtttagtaaaattccatcggtgtcacttgtgttaagttgaggtttatttgtgcgtggaaagtagtaatgtctttaatacttagaactcttagtcgatggtagaaattgtcttggcttaaatagagaggtggtgacatgtcaaggtagtcatcatttcctctatattaataagtcgagtcaatacgcattatgcgttcattaaatttcacatcgcccatagtgtatggttgtgttgatgacttcgaatagatgtttcgagttgacaagtaggtttgtaatgcaagatgtgtgatgaagttagtttgttgtagaatatttgttgaaatgctccattcatgtgatagacatgtatgattaattcaaatcgagtcgatgtgtgtgatgatgatattcatgaattaagtagatgtcttgtaattgtgtagtgaagcttaggttaagttgcaagcgatgtcagaatgtttggtaatgatatatgtgaaatgtgaatgagacatccaatgtaatcagtatgtcgcgtagtggtggtatgaaaatgggttagaaatcgatcagataaatgccatgttcggttacagttgttttgttacttgggattgtgtggtgaagggatggcatgactgcgtagccatcacgtcatctattgggtgactatgcttatgtgtgtctttatataagttagaataattccagtctctagaacatggcaattcttgaattatccaggagctgaaatttattaattgctgttttgggctgcacgcactgtttttgccgcgctgtttgtttaaagaaccaaatcatgttttctgtagaaaagctat

SEQ ID NO: 608 - DNA, 2227 bp, Zea mays
ggcctcaaaacatgcattattgtctataaccaagaatcatttaaagtagcactacagatggattaagatagcgtgcctaaactactattgtttatagtctggcataaagcaaattgtaattcaaattggaataaatttttttctatatttaatttttttgttataaatatcattgatataactgtaatagaataataactaagtatcttaaaacatggatcgaaataaaagcagaattacataaatatagctgtcaactccggaaaattaccgatctaaaaaatatacatgttgcactttaaacatttataaagttacctcattcttcatatctacaaactctagtgccatcattcgaacatctaatatcttgggccccatactcaagctataggttgtcttgcacttggttgatgatgaagcatgtaaaacaacatgttagatagctcacgcctatagtagagtgatgatctgaaaaagatctacatgttatgcttcaagcgcttctagagtcacctcatcattcatatgaccaaatctagtgctagcatgcgacaatctagagtcgcatactcatgttatggttgtcttgaacatgggttaatgatggtgcatgcgaaacaacaagttgggtccatccgtaaaaactgtctgtctaaacaatacaatatttagggcatcaaaatgcatcgaagttgacgcacatcagaaatcgatatatcatgcagtaaacttgcacgaaattaatacccattagtcccatactaatgttttgatcggccttaaacttggtttgatgtgttcccaactgaggaacattgcaaataacactatatatgttttaaggtaacatgcctaaacaagtatgtcttacattacgacatttagaaaagagtaatgaaagtgaaaatataatctttcgtccattaactatttttctgttaatagaggtcgtaactcggcaaaacattttatcttgaaaaatctgcatatttcaattcaaatacttttaaagttacctcattctttaaaacattgaactttaatcgtcatgcgaccatctaattatgtgggtcccatactcaagttattgattgtgttgaattttaggtgatggaggagtgtatgaaacatgttggatcatactataaatctaccacataattttgggcttcgaaaagcttcaaagttttcgcatggttcatgccacaatcttttcgagaaaacatgcacgaaatcatgaccctttactaccaaattagtgcattgcggaaactttgatgacaaatcttgttgggacatttttgtaaaaactaccgttctaaacattacatcgtttagggctttgaacgtattcaaacttacattaatgtccatagccataaaatatttgaaatctttccacatatcttatgagataacttgcctaaacaagtgatgtttatagtttggcaatgagcaaattgtaatgtaattttccttgcttaaattgttttgtgataaatgtcatgagtcccgtacttgttttttgagtggtctcaaaacatgcattgttgtccataaccaaaaattatttaaaatagcactacatatggtttaatatagcatgcctaagctagtattgtttatagtctggcataaagaaaattgtaattaaaattggaatgaatttttttctatatttaattcttttgttataaatatcattgatataactgtaatagaataataacaaagtatcttaaaacatggactgaaataaaagcttgattgcataaatatagctcttaactccggaaaattacagatctaaaaaatatacatgttgcactttaaacatttccaaagttacctcattcttcatatctacaaactctagttccaccattcgaacatctaatatcttgggccccaaactcatgctataggttgtctttcaattgggtcgatgatgaagcatgtgaaacaacatgttggatagctcacgcaaataatgaattgatgatctgaaaaaaaatctacatgttatgcttcaagtgcttctagagtgatctcatccttcatatgaccaaatctagttctagcatgcgacaatctagggtcgcatactcatgttatggttgtcttgaacatgggttaattatggtgcatgcgaaacaacaagttgggtccatccgtaaaaactgtctgtctaaacaatacaatatttagggcatcaaaatgcatc

SEQ ID NO: 609 - DNA, 2227 bp, Zea mays
  misc_feature (1795)..(1797): n is a, c, g, or t
ggagctcttgtctcagagaaataaaataaagattacttagctcctaagtaatcagcccctcctcaattacaaccactctctctccgttttctcgcacacgccatctttccttcaccctatttctggcatagtctgccactgccagcctctggccagtagatggctgccgcccgtggtggcaaatggattgccagcaacgtctcgttaaatcaaccagcatccttctatttaaattcccaccgctttgctcctttctctctattcctagacgccgggtagacatggtcatgtggcttgctcgccgcccatgatggccagttcccagccacctccgttctcgtccaaagccggctgccgcccaatcccgaccaatggccgtagccgtcacacagataaatctagcagctggcgcccctcaccttcagtcgacactcccttctcccctctgttccttagtgcagaagcatctcctggcattttccccttcttagcgtaggagcaagggcctcccatggccacctccctggcgtacctcgccagcagccgggaaggccacgtccccatggtgctgctctccggtgtttccctaggtccggcgaccccttctctccctcggaaatcagaagtcccccttcttcctcaactcgaactcgtgcagcaggggctttcttccccggtgtcggtcatcgttctcctgggcctcctccgtggcacggctcctccccaacgccggtgacctccctgagctagcttgtcggtgagccctgcccctctgtcagtagcgcgccgcgaccctctcttctcgtgcgcaggattgctggcaggagtcctaccatggccgcacctgccccctctagctcggcgcgcctccctgctcccttccatagcgtgccatggctcctcctcatggcgccccactccctgctacatctcctctcggcctcctctctatagtagagagtacagggacatgctcgacgcttcagcgcctagccatggtggatgtacgccgagccatccctccccgctggacagcaccagagtctaggtcttcggctcacctaggcagcgatccttccccgacacctgctccttggaactcggcgcccagccttctgtaggagcagtgcactcccccttctgaagcacctcgctggcgccctcatcatccatcgatagcatcccatggcgctgctgcccccatggtctacatgctgcgagttttgcttcgtcgcactcgtcgtcgagctcgaaccgggtgtgcgcagcccgtccgcgacagcattgaccccccgtgacggccttgtactcgcgctgctccccgagccgagaccttgcaagcagcagcaaggcccgaatcccctctgcatcgcgtgcttcgctggatctgcgcagctgctgcgcatcatcgtcgaaacctttggtgagcctctccgctagtaccccactatttttggatctcaggtgcttaaaaaatgtttgaaccactaggtgttgttaatcgcagctagatgttgctgctacgcctcgcgcaacgcatgattcggtgaagcacctaaaccgtggacgcatgctcaacttcaatagggtttcagccaggttgttcgccttcagtgatccgcgatttgttttatttacgtatttggtcgatgatgtgcatgtgtgaatatgtgtgggaaaaataattgtatgaatggaatcgtgtagagaagaaaataaagtagaaaagaactcagatctttttatattttgataggaaaatatgcgatgcgttgtttgatgcgaaaactaagtnnnaaatgcggattatgttttgggaaatgcatcgataggtgtttatgtgaaaagtgtatttgttttatgcatgtgatcggtgattgtgatagtcgatgcagatgaggagtatgattaatcctgttggagtcacttgtgatgttgatgtcttgtgcgtaatatggggacacgtatgtgtgtgccgtggtgtattatagtagtgatggcgtaagatatttgattgaggtgtgcgggtatatgctgtaatatggttatactcgcgacgaggaaagatgtatgcattgtgtaacacgacgcttaggtcgctattatatagtcgtgtgaagtatgctcatgatggtcgtgtgattgaggagtgatgtagtgacaagcgaggagtaagttcagtttttcaaacggttagtggatagtatctatcggcttcgtcatgatt

SEQ ID NO: 610 - DNA, 2222 bp, Zea mays
gctcggcgtgtgaacctctgtctccgcgctctcgcttgactgttgatttgactaatttggttgcttagatgtggctcttattaaaaaccatatgtggataggcttgcactacgtacacggtgcagatcataacactagagaaagtttgacatgtgcagatcataaatgcatgtgctatgtttaaggtctctttagtgctctttgttatcatacatgtgcatctactgtagttctgtaaatgagtgaaccttacctacatgtctcaacttgtattgtctctctgtttgtatgtggagagatttctgaatgtgaatccagtgtctgaacaaacttaattaattgttttccgtctgcacataactatgtttaaataagatttagctctatgatacatatagaaaccgtagcaacgcacgggcaactaactagtgatggatgaagacgcgtattccggacgtagcgagcgcaaggggatgcagtacaccgtacgcatgtacgctcagtgccctacatcctcatactgctcgccatttctccagcgtgatgaatgaccgcagcttcttctactccatcaaatgagcaacgactggctgtttccttggacttgggcaggtgagaatgatggaaaaagtaaaccaaacgccaagaaccatttaacaacaaacccacgagagaagcaagctaaccacatcaggtcaggtggttctgtgcaaggcgaccagaaaagctgaattcagaagaaatccagcttttagctgccaagtttccaatagaatctttactaattatacttttacaacacaagctggaacaacagcgaaagcaacattctggcataggagaaacgcatggcatgatccttttcgaaaatcctcagaagaaggttgtatatgccctcaaaccgtaccgctatgtattgactaggcaacagatgtacaatatgcgacagggaaggaatgcgtacaaaaagagatcgttttctgacattactgcatgcgaacaaaaaacaaacgcaattctagtattctagtaaaaaaaaatcaaacgtctaccacatagcgagttttgtatcatatatgataatgtgttcgaagcaacatgatagcaggctggatcaggattttcgtcagtgcatgaaccctaaattcacgaattttattagcatagcatgaacatatatacagattgatgtttgatgatgatatttattcagaggctcacagagtaaccgatcgagtaattttaggacagacatgttcacatgccaacttggcaacgaagatagcagacaaatcaacattcgtttagctcatgagcattgatgttccagctcaccaaccatccgaccagtgatccggagctacaaatctcatgtgcccagttttttttttttgtgtggcttaattagcttgcgcacagttttatgggatcaggtgggttgggattaaaaaaaagtactacacgtcgctcgttgacactgggacaccaattctctacaatccatctagccatagtttcagtagcaatgtactcgtagagtgtaaatcaccaggagatactcgggcaatctgtatttacacttatcccttgctccaacttttacttcttctacgttacaaaatcacaaaaaactaatcgaggtagctgtgatttccatccaaacaattttttttttgtaaaatatatcctaaaagcaaccccacagtcaactactcaagcaacccatcataacttcacacccaaacaaatttttgtaaatataccagtatgtccatcacctgcggcgcctccggtcggcggcgtactgcgagagcgggacgagctcggaaagcggcgtcgcgagcggcgtggagttgggcgtcgggatgggggaggacctgcagacggggcacgacgcgctccgccgcagccaggcgtcgaggcacgcgacgtggaagccgtgcctgcactcgggcatcacgcgcagcgtctcgccgtccctgtactcgctgaggcagatggagcacatggcgtcggcgtcggtggccccgctggaggagaaagggaccttggggtaggacgcgatggcggcggcatcgagcccgacgggtgagcaggccgcgacggcggcggaggagtaagcggcgtcggcgtcgggggactcggacccttccgcgacgaagagcacgcgcgggacggtgatggagaggtggccggagctggaggccgtggtggctgcttct

SEQ ID NO: 611 - DNA, 2218 bp, Zea mays
  misc_feature (755)..(756): n is a, c, g, or t
aggagcctaaaagctagccccattcagcccactgcacgggatcacaccatatcgtcaaccgccctcatctcctctctcctcacgccaatccaaactctagccgccgccgagtgccaggcctccgggaacgcctcgtcggcctgcgtgccgatccacacggccctgctccgcgcgcaccctccccacgaactcacaaaggcgcccctccgcgtgcccacccgctctgcctacgccgacggcatccgcaagtccggccgtgcgaaaacattctcggcgaaaaaatttcgagaaaattgaaaatcacgtttatcggtgggatccggttttttttttatttatcggccaaaattttcatcgattttaaattcagttcaaaacgctaccatctacttcttttagccagtatctacaaataatctacattgttatgattaaattgaacttttttctctaaattttgtccaattttttttgagaaaaacgaaaaaaaaaatcgagaaatccgagaaacacgtgacgtttctcggtgagattcggtttttctttaccggttaggtactcctattgcccagatccatggcggattcacccctctctcaccggcgcattcgcgaacctcttctaggtcatctcctcattcatcgctgtcggagcgtactcctattgcccagatccatggcggattcacccctctctcaccggcgcattcgcgaacctcttctaggtcatctcctcattcatcgctgtcggagcgnngtactcctattgcccagatccatggcggattcacccctctctcaccggcgcattcgcgaacctcttctaggtcatctcctcattcatcgctgtcggagcgcctggaggcgaaggcgccctgcgccaggatcgtgggacggttccacgcggttcctaggccaccaggccatagcggatctcgccaagaatgcttcctcactcctctcccttgaaggcgacaacgactgtgtggaggaggcagcggggtcagcgaagaggtgatcgcggcccgagctatgtctcatcttccctctcctccctgacgacgcggactcccatggtttgtggcttcgtgatttttttttttgcctcattagatgctctagttgcctcattagatgctctagccccggcacagcgcaggatgaggatgggcccaccgccaccattgcccacaatggtcatggcgacggccacaccacctcaggcttagtttgggtactgtagtattgacctcaatctaattgtattgtagtggattagggtgtgacttaaactaatttacaacgcaatctacttgaacacatatggattgagtactgagtgtccaaacaaagcctcaagggtttccaaccggacagtttctaacctggtcgtaattcaggcctacatttcagttcgtcaatccacgactccacgtttcctcgcccagtggaatcacaccgccatcatccctatccctttcgtggcgccctggcctccctcgcggcccgcctccccaaaccgcgggcggtccgtacaatcgcttccctcgcggtccgtacaatcgtctccctaaatccctcctcctgtccttcgctcggccaggaccagcgactaggccacccctcgccgcctgcccaaccagcgcccccacccagcgaccccaccgtccccggtgaccagccccaaccccatcacaaggccggcgacaaggaagcggatgtcgccaccgccgaaactgatgggtccaagacggggtcgtcctcctcgcactcgtctcgactgctccgggagctaggcatccatgtctcccgctacaaggagcgccaggcagaagcggagcgctcgccagatcgttaaccaccaggctgcttgtgctgatgcttcttgcaagcaggctctgacagtccggcaactgcttgtgattgcaaacatagcgaaacttgtcagcattgcgacccctggtggatgaatggggtctgcaatagttgaatgttcttgattttgctttatgtttcattggacgtatcagtatagttacagccaaggatttatttattttctttttcccttttgactgcaagcagttagggaaattggacttaagggcttcagacattttttaagtgcactgtactttttcatccaactcaagcctgctctttgtgaattatcaggtcattcatgagctacggagtgctcgaaagggtgttgtaaacat

SEQ ID NO: 612 - DNA, 2215 bp, Zea mays
ccccgacccgctaggttcttctcctctgcggcgaattagagcttgccggtgccgctgcgcgtcggtccgccacacctgaagtgcggccgatgcagctccaccccttgcccaagttgtggccctagatgtcccaaacccctcaccggagcccgtgctatcctcggtgcgctcgatcgccccactccgtggctgggatggcttgccaaagtacccccgacccgcccggttcttctcctctgtggcgaattagagcttgccggtgccgttgcacgtcggtccgccgcacctccaaggcgtgcggccgatgcagctccacccattgcccatgttgtggccctagatgtcccaaacccctcaccggagcccatgctgtcctcggtgcgctcgatctccccactccatggttgggtttgctcgctagagtacccctgacccgcccggttcttgttcattgtggcgaattagagcttgccggtgccgttgcgcgtcggttcgccacacctccacgacgtctagccgatgcagctctacccattgcccaagttgtggccctagatgtcccaaacccctcatcggtgcccgcgctttcctcggtgcgctcgatcgccccacttcgtggctaggattgctcgccattgtacccgcgacccatcggttcttctcctctacggcgaattagagcttgccagtgtcgctgcacgtcggtccacaacacatccacggcatccggccgatgtagctccaccccttgcccatgttgtggccctagatgtcccaaacccatcactggagcccgcaatatcctcggtgcgctcgatcaccccaatctgtggctagattgctcgcaagagtacccccaacccgcccggttcttctcctctgcggcgaattagagcttgctggtgccactgcgcgtcggtctgccgcacctacatggtgttcgaccgatgcagctccaccccttgcccaagttgtggccctagatgtcccaaacccctcaccgaagctcccactgtcctcggtgcgcttgatcgccccactccatggctgggatttatcaccagagtatccccgacccgcccggttcttctcctctacggtgaattagagcttactagtgccgctgcacgtctgtccgccgcacctccacggcgtgcggctgatgcagctccaccccttgcccaagttgtggctctagatgtcccaaacccctcatcggagcccgcgttgtccttggtgcgctcaatcgccccattccgtggctgggattgcttgctagagtacccccaacccacacagttcttctcttctgtggcaaattagagcttgccggtgccgcacttccacggcgtccgatgaccgatgcagctccaccccttgcccatgttgtggccctagatgtcccaaacccctcaccggagcccgcgttgtcctcggtgcgctcgatcgccccactacgtggctgggattgctcgctagagtaccctcgacccgcccagttcttctcctctgtggcaaattatatcttgccgatcccactacgtgtcggtccaccgcacctccacggcgtccggctgatgcagctccacccttgcccacgttgaggccctagatgtcccaaacccctcactggagcccgcgttgtcctcggtgcgctcgatcgccccactccgtggttgggtttgctcgctagagtacccccaacccgcccggttcttctcctctgcggtgaattagagcttgccggtgccgctgcgcgtcggtccgtagcacctccacggcgtccggccgatgcagctccatcccttggccatgttgagaccctagatgtccgaaacccgtcaccagagcccgagctggcctcgctgcgctcgatcgccccactccgtggatgggattgctcgctagagtactcctgacccgcccggttcttctcttctgtggcgaattagagcttgccggtgcctctacgcgtcggtccgccgcacctccacggcgtccggccaatgcagctccacccattgcacatgttgtggccctagatgtcccaaactcctcaccggagcccgcgctgtcctcggtacgctttatcgacccactccgtggctaggattgctctgtagagtaccctcgacccgcccggttcttatcctctacgatgaattagagcttgccggtgccactgcgcgttggtccgccgcactgtcacacccag

SEQ ID NO: 613 - DNA, 2212 bp, Zea mays
ggaggtgaagttttataagaatagtgattgaactgttatatctcatttttaaaagaatgttgaaaacgggaccactatatcagataaatggcaccgacaaaagtgtttagctaaaaaaacacatgggaggacagtaatatcccttggttatgatgcaaaaaacacattctttccctggatcatttgcatgagcgtcaccttccatggagttccctataccatatatttcttgcagttttgattttaatattcaagcaataaagcatgtatgatacggtatggaataaaaggctataggagatttcacaaagaaataactatcagcatacacctacctttcgagaatatacagaagatgaattctgaagtttttcgcccctcctacaaaaaaattgaaaatgaactgctatttcatacttctagatggaacaaatgtattttcaacaatgaaaagggcgacagcccagccaagcaacgtgcatggtgcttaaatggattgaacatgacttccttctagcccaccggtattagtaatcacgacgcggacacagcaaaacataaatcgtatctcggtagatgacaaagcacaaggaggttattctggcgcaaaatagctacagttcagtgtccaaaaacgtgtagggccatgcctgcgacatgccatcgcgccatgaaggcggcggctgacccgtgtgtgcgtgaagagagattgcatcaagcatcttctcgagaaaacgcttcctcatcacttcacaataccaactacaaccatttgaactaatttcttaatactcattttccacggtagaacttgtacttcaaatcattacttcattttactttggtacagatgcaaattcagattcgctggaggtacttatctatgagaacatatgctactctttccttagttgcaaattcagattagccgctctttgatacttctatactatactaaaaccagatctcctttgtatcagtttatgcgtagtaagtagtaacgtccgattagtgttatcccacaagattaacaagagaaatataaccacataaaaattagtattgaacgcctttcaaatccatctgaaattgaggtcccatgaaagggcacagcccaaaaagggagaccacagttacagcatcgcttgcaaactaccgagattactgaaacactacggtgagaagaaactgaaatcgagagcgcaaaggttgtcgaggaaaccgtcagcagttgtttgaacaaacttacttatgcagcaaaggtcattgttaaggacgcatacaacaagaagaaacgagtccaattcctggagcaagtaagcggcacatcaacacagtcgccgctggacgagaagcgccacacgaattaacaacaaaggcctcaacagagtagccacgggaatagcaagcgagttctttttttgcggctgcagcgtttcagcgacccatgcggtggaaaccgaaaagggaggcgcagtaccttttgggtggagaaggaggcggcggcaaagcgagcaaagacgacaagggtgggagcgacgagggaggcgcagtaccttttgggtgaaggaggcggcggcaaagcgagcgaagacggcgtggcggagaactggaggcggaagagcccaagaggcgtttagtctctcactccaatccccaaagcggcgccataaaatacaagctcgcggctgcagggcgcccaactgccacctgacacgccgaccccgtggtcgagctgaacccaggcagaacacgacgagctcactatcgcgtcggagaacaggagaggggcggctaggcctaggcaggggtggggtggggcggaactcagcgccttggcctaggggcgagtccacgcctccgctgaaggagctcggctgccagtgccgaccaccgacgctggagaggagctcgtccagtcgtcctgccaggcgagcgcgcgacctgggcggagctcggggcggtggcggctccatcatggcggtcgtctcggttgtgtgaggaggagggcacgggaccgggcggtgggggcacgaaggagtgcggatctccaggcttggaccgcgctggtgacggctgcggcatgcgggggcgggtgcagctcgcccgcgagattgacggggtggggtagggcgagagcggagccgtggtggacgccctctgtaccctcttaaggatagtagagattacttatttattttgtacagaactc

SEQ ID NO: 614 - DNA, 2210 bp, Zea mays
ttactcagttattctctttgtaatcagtcggtagtggggactccgttattctctattcacagtcagttattgcgttctattaactcagttattccatgttcgccactcagttatttcattccaacaacttagttattctaatggacgtactcaattattctggactaatacctcagttattcttatgggccaactcagttattctactccgatcccttagttattccgttctaatacctcagttattctctgctcatgactcagttattctagtgggcgcactcagttattccatgttcatgtctcagttattctggagtcggtacttagttattctagtgggcgcacttagttattccatgttcatttctcagttattctcggttcagtactcggttattctgtgttcatcactcagttattctggtgacgaaactcagctattctctgctcgtgcctcagttcttgtgggccaactcagttattctactccaatccctcagttattccgttataatacctcagttattctaaaccctcagttattatgttataacaccgcagttattccatgttcctaactcggttattctaatgtcggtactcagttattctaatgcgcgccttgagttattccatgttcatcactcagttattcgagtgacagaacacagttattctactccaatccctcagttatcccgtgtcatacctcagttattgtaatgtgcctactcagttattatatgttcatgactcagttattccgttccaacaactcagttcttctaatggacgcactcagttattctggtgccagaactcagtaattccgttccaatacctcagttattcttgtgggctaactcagtgattatggtgtgcagactcagttattctggtgtcggcactcagttgttcggttctgatccctcagttattctactccaatccctcagttatcctgtatcgtacctcagttattgtaatgtgcccacttagttatgcggtgtttattactcagttattctctattcacattcagttattgcgttcaagtaactcagttatgctattgttcattactcagtaattctgttgtgcacactcagttattctattgttcactactcagttattatctgttcattactcagttattctgttccaacaactcagttcttctaatgcacacactcagttattatggtgacagaactcagttattccgttccaataccttagttattcttgtgggctaactcagttattctcctccgatgcctcagttatcatcatacctcagttattggaatgtgcccactcagttattattgtgtgcagactcagttattctggtgtcggcactcagttgttcggttctgatccctcagttattatgttataatacctcagttattgagatgtgccgactcagttattcttttgtcagaactcagttattctaatgggcgcacatagttattctggtgtgatgaatcagttattctcgtgtgcctactcacttattctctgctcattactcagttattctctttgtaatcacttagtagtggggactccgttattctctattcacaatcagttattgcgttctattaactcagttattccatgttcgccactcagttatttactcagttgttgtgttttcattactcagttatttcattccaacaactcagttattctaatggacgtactcagttatttctttcagtagctcagttattctattgtgtggactcagttattctggtgtcagcactccattctaatacctcagttattctctgctcatgactcagttattctagtggacgcacttagttattccacgttcatttctcagttattctcggttcagtactcggttattctgtgttcatcactcagttattctctgctcatgcctcagttcttgtgggccaactcagttctactccaatccctcagttattccgttataatacctcagttattccatgttcctaactcagttattctaaaccctcagttattatgttataatactgcagttattccatgttcctaactcagttattctaatgtcgatactcagttattctaatgcgcgccctcagttattctatgttcaacactcagttattctctgtacattactcagttattctctgtacgttactcggttattgtgcgttcattac

SEQ ID NO: 615 - DNA, 2209 bp, Zea mays
  misc_feature (89)..(89): n is a, c, g, or t
tctaagctatcatatatagcctaccattaattttattaaacatttagaattcgtcataagtaatactaataatattattgtttagacantttaaaatactaaatttaaacttcattcactaatttaccgtatgtcatataattaacatctcaaacctacccaacgcgactactccaaaatcgtgaaaataatcacatcgcattcatcgaattaattcaataattaagctaacggaaatatggatcggctaataggaataaccaaaaatgtgcgccaatattaaattcagctcgaatccactaatactaatttcacgtgaaacctacgaactgacgaatactagacgatgcgattaattcaatacatatcgctcttgctaaaaatacgagaaccaacgtaacctacataactatcgatccatttattaaaacaaataataaaagtagagaatcagctcaccatcatcaactccactcaatatttgcaataacgacgacagtctccggttgaagtcttcgaccgaacacttgacgagcaatgcacatgggcctctcgctttcttcatccacacacacaaattgcaccgacgagcagtgaggtcagagaggctcggtgttagagaaaaatactaggaatggccggtgatggagctagcagatgacgatggtgacaccgcgaagcaaacaaggttagacaccggcgtggtctactgggagggaataccagcgcacagcatggccaaggcatgacgcagtgagacgaacaacacatgtcgaggctgcaagagacgtcgacgcgctgcacaagaccgagctgggcacgacgagctcgcggccagggaaaggtatgagcgcgcggctgcatgaggccaggagaggcgatgacgtcatgggtgatggagagcacgccaggcacagaagccgcatggccagcggcgttcgtcgtggcctgggagcgaacgcatggacggcgaccagagctggagcagcacaaccatggcgaggtcagagacggtggctggtctagccgcacagggctggtgaaggcacaacgtccatggcggacgtgagcacgcacgagagagctgaaggccgaagcctggagaagccgtgaaggagacatgatggcgtgctgaagacttccagggacatgtacgcttcaagatatggattgagaaagggcggtggtgagccgatatttggagctggcgtgaggagattagttccagaaaatatctacgtagtggagatatttcagagattagtcgtcgctggaacggatgagaacggcggtagtggatgagctagagaaatacgtagaacttttttgcataaaatggatgcgtggataaatgctgccacagatctaaggaatttctagaatagagaaatagcgtatgggagagaaagatagcttaggccgtgagaatacaaggaaaaagatatttctttttatttctcttttttttgttatagcttatggataaacatagtttaagaaattagggtttagaagatatataaatggaccggaccaaaacgagatcgacaataatatttggatatgatttgatttggtaaatattctggagtcagatgaatttttacctgttatttatatttgtaaaattagatcgtggagagaaactcacagaccgaaccaaaacactatcaagatacgatacttgagacgccattaatttagttgaacccggataaaaaaattatctgttatccgaatgctcagagtatagcaagaaataacagaccagaccacgtcattatcttcgaacacgatttctcagataacacacggggtcgagattattttgaactgaaaactttatttgttgaattctaaatgaatttgtttgaggaaaaatttagaaggctgagttttagccagatgtcgacagatcaaacctaggaacatcggctttgatatttagatggggtttgctttagttggaattagacgaaaatgtatctgtcctccgaacaccattaatttctttgctgaggacagcgcacttggtcgggtttgtttcgaaccaaaaatcgttgtcgttgagttctaattaattttcactggataaaattatccgagtgggtcgggcttccgaattcatatttacgcgagcgatgaattttaaatagtcaccggacgcaccgatttttggaacaactatgttccgaacatcacgaaaatt

SEQ ID NO: 616 - DNA, 2206 bp, Zea mays
aattcatcgctcgtgcgaatactaattcggaagctcgacacactcggataatgtttatccccaaataaattaagtagaactcgatgacaaaaaatattcagggcaaaataatctgaatcgcgcattgtccgagaaaaatcgtgcgcgaggttatgatcccgtttattcttcggcacactctgtaattaataaaatcaactgtgtttcgacatcggataaatttttatccgagttcgactaaacgagtgttgcctcaaataatatatccgttgctttttgccttgatttaaatcttcggatataaatacctggtaaagtttatctgactacaaaatattcactacatcaaatattcgggatgcagcagatcagtttatccgacctcgaaatatccgcaattgtagttaaaaaatagatgaaaagaaatttcaattttttctagctgatttttccaccgatttcccttccatatccgaagtcgctagcacctggatattttctccacgtcgtcctcatcctctcttcgatctccagcgcacagccttatccccgcagccgccctcgcctgacttttcccagcggtgctcgtcttctacgcgcctagaccttctcctcctcaagccgcccagccactcctctctccctgtgccgcgacgctccctccctgcttcttccttcctgcgtcgcgcccgggcgccctgcttcctgcttgccgttcctattcctcctaccatggatcgtcagtctgagcttccccatccgagctcggccaaatcggatctcgctcatggcggctccccctattcggcaccgcctcgagctgcctatgtcgtgcgccctgcttgccctctcctccccatcttccatggcgccctgctcggtccgcgtgcccctgcgctcgcccaaggcgccgaccgcttatcccccttctcttacggcactcctgctcatctccctggctcgcccaggcagtgggcgcgctcgcctcagccggctgtggtggacgcgcagacctcctggccgtgggcggcgctggcctaggccgccgtcgcgccgggattttggcgtgcgtccctgcttccctatagtgctgaccgccgtcgttctctgcctgtgacctccggccgtgttggtcgtggttcctaccttcatctcactggcatgctgccaggactcgcgtgcgccatggctctggttgccacgctctcgcgcctccctgggctccttttgccgcgtccagttctggtcactgttatccgctgaaccatcgtcgcgccgggttgcccctgattcgtggagttcaccagctttcccgtgcgcagtcgcggatgtcgtcgctcggcccttgtgttgtgccgagctcatcaccgtcgcttatccctgacgctcgtccgactcaatgtctctgctctagcatgctatttggcactcggtcgtgcccagggtgtcgtgcttgttgtggtcggctctggtggtcggaatcgtcacgctgtccgtcccgcctggccctcaaatttactctgctccagcagtccgaactcactagctcttatgcctctctgcgctcgcgtgccactcagtaccgcgtcgttatcctactcacattcagctttgtcgtgattgctgggcattgctcgacgccctggcatcatgtctatatttgtgtctgccatcgtcgtcaagttctttttgtggttgcctcgcctgtgtgtgtgggagtgagaatagagctatggttgaagataaaaatgaagtctgaaagcgacgctcgtcagggctcccatcgtcgacaactttggttctccatcaccgggtccgtgtttcggccatcaggtaggatattcggaaaataccttatgatcgacatcatctcaatctgtatgtagtgatctgtgttttccctatgatagtatgtgtgaatcacattatgtgattgtcatagaaagctagatggtgtatgtaatgaaatgcgtaggcgacgcttattaggtgctcgatgttacgcttgaattggtgatcgtcgtgattcttgtaggatcgggcttgaggtggggtgagttggttggttattttgttagttgccttgcgtcggtaagctagtctacttattcgactagaattaattgtgtaacgatatggatacactaaagtcttgcgttagtagctatcatgttcatatttaggtttgagtggacaagttgtcgcg

SEQ ID NO: 617 - DNA, 2205 bp, Zea mays
ctgcaatagaataataacaaagtatcttaaaacttggatcgaaataaaagcataattgcataaatataactctccactctggaaaattaccgatctaaaaaatatacatgttgcactttaaacatttccaaagttacctcattcttcatatctacaaactctagtgcgagcattcgaacatctaatatcttgggccccaaactcatgctataggttgtcttgcacttgagttgatgatgaagcatgtgaaacaacatgttggaaagctcacgcctatagtaaattgatgatctgaaaaaaatctacatgttatgcttcaagcgcttctagagtgacctcatccttcatatgaccaaatctagtgctagcgagcaacaatctagtgttgcatactcatgttatggttgtcatgaacatgggttaatgatggtgcatacgaaacaacaagttgggtccatctgtaaaaactgtctatccaaacaatacaatatttagggcatcaaaatgcattgaagttgacgcacatcagaaattgatatatcatgcagtaaacttgcactaaattaatacccattagtcccatactcatgttttgatcggccttaaacttggattgatgtattcacaactaaggaacattgcaaatagcactatatatgttttaaggtaacatgcctaaacaagtatgtcttatagtacgacatttggaaaagagtaatgaaagtggaaatataatttttcttccattaactatttttcctttaatagaggtcgtaactttgcaaaatcgtttatcttgaaaaatctgcaaattacaattcaaatacttttaaagttacctcgttttttaaaacaatgaactttaatcggcatggggccatctaattatgtgggtcccacactcaagttttgattgtgttgaattttagttgctagtggagcgtgtgaaacaacatgttggatcattctataaatctaccagataatttagggcttcgaaaagcttcaaagttttcacatggttcatgccacaatcttttcaagaaaacatgcacgaaatcatgaccctttactccaaaatcattgtattgcgaaaactttgatgacaaaccttgttggctcgtttttgtaaaaactttcattctaaacattacatcatttagggctttgaaccccttcaaacttacattaatgtccataaccaaaaaacaattgaaatctttccacatatcttataagataacatgcccaaacaagtaatgtttacagtttggcaaagagcaaatggtaatgtaattttccttggttaaattgttttgtaataaatatcatgagtcccatacttgttttttgagtggcctcaaaacatgcactgttgtccataaccaagaaatatataaaatagcactacatatggtttaagatagcatgcctaaactagtattgtttatagtctcgcatagaggaaattgtaattaaaattggaatgaaaatttttctatatttaaaataaaagcagaattgcataaatatagctctcaactccggaaaattaccgatctgaaaaatatacatgttgcactttaaacatttctaaagataactcattcttcatatctataaactctagtgccagcattcgaacatctaatatcttgggcccaaacttattctataggttgtcttgcacttgggttggtgatgaagcttgtgaaacaacatgttggatagctcacgtctatagtaaagtgatgatctgaaaaaaaatctacgtgttatgctttaagcgcttctagagtcacctcatccttcatatgaccaaatctagtgcaagcatgctgcaatctagggtcacatactcatgttatggttgtcttgaacattggttaatgatggtgcttgcgaaacaataagttgggtccatccgtaaaaactatatgtctaaacaatacaacatttagggcttcaaaatgcatcgaagttgacgcataccagaaatcaatatatcatgcagtaaacttatatgaaattaatactcattagtcccatactcatgttttgattggccttaaacttgggttgatgtgttcacaactgaggaacattgcaaatatcactatatatgttttaaggtaacatgcctaaataagtatgtcttatagtacgacatttagaaaagagtaatgaaagtggaaatataatttt

SEQ ID NO: 618 - DNA, 2203 bp, Zea mays
  misc_feature (580)..(581): n is a, c, g, or t
cctttgtttaggcaaaggctcaaaaacacattttatttaattttaggaagaatattacttttgagtatatgatcgaatttcaagttaactaactaaataaataaatatacattaccctacttacttaggggaaaataatgtattctcttttaccaagagtcgcttcatcttgaatatatttttatttaagagcattctttaatttcacgaggagaataacttatgctactagattaaatatatttctattttatcttatgtttactcgatttcttagtattacttcctataaaagacatagaaggaatacctaaactcttaactcgtcatttattagggtttacaatttgaggagggagacttactaagagcatctccaacaacaaaccctaaaatagagtcctaaaatttgaaataggaccatatttagaatgtttagggtcttaaaagaaatgtttactccaatagtcagaccttaaataatgctatttaggaaataaatcatgatattaggaaataaatggttggagattaagtggaaatgagaatagggctccagtatatgggtactatatttagnncccgagagaccgagccctataaacatttgatgaaattttataaaatagggccgctgttggaaggatgttttatggttttgagccctatatttaaaataggaccatgtttagagcctctcttggagatgctctaaggctgtggaggaagaagaaagggaagcgccagcgcaacgctcgtcatgtgattggtaatatgcgcgaaccgggaagccatcatcgtcctcgtgaatttgagtcattaggtcatggtaagctaaaagtgtgttaatatttgttggattaacgagtacctttggctagtacttttaaccgtgataattctcgtgattggtcatgaggcgttgtgtgatgtcacctgatccatgcttgttgcatttgtattgcttgtagcggtgtcttataaatggcattgtctagaaatcattaacttataggttacgtgaagggtgttccataattgtaatctctagtatggttcacatgttttaatccatgttttaagtggtggaggcaacatgtgtataatatttgttgagatgtttcgtctcttgcgttggcgaatagtattttaggaagaataagtgtgcgacatacggttaagccaagattgaagtacaaattatatgcaatgtgatgggattcgtgattatataggagttgtatttgttgatgtgatgagtagtttagaaaatactcatttgcgtggcgaatgtattattgagacctgtgtatcggagttcgtatattagtggttgcgtaagatatttgattgaggtgtgcgggtatatgccgtgatatggttacacttgcgatgagggaagatgtatatactgtgtacatgacatttgggctgatgttgtaagttctatgtgaaggatgcttttgatggtcatgtgattgacgggtggtgtagtggcaaagcgagaaataagtttagtgttccaaacggttagttgatagtatatatcggtgttgtgatgttgatttttgttgtatggcagatccatgcttcgtgttatcaatcattacattccatacctaattgataaataaatgtctttttgatcgattagaggtcttgtatgagtgttatcgttgtccaaaaattaattagaagtaagtagcattcataagccggaccctattgaaatcgaagaacgatccgatgagatacgcgtatgagtctttaggtccttaggtattaaaatatagtattgtggagttttatgctatgtgttaatactctatgtgttagaccaaggaaagatgtgagttttatttagttgatgtgtaacgcaagttaacctgataaagtgaattagagaactcgtaaaaatttcttccatgcatagtctaaagttttgatgtcctgaaatggtgagcctaaaattcaccagtcttttggcaacaccacttaaccaagaaaaatataaacttacaatgtgttagtgtcgtcttaatatgagggctacgttttgtcaaattggaaaatgtgagatatgtgtgctcgtaaattgtagcttgtgactatagttctccaagtagtttgaattttaattagtaaacaaattgtataatgaatgatgcctggttaagtgacaaaatgcctagttaattagtaa

SEQ ID NO: 619 - DNA, 2202 bp, Zea mays
ttagtattaattaatcacttcttgtgtggataactattaagagggtactatagacttgcccccacctccctaccccgcccgcctgcccgcgaacgccaggattttcgcatcgcgcctccgcctcccaggattgtcatgccgggcctccaccattttcgccgccgcgccctcgacaccacctccaaggatcctcgcccccgcccctgtactcctcgcgtccgtgtctcccgctccatttccgctgcccgcgatgcgctcgcacgcgtcgcggcccctgacccgcgattgcccccctccccgtcaccacctcgccgtggtgtacccccgtccttggcgccaccaccccgcaccctgtccgatattggctcttccaccgctccccctggagatgagcgctcgcctagggttaggcgtccgacggctgtaccctccaccacaagcgagaggagatcgctggaagagggggctgggagacgagcaagaacacgatccacatctgggtgcccccgcctcccactctctcgaatcccgatgcccacacagcgcctccgccctcgtgagaccgcgacgcagatcccgcccacacagcgcccccacctcccatttaccgccgcagatctcgccccctttcctcccttgccccatccccaccatgcgcgcacctccgggcgtcaccccctcacctccctttcccacgtgtcgtgatcaccagatcccagtacgtgtttcctccctcccgacctctcataggtttcttctccatgtccccaccccagatctcagttctcccccaccatgccatcaactcaggtctcccacgaaaacgtctacacaaccccgagctgcgggtggtaggcactccccatggggttgcaaagtattaagcatgggtaatttgagttatgcctagatagttgtatttctcttcgattacactgtcaattttttttgtcaagacacatgtgtgatttttatggttggattacttatattttacccaatgtcaactgtcaatttgtccaattacgaagttggatttcaatggaagaccttgtttttcgtctttacaggagtaccctcacgctccaatctcctctagctctgggcgaaattgacaagagtcattgcctaaagcttcatatcgatggaactcacatttttcaatgcctctataatgagtactacggtgttagtgtcggtcgtcgggtcttaagatatctattttatatatgattgaggtcttatatctaccaagtaggatctatactttgcctcttcacttagaaattttagacatctatgtgcatgcttccaagcactgtaatccactattttcgttgtgccagacacttggtgttcctatggacagacttgtgcgagccgtagattcagtttcggtatgttccaattttcagtgcactacatgctcagctacacttgcatgtgaatgggctacactgcttggggttccactgctttcgtacatttcgcgagggagggacacatttggattttgcagttattcatgttgggacgagggaatggctgtgtgtgtgcgacgagtcagaggaggctaaaatatgtaggagtgtcatgcaaaaaataatattgtactaaactactggtgtagtatttggagatacctttcaacatttatagaaggaatgtcatgctatttaaactagattgatggcctagattttatggttaattaattgacaggtttattaaacctaaaagacacacacttcttgctacctaactaatgattgactgtcgccacgcattagaccgaacatcaacgtaaaatgagacacctaatggtagcataaatacttaactgaactaatgtgtagaaataatcggactaatatcttgctcagggactgctccttcctgtgctcgagtctactctgctggtacaagcaaaaacatgttctgttaaggaaggtacgtacacattacaacaatttggtgcatctctgttgctgtttctggagctttatttgacatgcttgccttcttgatttttgaactactcatgaactggactacatactccaacaaggccagtacaagcaatagataaataacttttcattttatccagttgcataatcatttggctatctactcatgaacaggatctgtcagtgcagataaggagtcacaagttgtaaagggtaatttgcatctgaggca

SEQ ID NO: 620 - DNA, 2202 bp, Zea mays
ggatatttgagtagtcattcttgatctcaaactttcataatcgatgttgggttgctcagggggaaaatgatgatttttttttgatatttaggaaaaaaataccatgatctttgtgcacaccaggaaagagaagtaggaaaacactaattgattgcaagtttacagttttcatgccaaatacaggcccctattaaaatttatgctctttcatataatcagtgctctaaaataattaagttcatctccttaattgtgtataaggaaatacttaaaatacagcccttactccaagtcagtaggtcaaccgtaaagataccaacagaagatagaagttctctaaaaagaatgtttagaggacacgttttttcattgcaagtgcagaatgttattttctttcatttttaatcttaacaattacaagatatgtcccagttgttgactgcttgactgatcacctcttatactaatatgtagagaatgggaaacattgatgacgtcgtgcctttcttcgggagaaccttcaacaaaatctacccactcattatggttgtttataccctattggtcgctgtaaattttttcgagcatctgatagacttttttgggagcttgaaaaggttcaagtgctggactgaccaagaaggagatatggatgggttggatccgtctggagtattcattcttcagaaaggtaagaatttcgttacgagcagtaccttgtgtctgaatctccgtcgcagcatttcctatcaacttatcatgcttacacagaccattccaaaccctgcttggttttgagagaaaaaaataatcaaaccctgctagtggtttcggtaacgtgaagcttgttgctggtggttttattagaaaccctgcttagcttggttatagaagtcattttgctccagcgccggcttgctctatctgtgtatcgtctgtctgatgttatttgctttcttctgcagagagaagctccatggaacaaggacgcaaagtcagtgagcatgcagctccactagcaagaaacttcagctgtttaggcgaagacgtcgaatctggaaacataccacaggtgcgaattagtctggctgcgtcatagtccttcttctagtccatttggaggttccactctcagctaatctttaacttgttttttgcacagggtgacggtacagtggagacggagccggaacgaaccgccgcccagccgaaacacggtggcgatgtcgctcagagtcagagatattctccggcgagggaacagtgcagcagtccgaaaccagtggaggttcagaaggggatctcatcgacctccaaatccaatgagccgccttgtgtgagtgcggcggcagattcaccagctgagacggcctcaaggtgggcctcaatgaagacgggtttccagaacctcagagcgaccatgggcggctccaggaagttcctcctattgggcctgtctcctagggccgggacgaacgaatccgctacggaatcactcgacgagatcttccggaaacttaagcggcattcgagcaacgcggatgcgaatcgactagacgacgacgacggattacctttttgaccaacggtaggggcaggggcagcaacacagacgagcgcaacactgttgagaccggcaaggtctcgtcctttcgcttggcgtatctctcacgactcaagtctcaaggtagcaaacaagaaagctaaaggctgggaaggagtagagggtacactggatggcagggactagaccaaggtacagaacataaagttttctgtatgttcgagggtaggctagacgtgccacaaataggacaaaaccctaaaaatgtacagtacgtgcaagccctagtatcatcggtgggctgccagatgtgtttgtggtcatctgtcacgctattatctgattgcttacttctgaacagataactcccaaaaaaaaaaccatccgcaacggagaatgcataataataataacccctctaaagaaaagattgatgcataatgaaggactgccaaagcagtgtcttagttgtacgccactcctttatccgagaatattggttacacctgccatggaagaccaagtgcctagaaaagcaaaagttgtgcagctgctgatgcagcaatcatgttgtcacttgcgattggaagatgttcgtcgctacttgccaaaacaggcaaacgactcgctgccagtag

SEQ ID NO: 621 - DNA, 2201 bp, Zea mays
gcatatatgttgttctgttctcaacgtgtaatgaaaattactggatgattgataattatagtacaaacgttataaaattaatgggtgattgagaaagtgttgaacaaatactgcaaaattgatgcatatttattgttcttttcttagcgtgttaatgaaattactgggtgaatgaggaagtgttgaacagatgctgcaaaattaatcagtgattactgtaaaattactatgtaactactcaatctgggtgattgaaattactgaataaatggtgcaaaattactgagtggagactgtaacattatttagtaactagataatcactacatatctgttgttattttctcaatggataaatgaaattaccatgtgcttaaggaattaccgaacaaatgatgtcaaactactgagtgacttatgtaaaattatcaagtgattactgtaaattaactgagtaactagacaatcattgcatatatcttgttcttttctcaatgtgtaaagaaaattaatggatgtttgataattatagtacaaacgttataaaattaatgagtgattgagaaagtgttgaacaaatactgcaaaattactgcatatttattgttattttattagtgtgttaatgaaattactgggtgactcaggaagtgttgaacaaatgctgcaaattaatcagtgattactgtaaaaattactatgtaactactcaatctgggtgattgaaattactgaacaaatggtgcaaaattactgagtggagactgtaaaattatttagtaactagataatcactacatatctgttgttattttcccaatgggtaaatgaaattattgtgtgattaaagaattactgaacaaatgtcgtcaaattactgagtgatttatgtagaattatcgaatgattactgtaaattaactgagtaactagacaataattgcatatatgttgttcttttctcaacgtgtaaacaaaattacttgatgattgataattatagtacaaaccttataaaattaatgagttattgagaaagtgttgaacaaatactgcaaaattactgcatatttattgttattttcttagtgtgttaatgaattactgggtaactgaggaagtgttgaacaaatgatgcaaaaataatcagtgattactgtaatattactatataactactcaatctaggtgattgaaattactgaacaaatggtgcaaaattactgagtggagactataaaattatttagtaactagataatcactacatatttgttgttattttctcaatgggtaaatgaaattactatgtgattagggaattaccgaacaaatactgtcaaattactgattgatttatgtaaaattattgagtggttactgtaaattaactaagtaactagacaatcattgcatatatgtgttattttctccacgtgtaaagaaaattactggatgattgataattatagtacaaacgttataaaattaatgagtgattgagtaagtgttgaacaaatactgcaaaattattgcatatttattgttattttcttagtgtgttaatgaaattgctggatgactgaggaagtgttgaacaaatgctgtaaaattaatcaatgattattgtaaattgctatgtaactactcaatttcggtgattgaaattactgaataaatggtgcaaattactcagtggagactgtaaaattatttagtaactagataatcactaaatatctgttgttattttctcaatgggaaaatgaaattactgtgtgcttaaggaattttctaacaaatgatgtcaaactattgagtgatttatgtaaaattatttagtgattactgtaaatcaactgagtaactagacaatcattgcatatatgttgttcttttctctcttgttcttttctcaacgtgtaaggaaaattactcgatgattgataattatagtacaaacgttataaaattaatgagtgattgagaaagtgttgaacaaatactgcaaaagtactgcatatttattgttctttttgtagtgtgttaatgaaattactaggtgactgaggaagtgttgaacaaatattgcaaaattaattagtgattactgtaaaattactatgtaactactcaatctgggtgatttaaattactaaataaatggtgcaaaattactgagtggagactgtaaaattatt

SEQ ID NO: 622 - DNA, 2198 bp, Zea mays
gccctacatctcccaaacccctcaccagagcccgcgctgtcctcggcgcgctcaatcgccccactccgtggctgggattgctcgccagagtacccccgacccacctggttcttctcctctgtggcgaattagagcatgctggtgtcgctgcgcgtcggtctgccgcacctccatggcgtacggccgatgcagctccaccccttgttcaagttgtggacctagatgtcccaaactcctcaccagagctcgcgctgtcctcggtgcgctcgatcgccccactccgtggctgtgattgctgactagagtacccctgacccgcccagttcttctcctctgtggcgaattctagcttgccggtgtcgctgcgcgtcggtctgccacacctccacagcgtgtggccgatgcagctccaccccttgcccaagttgtggccctagatgtcccaaacccctcacaggagcccgtgctgtcctcagtgcgctccaccaccccacttcgtggatgggtttgctcgctagattactcccgacccacgcggttcttatcctctacgacgaattagagcttgccggtgccactgcgcgtcggtccaccgcacctccacggcgtccggccgatgcagctccacaacttgcccaagttgtgggcctagatgtctcaaacccctcaccggagcccatgttgtcctcggtgcgctcgatcgccccactccgtggctgcgattgctcaacagagtaccaccaacccgctcggttcttctcctcttcggtgaattagagcttgctagtgccgctgtgcgtcgatctgccgcacctccatgatgtttggccgatgcagctccaacccttgcccaagtggtggccctagatgtcccaaacccctcaccggagcccgcactgtcctcggtgcgctcgatcaccccactccgcggataggattgctcggtagagtaccctcaacccgcccggttcttctcctctacgatgaattagagcttgccggtgccgctgcacgtcggtccgccgtacctccacggcgtgaggccgatgcagctccacccgttatccaagttgtggccctagatgtcccaaacccctcaccggagcccgtgctatcctcggtgcgctcgatcgccccactccatgtatgggattgcacgccagagtacccccgacccgccagttcttctcctctgcggcgaattagagcatgccggtgtcgctacgcttaggtttgccgcatatcaatgtcgtccggccgatgcagctcaaccccttgcccaagttgtggccctagatgtcccgaacccctcaccagagcctgcgctatcctcggtgcgctcgatcgccccactccatggctggcattgctctctagagtacccctgacccgctcgattcttctcctctgcggcgaattagagcttgctggtgccgctgcgcgtcggtccgccgcacctccacggcgttcggccaatgcagctccaccccttgcacaagttgtggccctaaatgtcccaaaccactcaacggagctcgcgctatcctcggtgcgctcgatcgccctactccgtggctgggattgctctccagagtacccccaacccacctggttcttctcctctgcggcgaattagagcttgccagtgccgctgcatgtaggtccgccgcacctccacggcgtccagccgatgcagctccaccccttgctcaagttgtggccctagatgtcccaatcccatcactggagcccgtgttgtcctcagtgcacttgatcgccccactccatggctgggattgctcgctagagtacccctgacccgcctggttcttctcctctgtggaaaattagagcttgccggtgccactgcgtgtcggtccgccgcacctccacggcgtctggccgatgcagctccacccctttcccaagttgtggccctagatttctgaaaccccacactggagcccgcactgtcctcggtgcgcacgatcgccccacttcgtggctgggattgctcgctagagtacccccgagccgctcggttcttctcctctatggcgaattagagcttgccggtgccactgcgtatcggtccgtcgcacctccacaacatccggccgatgcatctccacaccttgcccaagttgtggccctagatgtcccaaacccctcaccggagcctgcactgccctcagtgc

SEQ ID NO: 623 - DNA, 2196 bp, Zea mays
aaatctataccctcccatggaagggtggttgtaacaacccaggtgtttatcgtctgctcgaccacgagtgcggactttaacacgtgatagcggtgaataacagtctctctgtcttaatctatttttgtctgtcacgagttcgacatcatttttatttttatctatccgggctcgtcctaaattttcgtgatgttcggaacataattgttccaaaaatcggcgaacttggtgattatttaaaattcatcgctcgcgccgaatttagaaacttagtttagtccttcgactttgtccaaaacaagatttattagaagtcgatgactaaagttttcagtgccaaataatttagtcccctctcgtcaagcgagacatcgtgtctgaggaattataatcatggtcggtatccaacaaattatcctcgacaaagaaataaaacaggttcaaatggcagataaatatttgtctgattttagctgcatcaaatatcatctgaagtagtgaagccggtattattttggatctggctgtttatgtgttgctcgagaaaaacaatacgccatctcattaatcgaatcgttctgtagtcaaatgaccgaaagcacgtgagactcgtaaaaatttgactggattaaatatagtctaaaatatcaaagccaaaatcagtttggttcaatctgtgtgtttcttgtcttgatctaaatcttcaaatagaaataatgggtacgaattaatctgactttggagtagtcatcaaatcaaatcgtgtccaaatatttgttctcatacatataacggtgttgaaaaaaagagaaaatatctcttatcctcatctcccaccgttgacatgcattcatattttttcttcatacgtgtataccagatctttgttcctatccagtggttgatatttctgcaacgcacaagtgtgccagccgtatcttctttgcctctcggttcttcttggacactctctctctcacctcgtcattctctctcgcgggacgttgctctctgctagcgcctggatgctcgcctcactcagctctcgttctcctcgcccccatgctccatccatggcgtgtgcttgccagacaccgatatgagcttcctatgttcttctggccctgctccagttcggcatggtcgcacgctgttttccacagctcagatttcgccagccgccgttctccggtccgtgtgccgttcgacgtcttggagttttgtttggtcggctcgtcgttgacctcgtcggtgtcgtcgaaccgtcgaaccccttcctcaatcgcgtcgggtctcaatgccagttgtcgtcgttcgtcgtcgcgtcgtgtgtgcaacaacgtcgctgattcctccatggtgcatgtcgacgaacttcgcttcatcggttcctcgcttttggttcggctcacgtatgcaggccgaacgcattcgccgcttgaccctatgtcactagagctcgtggcctcgccaacgacggagtcctcactggattcgtgtcctcgccagagctcgcactaacctgctcgaccacacctcaccagctcgctctagactcgatctcgtcgtcgttccgtgcgtcatcaagaaatcccaagagttgaatgaagacgaagctagcatcttgaaattcaccaagtactcgacgaaaagcctgaactataaatcatcgtggttcttgcagagttcgcgtcgaatttaatcatgggtgagctgattcgctactactattattttgttttaattaatggattgatagatatgtaggttgcgccgatcctttttatttagcataggtgcgcttagtgattatgtttagatccgttgttgtgtcggtgtgttgttccctggtgatataattatttttagaattataaagtagtcgggtcaggggttaaggtctagaattttgataaaaaaaagttatgcaacgaatatcttgtctgtagcacaggcatgttgtggttttattatatgtttgataaaatgccttgttacatgtattgttgcaattgtgttcgtgattgacaaataattgtgtcgcatagagcttaggtttaaaatgcatattatgctaggagtgtattactgaatgtataaatcaagtgtgattggattaataataggaaaggcaggttaagtattttaaacggctggcgggcaggatttaccactgtttctaggtttttaggtgtt

SEQ ID NO: 624 - DNA, 2195 bp, Zea mays
aaacaactcaactaactatttaaaccactcttttgaattaacctttataatatccaaactaataaaacatcacactatacttaatctatcaagtagacaatcatcacaccacatatatatttaccaatatacttatcacataaacctaaaattcaactttaacctccgcatcaagtaatagacaagagaatcatcgcaatcgatacatctatttaatcgaaccatctatctagttgacgggaataacgaatcaactcaccataactaaactcgacccgaatccgcgaggtcaacgacgattctgcggatgaggacaacgaacttgaagggcggcgcggtgaaattattggaacggctgagtcatggacgtggttctgtcgaggcgagaacaagaaacaacgacgacgtccaaagcacgacttatgaagaacagaatggcgaccggcctaggcgcgatgggtgagttgagcgactccgacgacgtgcgcgagctcgttctgggcatggacgtgagttggagcagaggagaacacggccgaaggtccggagtggcgctgcgtggtggagattggcagccgggtgtcgacgagtgcgtggagtcctgcagaactgtgatgctgaagatggcgtggtgacgagtgaacacggggctgagtgacgacagcggtgtccgagtgctgtgaggcaacgacgaggtcgacagtcggtgtcacggatgaaaccgagatcggccatgacagcggagctacgacgactggatcgatgtcagttttgagcttgcagacgacggtgttgtccggcgaggccacacgcagaggtggccagcccaagtgcacgacgcgcagtgcggcgatggcggccaggatcgagtgttgctggccagtagcgtgacggcgaggtagtggtgaggcccggcgagctcggaacaggggctcgacgaacggcggtagggaggtcgagtacagctgaggataagatcagcgtgtgagggagatacccagcggcggctaggagaacgatgggaagggcacgcggccaggcacctaggcgaggggagcacgtggcttgctgggggctcctacagcctggacatgatagggagatgagcaggaaacatgcacgcggataaggaagaggatgtcgtaggaaagtttctagcgtctaggagatgtacgtgacctgtgaacttgtaccggctgaagataatatcaacagaaggtaaggctaaaagccttgggaggggatgacgtggggttgagaagaaaaggggattatcccccattttcttaaatgaatacataaagataattagatcataggaatagagggctgtgggatatttccggagaaaagcacggactcaagataaggaatgaagggagatgaacacgtaatttttttagcgatgattaaagggtcgatgatacgggctacatatctcattctaatgttttagcaaactaaatcatttaccaattacttgctgtcagtactaattatagtggtttggtttgcttcggacaggatgcaaatagaccgaattagacagattttggcgtcagtatttagtcggggcttaactcgtctaacctaataatctcatccactaatcaagcactcgattactctgccgaagacaacacactagaaaaaagaggcccaattattactcttacgctcgccaaaacaacgtgctggaggaaaaattgggtcataacctcgtgcaagatttcacgcgattcgaattattttaccccgaacattttagttgtccagttcaaactaatttgctcggaataaaatcatcaaagtggggcgggcttccgaattcgtattcgcgcgagcgatgaattttaaataaccatgggacgctccgattttcgaaatgactatgttccgaacatcacaaaaatttaggaagagcccggatagataaaaataaaaacgatatctcactcgcgacaaacgaaacagatgcgatattaaaatcgcgataaacgaaaataattaaaatttggcatccgttttatccactgatattacgtgcttaaattcatactcgttgtcgagcagaatataaacaccaggggtgttacattacactaggatcgaactgtgttgtgtgtggtgctgacgaccgcgccgtactagtgccaaacattgatatggatcaatagagagcctaagagatgaag

SEQ ID NO: 625 - DNA, 2192 bp, Zea mays
cttaaagcccgggtgtgacacatactgtggagaaggctatttacatcacaaaataaaccctattatgcagaattttttaacactatgatgttcttcctattctcatttgtcatcattgatcaactataccacccttgaaatgtctgggttttgtaccaacgattcgtttcagcattttttgtttttcaaataccatttcgagagtgtaaataactttaatagaattcaaattgatgtacttaggtaggcctgagccctgtttatcttcgatatatatggtttgcatgtcaccaaccattgtgggcgatgattgattatttaccgtcttgttttatctgtttgtactcctttaatgcagcaccttcgtgtgtcatgtgtcgtctcccctgaaagatgttgattattattgtttattttttagcaatgaaaaagtacgtgtacaatcttatatatcttttaaagtatgtaaacatatactttacaaaagtatataataacaattagggtttttacaaatcaacgtaatttatcatattgattccgtagcaacacaagcatataactagtaaagacataataagttcattagaaagattattgactgcttctccatttcccgaggcaggagagcttggtactcgatagtcatggattgagtatgaactctcggattctccacaacgaggattttggtttccaatttcatttagtttaacctcctagaggaacttagtagttagaggagctgggtgggggatgagtttatttatcgtttcgataaataaaagggaatagaaaaaagggtacaaggaagaattccatcacaaggaattgataactggagaaccaaagcaattaatatcggtcagagtccctttcttataagatcgtggtttgatcaaacattttcacgaacctagtagatacttacttcatacctttcaagattaggctagagccaactatatcctacacaatgaatagatcgctctttcgatagcaactgacaaaagatatggaacacagcaagcagtcatagaccgcagaacaaacatactttacctatccagggactttactctattgaaagaagcctgaaactaaaattccactcttgggaagtagagaaaactgggttatgcattcaagagtgaaggttggagatgtctgattcatcgacatcacagtcacccagctcagagctacacaaaaagaacaaagctaagagcgaatttcgaaacccatgcatatgcctattacgtatcccgcgcttggctccctttactaccctgaacatccatcccgttcatacatacttgcctatctttctaaacctaaaccggtgctctttctcctaaatatgcatcccaagcttgctttcaaacctctacttgccctggctagaccagttcatacctattgagtttttagacctttcccgcctcctttgcggatatgcccttattcagctcttgaaagaaagagagatagaaagagagaatgatcaaactcaactagacgacagttcctcttgttcaaacctctcttgccgagtcatctcctcatagcaagttccggggtatagctttattttgtttttccctataagaggagatacatataatgcaaataatatttgatacattaaactgcatagaatgatcattaattagatcaacgttgtctgcctcttcgcaattgcaaagagggtgtggctcataccacatgggtaaaggcaactactattaaattaaagggacatgtacatttcacccactagtctggacgcgctgctcaaatctacctcgcccaaattctctacttagttttccctcccacctccacacactttgctcataaatcacctcacggtggcattttctcccatcaaaggctcttccatgtggacataagtccttacaagtgggacccatcctcactcccctgcttctcccccaaatcgaaatcgcacgcgagcaccctcccaggctccactgcgccttccctccacggctccaccacacggctcccctccaccgtgccatccgtcgagcagtcgagcggctgccgtccaccgaacctccaccgcgcctccctcgagcggcgagcgctcctctccggcgagcgctcctctcggccgccgtgggtctcggacgccgcgggccgcacaggcaggcggatctcggccgccg

SEQ ID NO: 626 - DNA, 2191 bp, Zea mays
cacctaaaaacctagaaacactagtaaatcttgcccgccagccgtttaaaatacttaacctgcctttcctattattaatccaatcacacttgatttatacattcagtaatacactcctagcataatatgcattttaaacctaagctttacgcgacacaattatttgtcaatcacgaacacagttgcaacaatacatgtaacaaggcattttatcaaacatataataaaaccacaacgtgcctgtgctacagacaagatatcggtcgcataactttttttgtcaaaattctagaccttaacccctgacccgactactttataattctaaaaataattatatcaccacggaacagcacaccgacacaacaacggatctaaacataatcactaagcgcacctatgctaaataaaaaggatcgtcgcaacctacatatctatcaatccattaattaaaacaaaataatagtagtagcgaatcagctcacccatgattaaattcgatgtgaactctgcaagaaccacaatgatttatagttcaggcttttcgtcaagtacttggtgaatttcaagatgctagtttcgtcttcactcaactcttgggatttattgatgacgcacggaacgacaacgagatcgagtctggagcgagctggtgaggtgtggtcgagcaggttagtgcaagctctagcgaggacacgaatccagtgaggactccatcgttggcgaggccacgagctctagcgacacagggtaaagcggcgaatgtgttgggcctgcatacgtgagccgaaccaaaagcgaggaaccgatgaagcgaagttcgtcgacatgcaccatggaggaatcagcgacgttgttgcacacacgacacgacgacgaaagacgacaaccggcatggagacccgacgcgattgaggaaggggttcgacggttcgacaacaccggcaaggtcaacgacgagccgaccaaacaaaactccacgacatcgaccggcacacggaccagagaacggcggctggcaaaatccaagctggggaaaatggtgcgcgaccatggcaaactggagcagggccagaagaaaataggaagctcacattggcgtctggcaagcacacgccatggatggagcatgggggcgaggagaacgagagctgagtgaggcgagcgtccaggcgctagcaggagcaacgtcccgcgagagagaatgacgaggtgagagagagtgtccaagaagaaccgagaggcaaagaagatacggctggcacacttgtgcgttgcagaaatatcaaccaccggataggaacaaagatctggtatccacgtatgaagaaaaaaatatcaatgcatatcaacggtgggagatgaggataagagatattttctctttttttgaacaccgttatatgtatgagaacaaatatttggacacgatttgatttgatgactactccgaaatcagattaattcatacccattatttctatttgaagatttagatcgagacaagaaacacacacactgaaccaaactgatttcggcttcgatattttagactatatttactccagacaattttttacgagtctcacgtgctttcggtcatttgactatagaacgattcgattaatgagctggcgtattgtttttctcgagcaacacgtaaacagccagatccaaaataataccggcttcactacttcagatgatatttgatgaagctgaaatcagacaaatatttatctgccatttgaacctgttttatttcactgtcgaggataatttgttggaaaccgaccatgattataattcctcagacacgatgtctcgcttgacgagaggggactaaattatttggcactaaaaactttagtcgtcgacttctaataaatctcgttcggacaaagtcggaggactaaactaagtttctaaattcggcacgagcggcgaattttaaataatcaccaggctcgccgatttttggaacaattatgttccgaacatcacgaaaatttaggacaaccccggatagataaaaaataaaaacgatgccgaacttacggcagacaagaacagattaagacagagagactgttattcaccgctatcacgtgttaaagtccgcactcatggtcgagcagacgataaacacctggagtgttacaaccacccttccatgggagggtatagattt

SEQ ID NO: 627 - DNA, 2189 bp, Zea mays
cgacgcaaattatattgaataaatagcatttctcgaatttaaactacgtggcacgattttattggtcgaaccgaagccacgcgaagggccacatgggacacaaccacataggatgaaaaggagtgggatctagtgtggctagcatctcctcgaactgctcactcacacgcacctgaattagtggctccttcttcaacctcaagaacgcagggagagaggcaaggctagcctggccggggctcgctggacagggaccgcgccagcagggtacctcgtcggacaggggcagtcgtgcagccgccatggattcggccatggggctggctcggctcggtgaaagagcgaaggcagagtagggcaagatccagggaggggctgcaggtggccatggaagctgagagagatggagacgaggacgactgctttagagcttcacagtgtcgacggtcgagaagggcgaggtgggcgcgcgacttgtggtggccaacctccatgcaggatcaagcagggaagagcagggctggacatcaaggatcagctgaaccagccgacaaatcaactcctcctgccaagaggatgactcgacaatccaaagccaccaagtcggatgtcacagccctcgcatatagtaacggagctaccggcgagaaggccgagaagccggcctcagcttctcctgccaagaagatgactaagcaatccaaagccgccaagtcggatgtcacaacttctctagttgcgatgccgactcctctggtattaatcttatcatgataaacctttgtattgcaccattgcgaggagtctacccaattccacaaacccgtagacgttcaaccaatttcccgacgtccacctccggcaaaccctaaggtgatgacttgtgactcatcgtagccggaaaagcttcagctacgaccaagcctgcaaagaaagagtcgaccaagaagatgccgacgaagaaacatcaagcatcagctgaactagccgacaaatcagctcctcctgcaaagaggatgacttggcaatccaaagccgccaagtcggatgtcacagcccccgcagatagtaacagagttgccggcaagatggccaagaagccagcctcagctgccaagaggatgactcagcaatccaaagccgccaagttggatgtcacagcccccatagatagtgagggagctgccggcaagaaggccaagaagcagcccattagtggtcctcgagtgcctgttgtggtgtgttagtgcagcaagtaagtcccatcctacacaactgatcaatcctatgtctttgagttctgctaaactatgccgctttactcctcttcccttgagactcctgtgccaccttctccgcctccaagcccaaaagatattgcaaagttggatcgagaaggggataacgaccaccagcgagttacaatcgctcaagctcttccaagtattttgataggttttgcatgattcatggactcaaaatgcttaaacgatcctctatgtatcaatatgaaggtatgcaatataggtacaccattggtctagtgtgtttgattgtttgtgagaccattggagcatcttgtgttgcgctgcagcagccgctgcagattgcgttagcccagttatgcagagcagcataccagaacatccaactttcgtatataaaatgcaaaacaattcaactcttacctcatatcgtaccataaattagtgtgcctctccacactagtcttcttaaacctagagaaatggatattagaataactgagtaccgaaactagaataactaagtcgccacactagaataactgagttactgaaacggaataactgacttgtgaacagagaataactaagtgatgaacacggaataactgagtgggcacattacaataactgaggtattagaacggaataactgagtaatgaacaagagaataactgagtgcgcacattataataactcaggtattagaacggaataactgatggattggaatagactaactgagtgcgtccattagaataactgagtggcacataaataacttgcacatattacaataactgagttgccataactattcagaataaaataaatgagtggcacatacaacaactgagcgttcatcgtagaataactgagtttggaacataaataagtgagcatccagtataatacaatcgagt

SEQ ID NO: 628 - DNA, 2188 bp, Zea mays
ttagaccaccgcccggacgcctaggcgacgccttaagaacagagatgactagattagcctactatgttgtcaacattagctatttcttatactaacaatgaacgacctccataagtccacacaaatcaattcatcaccatttttcttattgatgccacatagaacgtgtgagcccacagaatgagctctttctgctccaaacacataagtttattgttgtaatactcataaaactgaaatcaatgtttaagcctattagatgcctatgcatgtgttcgttatattctgtctcatagcgtaagggcctctagcgtaatggttaaggcttccgagtagcacctccaggtcccgggttcgatccccctcggggggccatttttgggcttcattaaaaaaatcccctcgttgtgccccgcccgctcccgggttacgtcctgctcatcaccctccggctgggtcgttgcagagtggccggtgacagcccgctagtgatgggaggccagggaccggggattttttccgctgggataatgtttcggtctcttcttaatataaaacaggaagggcggcctttccctccccgaccaagtttttttatattcggtctcatatatagtcctcgttagatgtctatgcatgtgtcctttttgtattctatctcatatatagtctttgttctacacgatctctatctgtatcggtgtatatatttgaacctagtgccttcatattcaatatagtgcgagacataacatgggatacagagccaatatctagggttatggttcttcccctgtctacgattttttccaacttgtcgcacacattacggtctcagacaaggacaccaaacactctgcacccacacgagaccaagttacactcgcgactattgtccatgtgctgttgtgttctgctcacgctagcaatcccccttccaaatccgggtttgtagatctagttctatttggtaataaaattacatcttgtgtagcttttcttttgcgctcttatcgtcgcacgttgttgctccactctgcgctctaatatcgaccgctaatatggtatgtctttgacttctttgtctagtggtgctccagttctacgatattcgatgtttttaatagcaccaattacccatgcatgtgtctgcacatgtggttcgcgcctttgagagttcctcaccggcaatccagcgtgtcatgcttatcctatcgctcctacatcgcctgtaatcccaaagaaggctactggcgaggagttaattgcacactatgatgatcagatgtcctcttatgactcagtttagtccttacaggacttggttagattagggtgcccatgtcagtgttgttcttgcctcaaatatggaggatcgtcttaatgctaatattgttgagtttgagtttgcacatcacatgtgcgctttttgtgtggtcgttacgagcctattgatcagtctacctatcttgttgctattcgtcaagagcatcttttacaacaaagagattctacaattgatgagttctacgcttagaggtctgctatttagcgccaatttaatactcttggtccctagctatcaacagatagttgtcaatcttagtaggattaaaaggttgcacttgagcttcaaagtacctactacctacaacttcttgacccgacttcgtgacgagtttgagccccttcatgctcaggtgctcggtcgtcatccctgtctcactgatggatgttcttgctagtgtctgtaacatggagactcatctatgttgttggcctattgcagtcattgtaggtcttagctactcgtttttcgtcttctcggtcgcctgctacacctacgctaccgccttcggttgtgcctctttctgcgcacgaggggcatggtagtcttcattgtgcttagtgtggtgatgacgagcatgtggaagcctattgtttcaagaagaaggctcaggttcgccattcttcacatggtgatggtggtgttggtactagaggatctcagagaagtttggctacgactacgaaggcccaattgttcatatatgacgtcgccttccgacctctacacctaccggaggtgctagttctatgactcagtcctctgcacctacaagttttgttgctagttctctatcttccactaaggaaccttctccctcttccacttcaggtacttgtc

SEQ ID NO: 629 - DNA, 2187 bp, Zea mays
  misc_feature (1428)..(1429): n is a, c, g, or t
cataagcatcaacaaaaaaaaattagactacatactccacaaactccatacaaatagagatcctaacttaatatacaacagctacaattccacaaactctatctaattatccttgctacaatttacaaagaagaaagaataaacaactttgtctatttttgaattagcacaatatttatgttgctacatcttggactattcacgcagttagtatccaaattttgaattagggaaatgcagcatgtgcattctcaccgcgtcaggcccaggtcggcatatgcgcagcgcacaatggcatcgagagagagagaggtggggccggccccgtccgctagcccgaatttcatcggtcgcaatgacaagaccctcggtgcggtgcccgagcggcacgcagcagatgcgccggacccgtcatcatggcagtacgagcgacgtgaccaacagagccgccggcattgtgctgcagcgcgcatgcatgcaggagacttggcgtgccggcttacgacctggccacgcacacgacgtgcacacacgcactagctaggcggcctccttgcagcatcggcgctaaacaaactcacgtaaataaaaacaaccagcggctgcatgcacacagatggagcatgcatgcagtcgacgcagtcgacagtcgccaccgacgcgcacttccccgcgaatgatctcaagactcgatggattgttgttgttcgcttggataagaaccgaaaaaattagggacagaaagcagagtggcgtacgtgtgccatgcatattgccaccgggggcttgtattaatatacttcccttgcatgcacacagatggagcatgcatgcagtcgacgcactcgccagtcgctagcgacgcgcacttccccgcgcgagcgatctcaagactcgatcgatcattgttgttcgcttggataagaacggaacaaattagggagaggaagcggagtggcgtacgtgtgccatgcatattgccaccgggggcttctattaataaacttcccatggccttcagcgcgatagatctaaaaagaatccctgctgttatagcttattatcattgcgcttaagtttgcttccagacagtcacacctcagtcgtgacccgtagttttatgtgagttttctcacgtacgtacccctctcttactagtaaatgtgatagcttatatgtatatgttttttttgtgatttctttcatttttttcttgtagatgtaaaatatgacccaagatgagggtaggttctgctggtatccggatatagacactgtgttctgcaggggctgcgtcgacttgcttgacagcggcatcataaagcagaggcaatccaccttatatgatacagctctggaatatttgtcggaaaaactttataaggtgacaacaataacaatttcaaataaaacactcataaacagatnnacagttgtatgatgaccatgttctgcatcgtatccactcttcaaacatgggggagacgaaaagccgcaagatgcatattaaaaaaacaagggtattctctgtctctctttgattgaatccagattatatatattctaattatacgtttgttttatttttagaaatgtggcaatgatttcaagcatatgataaatgaaccacctaagaatttggatctacttgagagattgtttcacgaacaagatgaagcgacaccgccatgacatgcgccattccagccaccgccgacgccccccaacacgtgtgccatcaaggacaccatcgatgtccccgccagcgtcgtcgtggcatgacatgtctccctccaaggtagacgtttatgtcatccacaaacaactaaacgtttgggcaaaaggatggatgtccggaaagaccaaatggatggcgttagcaagtcaaaatcttgtcagtgtcgtgacagatgagtttttgatatgttgggctatttgcagccgagtagtggaatcaataattattcacttttgtgtgttcagattacccattaataaattttgtcatcgatcaccatgatatattggttcaaggaacttttttagtgttgtttcttttgattcctttatgtgtctagcttgcatctttttacaatcggccatgataatagagatagagaaaggggcaacaaaaagaaagaacagagggaagtggaataagaagaaaaaaaaggagaaaataatgag

SEQ ID NO: 630 - DNA, 2186 bp, Zea mays
tttataacacataggcactcggttagtctgtatttggaggctatagccacaagcttagcagccgcatggggccatgggggacgaaaaagtgcctgcccacctcagtccggcgtcttcaccaggttgttcacagtttcccacaaggccacaactcccgctcagtccggcgtccaacgcatcaggcgtctgacgattggtgtacctgccctctccttcatctttggcagactagccttcaatactcttttcaatgggtgttgttcaaagtccttgctcacttgacaagacgcatgattcagtccttgcttaaacatgacaagaggtgtggttcagagtccttgctaacataatggtaggacataagctaaaattatagaatatcgatagtagaccatatacatatccggatagaaaataatagaggaaataaatgccatttttttgttatttcaaggaagcaaagaaatgatccaacatgtttgtaatgaaacaaaggagcaatgtatggtgattataaaagtaaaatagcactcgtgaaccatcccaaataactgacagtgtgagaccctagttaccgtcagatcaccaagtgttcaagtttagtatgctggtttaggtctattgtctttgttggtcacttaattttgattactataagtatcaaaaataagacaatacaagttaaaagattgaaacctttcctttctttcttttatctctccttcggagacataagtttaaagggaggatacaaacaaagatgtaaatgaagtaaaagcatatacgactaaaatgaaaggttggagcatatacaaacaacgtcgggaaatgttgtgagactatccttggtcacagggtcaccgacgatctgtcctggctcaaggtctaggcccatattacaagatgttttgacttttcacaaattataagatgttttgacttttctagttatatttattttactatgtatttagatatagtgtatatctaagtgcatagcacaaactatgtatctaaaaaatgttgaatcgtttactatgtatctaggtccttggattttagccagaaagggctgttagcctgcactgcagcaatggatatacagggatttcggtgggcatgacatgactataggctttacatgaagcacaagatagtgaagggctatcaagtcggcctacgaagacagacattctggggatcgggcactcgatgggcttctcttccatccatccttgtcacaggatctggtgagcccaacttggacacctttgttgacaatccgatggaaactaccaggcagaaacgtgagaaggaggtgcatgctctcctggatggataaactccctccggagaccatcatgctgaacccgaacacgatagccactgtatgagcgctccgaacaagaaattaaagataagaagaccaaggaggagattgaggaagagatggcacatgccgtggaggcagccaagaacacggagcgcaaccaagggcaggagcaattgagcaaaccgagcaagcgagccaagaagaaagaggaagacgttttcaaggccaagaggccataatcataatcgtcgtcgttaacacagggttgggatttcacattggtatttccaatatgtagaatttccgcgtgagcacagaattttgtctggactcttcctcgccgccctctccctggccgcgatgatcgccttcgccacctctacggctctaccccgtcctccacctcctcacccgcgcgccgcacccagaagatcgtgccgccacgccgccgccagccactaaccgcggtccgaaaggacgggggcgagaacgaggccaggcccgcctcggactcgtcgggccttgaccaccccgacttcgtgctgctcccggactgggagctcctcatcatgctccgccccctacgacgacgacgtgcacgggacgacggcagtcaacaccacgtgctcgttcccgggcggggccacgtcctcggcgcgacaactcgggaggatgcccgcgtccggtcgccgagcctacacgtgcgtcatcatgcccaggccggagcgtgccagcagcaggcccttccgtgcgccatgcctcgtcgtggccgccacgacgccgtcgtccccggcggcgccacggtcaaaaactccggagacgacgcggtggagcggccgccttgtgtacgaat

SEQ ID NO: 631 - DNA, 2186 bp, Zea mays
cttgggaggttccgtcacattggacgcgacctacctggactcggatcgaacgcgtgctggtccctgctcacgtccgtgggtggctccctgctgtctctgctcccgtgttgcccatgcggctctgccgagcacatgacacaacagctagctagctatcgtcgggacgtgacttctaaagacgcaaaatgatcacgcacaatatgtccttttttcgaatacaagaaaatttcctattttctgtgttttttcctgctaaagtaaactaatttgacaatttctttgcattccaaaggggccttatatctggaagaaatccagccggtccaccaaaataaagggagcgcatctaacctagacgtcattttcttgctgttccagctcgatcgcccatgtcgccgtcgactgggatgtttcaactacatggaaatgcagagttcatttcaacgagaaggcatcgttgcaacgtagagaaaacaactatattgaggaaaataccacagcccgaaatagacagttcaacctatcagttttctattttatgatgtttttaatgtaaaatagacatttcagacttatgtaatcctgaggtttgcagctcctttatgtagaacatttgatagaagagatgtgtcagttttatgatgttctaactcttgattttcaacacagacaaggtaagggataggctgacagaagaacactcaagaggtttgaatctcctttctgtagctgaatctaggaataaagaaattgctgcatgatgatcttgaaaaggtagcacaaaaagaaggcggagttacagacttgacagagaagctggctttgttagaaactgagaatagatgactggttcgaacgaagcattaaaaaagaaagtggatgctatgctggtcatgtttgatgagctacaggaacggtttggttttactcatcaagctgagaaggaagaaactgcagagaagctagcagttcatgagaggataatctcacacctgacagaggtacacacaagaaccttggagctccattctctagctaaatcaaagaatgaagaaattgaaactcagttccgtgaggctcttcaaataatataacagaaagaaggtgaaattaaagaattgtgtaagaagctagatgcccttgaaattgagttgggatattatgaggagcaggcaacggaagccactgccgctgaaaagaatcacaaggttaaatttgatgtagcacttatgttatatctgcagcacatattgttagaagtgaaggctaccttgagattgtgataggcttctgaacccatctgcattgcttattcaaagtttatagcaccagcaaggaacgatcatagtttcctacaaataagaaatgtttatagttactaaagaactacaactaaacatgttgatatggtggatatagatgaacaactaactgtcttaatatgtttctatttaggcaaaaggtgactcaagtgggccaaaaaagggaatggtgccttcaacttctcagattctgaaggtttggaggaatacttgaatgggaagaccatttccagcatgctttcaaccattaattattgtaattgcttacttatagagtggaacctacatagcaacaagcatccaatgttccgagaataagaattatgtgtgctggcatgacacatttatcaaattaagacgattttagaagaaaagcagcaccagctttgcaagctgcaattaacactatcagcatggcattggctccaagctcggcctgcatttcatgcaatatcatatctatttccatttggataaatttagttgccagaaataagggaacgaaatcaagatacaaaatattttatgttgtagtgctaagtggaaacacaaataaagtgaaaagaacatcattatttccaaacaaccaaatataactgaaataattagtatcctacttcccttatattgactatacccaatgtaaagaattgcagcaggccataggagtatcttacagttacagggaaaggaatctacaaacaaataaacaaacaggaattaccagaggcttaggagtagcaacggtacaactacaaacaaagataacgatccacgagatctgatgaaaccagaccagacagagcgcagaggtacaggggggttcgcacctcatagctgtcaacgcctataaatgatcttgta

SEQ ID NO: 632 - DNA, 2186 bp, Zea mays
ggtactctggcgagcaatcccatccacatagtggcacgatcgagcgcaccgaggatagcgcgggctctggttaggggtttgggacatctagggcctcaacttgggcaaggggtggagctgcatcggcgggacgccgtggaggtgcggtggaccgacgcgaagtggcaccgtcaagatataatgtgccgtagaggagaagaaccgggcgggtcgggggtacgctggcgagcaatcccagccacatagtggggcgatcgagcgcacagaggacagtgcgggctccggtgaggggtttgggacatctagagccatgacttgggcaaggggtggagctgcatcggtcggacgtcgtggaggtgcggcaaaccgacacgcagcggcaccggcaagctctaattcgccgttgaggagaagaaccgtgtgggtcgagggtactctggcgagcaatcccagccatggagtggggcgattgagcgcaccaaggacaacacgagctccagtgaggggtttgggacatttagggccacaacttgggcaacgggtggagctgcatcggccgcacgccatggaggtgaggcggaccgacgagcatcggcactagtaagctctaattcgccgcagaggagaagaaccgggcgggtcggggatactctagtgataaatcccagccattggtgaggtgatcaagagcaccaaggacaatgggagctttggtgaggggtttgggacatctagggccacaacttgggcaaggggtggagctgcattagtcggacgccgtgtaggtgcggcagaccgacacgcagcggcactagcaagctttattttgccgcagaggagaagaaccgggcaggtcaggggtactctggcgagcaatctagccacgaggtggggtgatcgggcgcaccgaggatatcgcaggctccagtgaggggtttggacatctagggccacaacttgggaaaggggtggagctgcatcggtcggacatcgtggatgtgctgcggaccaacgtgcagcgacacttgcaagctctaattcgtcgcagagaaaaagaaccggcgggtcaggggtacaatggcgagcaatcctagccacgaagtggggcgatcgagtgcaccaaggaaagtgaaggctccagtggggggtttgggacatctagggccacaacttgggcaaggggtggagctgcattggccagacgtcatggaggtgcggcggaccaacgcgcagcggcactgacaagctctaattcgccgtagaggagatgaaccgggcgggtcgggggtactctggcgatcaatcacaaccatagagtggggcgatcgagcgcacagtggacagggcaggtttcggtgaggggtttgggacatctagggccacaacttgggcaaggggtggagctgcatcggccaaacgccatggaggtgtggcggaccgacgtgtagcggcaccggcaagctctaattcgccgcagtagacaagaatcgggcgggtcgggggtactctacagagcaatcccagccatggagtggggagatcgagcgcaccgaggacagcacgggctccggtgaggggtttgggacatctagggccacaacttgggcatggggtggagctgcatcgaccgcacgccgtggaggtgcggcggaccgacgcgcagtggcaccagcaagctctaatttgccgtagaggagaagaaccgggtggatcgggggtactctggcaagcaacccaagccaccgagtggggcgatcgagcgcaccgtggacaacacgggctccggtaaggggattgggacatctagggccacaacttgggcaatgggtggagctgcatcggtcggacgccgtggaggtgcggagaactgatgcacagcggcaccagcaagctctaattcgccgtagtggacaagaacctggtgggtcgggggtactctggtgagcaatctgagccacggagtggggcgatcgagcgcaccgaggaaagcgcaggctccggtgaggggtttgttacatctagggccacaacttgggcaaggggtggagctgcatcggccgcatgtcgtggaggtgcggtggaccgacgcgcagcagcaccggcaagctctagtttgccgcagaggagaagaacctagcgggtcggggtgtcacactcgggcttcaagggacaaagccgggtgcatc

SEQ ID NO: 633 - DNA, 2185 bp, Zea mays
tgttgactaacttggtctctatagacaagtttagtgacctcgtgggcaatttactctagcaggccccaaaagtcaaacaacaagttacctacttctccataagaatgtaggaatcaataacatgcatgtttgtcaaactgacaactaagacccaattccagcaagagcgcatgacagttcctaacccacgagacccagtttgcagtagaaaagcatgcataagattttgttgacacctagaggagacggttcctacattgttcaactccagtgcacctaattgggcccataaataaaccaacaatacaccttaagggagaaaattaagttgggtatatgatcgcatgtaaatgcgacattaattttcaggcctactccgacggtgtaaacaagcgaaactatatttttcagacctgttaaccacctgacacaaagttgatatagttaggcctcatttggatcagctaatctcaactacagctaactcttgtgttttagtcttttgttgatcttcatttttattagtttcaagatcttcatgcttaacaaaagagaacaaatttcccagcgcatcgtcaagaaatagcatactatctttggcatttatcgccactacatgtcatctaacaatttcaacacatttatttgtgctcccacttgcagctcctcaacattatgctaaagcttttgagctgcttcagtagcccgctttacctgtaagttcttcctcttaatggtcccaccgtaacattcttccattgtctttagctatttccacacataattctttttcgtttgttatgctgaaatttcattgtgcttttctcatcttaggatctagtaagctttctttagtttttaatctcttccctaatctcttctccaattttttgggatccgaattgtcaataataatacatgaagtaaagtttagtcccaacaattcggatcaccaaaaaagtgaggaagatattaggtaagagataagaaaactaaagtaagcttccaagatcatgagattagaggacagtgaaaattcagcacaacaggcaaaaaaggattttgtgtggaaccagcttaagacaatggaagaagattacacttggaccattaagaggaagaaaatagaggtaaagcaggctactgaagccgctaaaaagtttttgcataatgttgatgagttgcaattgggtgcccaaaagaaggatgatgaaattgctatactacaaatagtggcgataaatgccaaaaagaggatattgtttcttgaggatgagctgcaaaaattgttgtctttggtcaaggataaagatcttgaaactttataaaaataaaatcaaccagagactaaaatgcaagatttagttgttgtccagattaactaatccaaacgaggcctaactacatgaataggtgattagcaggttactaggttcttattgggtgagaaacttttgatgccggtggatttttctatgtgggtaaaccctgaatcatgtcacatccactcttctcaagactaaacacaagagttaggtgcagatttgtttaactgtggcctatgtaaaataatgtggactaacttgttctctatagacaattttttagtgatctcgtgggccaaaggttagacgaaaagttacctacttctccacgagaaagttgcaattgataacatgcatgttggtcaaactgaccacacagacccaattgcagcaatatttggcacacggacaaactacaaacataaatgaacagtcaggactcacaaaatcaataggcttgtgctattgctctctctctctcactcaccgagaagacatgtacacaactctctatcttgtgagtatcaggagcatcgtattgctagctttctcctaccagagcaccacactttctcatagcactagatggcacatcattgatggatccctacatatagcgctagcacccatttaataaatagaagtagacgacgacatgcctagaaacaacacctctcgtctcgtctgggccacatgatgcacgtgtcttaccatgagaagcggtcactactgcaggccaaccgtacgtgtatctccaaacataggccgcactagagcacgttcttcaactagtggacgcaagcctcgcactaaatgcaggcatggtctacatgcacaaggcgccagcccgcacgcctcct

SEQ ID NO: 634 - DNA, 2184 bp, Zea mays
aagcagaagacggcatacgagatatgtcgcagtctcgtgggctcggagatgtgtataagagacagccgcacaatagaataactgagctactgaaagaaataactgagtactgaacatgtaataactgagtgcgcacattacaataactgaggtattataacggaataactaagagatcgtagtagaatgactgagttggcccataagaataactgaggtattagtccagaataactgagtacgtccattagaataactgagttgttggaatgaaataactgagtaatgaaaacacaataactgagtaaataactgagtggcgaacatggaataactgagttaatagaacgcaataactgactgtgaatagagaatacggagtccccactaccgagtgattacaaagagaataactgagtaatgagcagagaataagtgagtaggcacacgagaataactgagttatcacaccagaataactatgtgcgcccattagaataattgagttccgacaaaagaataactgagtgacgaacatggaataactgagtcggcacatctcaataactgaggtattataacataataactgagggatcagaaccgaacaactgagtgccgacaccagaataactgagtctgcacaataataactaagtgggcacattccaataactgaggtatgatgataactgaggcatcggaggagaataactgagttagcccacaagaataactaaggtattggaacggaataactgagttctgtcaccataataactgagtgcgtgcattagaagaactgagttgttggaacggaataactgactaatgaacagataataactgagtagtgaacaatagaataactgagtgtgcacaacagaataactgagtaatgagcaataacataactgagttacttgaacgtaataactgaatgtgaatagagaataacggagtaataaacaccgcataactgagtgggcacattacaataactgaggtatgatacaggataactgagggattggagtagaataactgagggatcagaaccgaacaactgagtgccgacaccagaataactgagtctgcacaccataatcactgagttagcccacaagaataactgaggtattggaaaggaattactgagttctggcaccagaataactgagtgcgtccattagaagaactgagttgttggaacggaataactgagtcatgaacatataataactgagtaggcacattacaataactgaggtatgacacaggataactgagggattggagtagaataattgagttctgtcactcaaataactgagtgcgtcgtctagaataactgagtaatgaacgcacaataactgagtaacgtacagagaataactgagtgttgaacatggaataactgagggcgcgcattagaataactgagttaggaacatggaataactgcggtattataacataataactaagggtttagaataactgagttaggaacatggaatactgaggtattataacggaataactgagggattggagtagaactgagttggcccacaagaattgaggcatgagcagagaataactgagttccgtcactagaataactgagtgatgaacacagaataaccgagtactgaaccgagaataactgagaaatgaacatggaataactaagtgcgcccactagaataactgagtgctgactccagaataactgagtcggaaaagtagaataactgaggtattagaacggaataactgagtaattagtagaataacttagttattagaacagaataactgagtgtgcacattagaataactgaggtagtagaacgtaataactgagttccgtcaccagaataactgagtactgacaccagaataactaagttattagaatggaataactgagtaatgagtagagaataactgagtgtgcacattagaataactgaggtagtagaaggtgaacgacacggattagatcctagggcaaggtgaacggcacagattagatctcgcataccctttcggctaggaaaggtctgggccgtagatcatcaaacggagggcccgtgctaaatctgttgtgtggatgatttcgggccattgatctttgatcctagggcagtgaacgcatattggattataaccttcccc

SEQ ID NO: 635 - DNA, 2184 bp, Zea mays
aaacctgggatataacaccccaggtgtttatattccgctccacaatgagtacggatttaagcacgtaatatcagtggataaaatggatgctaaattttaaacatcttcgcctatcgcgattttaatatcgcatctgtttcattttgtcatgagtgcgacatcgtttttatttttatctatccgggctcctcctaaatttttgtattgttcggaacttagtcattccgaaaattggtgcgttcggtggttatttaaaattcatcgctcgctccaaattcgtatttggagcctcgatcgactcttgagatttttatcccgggcagattaatttggactcaacgacagaaatgttcggagcgaaataatatgtatcgcgcgttgtccgagaaaaatcgtgcgcaaagttattatccaatttattcttcggcacactctgtaaaataataaaatcaactgtgtgtaggcatcggataattttttatccaggttcgactaaaccagtattgtctcagaataatgtatccgatatccagtccgtttccgtgttgcccgaaacagtcacgaaaactatccgaacgagatttagtcagaatcgtatacctcggattttccgtttcttaattcggaaaataaagtgtgtagccagttgtcgtctagtgcgttgatccttttgttgtcgctaaaaatctcgatccacaaatatctgagatttttcggtaaagaaattaaaaatctgaaaaaggaaaaatatctacgttcctatcctgaagccgctcaagctgcggaataaatcctgcgcgtcgttcttatctccctcacgcgcgcgtcttcttctttccctctgcatgctgctgcttctccaccgcgccccagccccagtgcccaggccaaccgcgccaggccttcctctcccctggctcgcggtttcctttctcctccttccatttctctccagccgaagcccctccctgctcggagctccttggggccgcgccccctctgctcgccggcagaagctcccagccgcgcgtatctcccaggcgagcttccctgcttcccagccgtcgctccctgccggatctctgctctgcgcgcgccgtgattttccccatctccacggccgcgccgcagccgcccagctgcttctctctcgctctgctcgcttcagctcggcgattcctccctgcccagtccgtctccaagctctcggcgccgggattttctgcggactcgcctcactgaccgcgcacagccgagcggttccccacgcgcgctgctgttctctgctcggagcttccctacgcgcgcgcctgcgcccagccgagctactgtttcccctgctccatcttcctgtcgcgcgttcctcaagctctctgtgccggtcgctccttcaatggccgtgccttgccaagatccgtgctgagctcccctgccgctcgctctcctccatggcgcccggacctccctgttccctgcgcccaagttccattttccccagccgactctgctgcttgctcccctgcgcgtcgtgctcctttgctctctgtctgcgcgcacgctgtgctcaacgtcctcccatggcgctcgatgctcctctgttggccgcgtcgtgaagtctctgcgtgccgtgctttttcctcctctactcagtgctcctgcttcagctcgcccctgcgctcgccggcgcttgcttctggagtctccttgccacacgtctagatcgccctgtctgcgcgccgcgctcccttgtcgtggttttctgcttcctcgtcgcgcgcgtagcgttccattgttcctgcgcgtgctgccgcgaagccccctgtttagttctcctccgtagcgttgtcatgcgcgcgaaactgctcgcagtcgacattgagtctgtgacgcgcgcgttggacacgatgaaatgctacgtgtgtttgtgtccgagcccgaccgtgacctcgctttgctcctcgcgttactgctcgtcgagtctttcctcagtccgcgtcgttcgtcgtcgtgtgtgcagcaacatcgctgattcctccatggtgcctatcgacgaacttcgcttcatcagtttctcgccttcggttcggctcaggtgagaccgccgaacgcgttcgccgtttaacctcgtgtcgttagagctcgtgatctcgctgtggtcagagtcctcactggattcgtgtcctc

SEQ ID NO: 636 - DNA, 2180 bp, Zea mays
acggatgctaaattttaatcattttcgtctatcgcgattttaatatcgcatctgtttcgtttgtcgcgagtgcgacatcgtttttatttttatatgtccgggatctttctaaatttttgtgatgttcggaacatagttgtcccgaaaatcggtgagtctggtgattatttaaaattcatcgctcgtgcgaatacgaaattcggaagccgactcactcgaatgattttatctcaaacagattaagaagaactcgacgactaagctttcagtgtaaaataatttaatcccttttttgtcattcgtgacatcgtgtctacagaattttaattgaactgttatctagtcgagtgttcgagtagcgaacaaaattcgtgtgaagtcaactaaatcaagtacagattaaaatatagaagtcgaaatccgtttaactcggtccgtaggtttcttgctagctttaaatcttcggatataaataccgggtagaagttcatctgactacaaaatattcaccatattaaatattggggacgaaggcagatgagtttatccaattttgaaatatctacgatttccattataaaaaaaagggaaaatagaaaaatctgaaaaaccaaataaaatactatccaaatactgttggttgatcttgttttggtctgagcctatatacatcttttagacccgggtttcagaacccaaaataccaatatttatctttgttttaattaaaaaaatctcccaaatatatcctaatcatcatctcttaacgtaactccacacggcgtcctgatttttctgagtcttgttccagccgatcctcatcctcccaccgctcactgtttctttatcttcttacagccgtactctctccgctcactgccgcgccgctcatttcctgcagaaatatcctctgccgcgacctctcatttctcccagtgcctgctccctggctcgccggcgcatgcccagacggagttccgcccgtccgtgctcctccctcctctagccgcgctgctgctcgcccagtctgcgcgccgcggcttccttttctgctcggcgccatccgtgggtccagctcggccatggccactgcgccgtggagctctgcgcgccgagcttctcccgggtccctgccatggccgccgtgccctctgctcctccggcgtcgcgagctccagctcagttttcttcttccttgccgcgagcactccttcctggcgcgctcagctccctctgctagacgctcatctccctcctctgctcggcgccttccctgctcccccaagtccggtgtcttgccgagcttctccttgcgtcggtctcccctgcaagctgctgcgcgcgctcggcctcctgtccagccgcgggctcgcttcacctggccgcgccgagctcctaccgtctgtgccggtcgccgttttcgagaccgattccaagctgtcatgtgcccagctccatcccccacgccgcgcccttcggctcgcccggccacgcgctcttctgctcgcgcgcctgctcgttatcacctcgtcgcgtgccatctctctcgcgttcactttcgcagaccgtttgctcggacctgcttctcctccaacagctcgaccttgctgcgttaagagatggagaagaaaggatttagatgaagaaggaagcaatgcctaatgcaacgctcgctgcgtgttcggtagaattcctgagccaagagtcatcaccgtttgagtgaatggccttggtggcagtgcacgcggtggtgttcattaaggaagaatgcgaagccctatggtgttcgatggacttgtggtgttcgatggactgttccaaccgaagagcgtggacgatctcgcggatttaaattgaattggtcatggtaagccgatgagttattctgaatagttcgatcgttgaataaattaatgtgctagtgcgatgctcactaggtgctcgataaattgcgtgagtcacggaactctcgtgtacttcgtggttcttgcgattatcgagctagattcatttatagcgagttatttcgctattccagtcaattagctgaattggtggaccaagtagaatattagtaggcctgtgtgatgatgaaatattttaatcacttataaagatgtgtatatatttacgataaaaaatgttcgatataggaactaaaatttgaattactactttca

SEQ ID NO: 637 - DNA, 2180 bp, Zea mays
tcagaatcgtctctctgaagaataagttctctgctttgagatagaaatgtgtatatagtcattgagttgagtagtgtatagttgcctcatgtagcaccttgctattgttgaggtgtaaaaactacgagttaagaaattaaacattaagcataaacatgtagtatgagatcaaggaagataatattgtgttgatctcatctgaatcggttaggggactgaatcgaactccatggtcacatgctaatcaaggttgtaacaatctattgatgacgaccatgtttccgtgtatataaacatgaaaaaagtctgacacattaatcaatgtacgtcgtaccctctttcatgaaacacatagatctgatatattgtggtacccactttcaagaaacacataaatttgatctatctctaactccaatcacactaatgatgttctcctaaaacttcaaagttataatcctatgttttagcatattctagtggctaagatcaacatgatgctaacatatggtacttgtgtattcaactcaaagtggtcttgtaatatttgcctcaatagaccttagggatgaaaacgggacggatacagccggatacagggtcatcctgtatcctaccctaatgcatttaactcggatacgggaccggatacaggtagttaagattcgtgacggatacaggacatgaccgagtaataatacgggcggataagaaacggataactgatactattcgggtaggtaccggatagttgtcgggtagttcgtaccgatggcattaattgcccaaccatcctggaagtgttgtttatgcacatatttgatgccctggttgcctcatggtgtttagatacttatctgtttacatgatcatcagtactgtttatgtataatcaaatcgaatttggtgctcagtttcacctttttctgtttgtaatctcttgttttgccaaaatgcagggatggtatgtcactctatccaaaaggagaaacagtcatgcagacacagggaggaaaaacaggagtacatagaagaactaataagtcaaacttattgttgattgattaggaaaaaacgaccaatcaattatggaaaagatgtattttttgttcttgactagacggtagtgctggcagtttggtacatcacgttgttgaaaaaactcaatgctttccgttgggcgcctgggccactgctctaggcgtgtggccggctagtgagctttactagatgggccgcctatcaaccagaagtagcaaagagtaggcccaatccgcaactgcaagcgtttatctcagtccggtacctgcccgaatggtacccgtatcctacccgggattttcgggtactgaccgggcattagtgattccgtatcctacctgtatccgaggttcagtatccgggtagtacccgtatccgtcccgacaaacaaaaatacccgtatctgtatccgaaatttcgtcccgttttcgtacccatatccggtacccgttccaggttcccgtcccgttttcatccctaatagacctagtacctaaaggggataaatagagggattactgttagcgccccttctcccaaattcctcttgatggccccctcaccacgtcacctccctccgtccttgtgatgaccagccccatccctgtcgttgttggggctctcaccaccgattcgctgaccgataacccccatcctcgccaccaaacgacaaattagcccttcagctaccgttcttgccttgtcccgaccaggattgtgggcactcctatgagccctggctacccccacaccgtaggctagccacctctgtcgtgacccttcctcaagccgatcaccgggagatgggcttcaatggctccctacaacaagaaagttcattttgatgtcccatcactgccactgaaacaacttcgtcacccccacaagcttgtgtctgctactcagggagctttcactccgtgccgcatcgatgggacttcttgccaaccacaacattcaagacaacttcacatcaataagcgattatgcaacttagtcgaatccattgatgaggatggtgcggctggttggactacaatacattgaaggcgtcgtgggagactcaattcggtagatcctttaagttagcaacaaccagtctcccaacttcccccccatctggtctagaaaaatttgca

SEQ ID NO: 638 - DNA, 2178 bp, Zea mays
tatattctgctcgacaacgagtatgaatttaagcacgtaatatcagtggataaaacggatgctaaattttaaacatcttcgcctatcgcgattttaatatcgcatctgtttcatttatcgcgagttcgatattgtttttatttttatctattcgggctcgtactaaattttcgtgatgttcggaacatcgttgttctgaaaatcgatgcgtccggtggttatttaaaatacctcgctcgcgcaaatacgaattcggaagcccgactcactcgaatgatttttatcccgggcaaattaatttgagctcgatgactagaattattcggggcaaaatatttaggatcgcgcgtcgtctgagtgaagtcgtgcgcgtgaatatgattcaatttatccttcagcttgctgttgtggcgacaaaatcacgtatacaatagcggatttggtttcggctaattttagtcgaatcccaccgaacaaattaccgaagacgatatcagtcttattcgggccgtcgtttctttcccggatccgaattttcggatataagtaattagcgattaaattggttcgctaatccgaagcatgtcatttgtatttttgtgttgaaaaaaaaggactgagaaatatttcctctgttgaatttttgttttctctccaatctttatcctcttcgtaggatatttcctgacgtcgtgctcatcttctctccttcatccgttcagccggcgcaagattttcctgtgtctcactcgttctcatcctctccccagccaccgtacctgactatgtgatatttttgccgccgcccctgttcgttttatatgcgcgtagctcgccagcggaagcccccaaccgagttccagccgtcggtctcatcccgtcgcggaatatttcctgctctctctcctcagccgctcggtttcttcctgtggacgcgcgctccctcccagccgatttccctgcggctcgctctcttccccaaccgcgccgggtcccctgcaagcttcagccttcctgtgcgcgtcctcccatggggctcagacttcttccgagacattgcctcttctctctgctcctccctgcaccagctcggattttcctcccatggagttcgcccgcgcctgctgctcaccggtgctccagctcgccggccgtgcagctcggccctgccctctgctccagcccgctcagtcggacccctggccgtcgtcaacgaacctcgtggtcgcggctctccgctgctagcacatgctcacattcggtctccagctcgtcgccatagcgcgtctctgtccttgcgcactcctcagtttagccatggtgctcctcctaactcgcccagccgtcgagctcctttgcgcgcgcgtactccctccctgctacatcttctcgtgcgcgtgcgttctcgccgcgccgagcgccgtgaagtctgcgcgcgccgcggctcgactctttcaccccgcgcgcgtcccctgcgtttctctgctcggcctctgttactcctctgcccgcagccgcgtcccactgcttggctacggctcatccgtcgcgctcgggtcaccctggtattccagctcgtcgtcacgttatttgccgtcgacctcgctagatcgccccttgctcgacgccggtgatggccgtcgtggagcaccgctgtgaactcccagcaccttagctctgctccaggaaatatcaagccttgaacagccatcgttttgttttgttgcgacgtgtgtgtgcgctactcgctccacgtcgtcgtctttgtgtttgggcagccccgtcgcggcatctgcaaactttgctccttgtcatcatgttctccctgtctgccaaatcgtcgcgcccgtgctgagttccctggccatcgcctcggtctggccgttggccaggacatctcaatactcggctccgaggcgtgtctccctgctccatagtgcccttcatctttcaccatcgcaacagcaacccccttgcttcttgtcgccaatacccgtcgcgtccgcgacatgcttgtggcccccgacggtttatctttcaattgcgcgttgggatccgaagctctttgtcgtgttcgaccctgcaagtctccaatttattgttgttccgtgcgtcatcaagaaatcccgagagttgggtaaagaagcgattctcgtgtggcgctcgtcaaatattcga

SEQ ID NO: 639 - DNA, 2177 bp, Zea mays
ccaataatagaggtcgtaactctgcaaaatagtttatcttgaaaaatctgcatattgcaattcaaatacttttgaagttacctcgttcttgaaaacactcaactttaatcggcatgcgaccatctaattatgtgggtcccatactcaagttattgattgtgttgaattttagtttatggtggagcatgtgaaacaacgtgttggatcattctgtaaatctaccacataatttagggttttgaaaagctttagagttttcgtatggttcatgccacaatcttttcgagaaaacatgcacgaaatcatgacccttttactcacaaatcagtgtattgcgaaaactttgatgacaaaccttgttggatcctttttgtgaaaactaccattctaaacattacatcatttagggctttgaaccgattcaaacttacattaatgtccatatccatgaaacatttcaaaattttccacttatcttatgagataacatgccaaaacaagtgatgtttacattttggcaatcagcaaattgtaatgtaattttccttggttaaattgttttatgataaatatcacgagtcccatacttgttttttgagtggccttaaaacatgcattgttgtccataaccaagaatcatttaaaatatcactacataaattttaagatagcatgcctaaactattattgtttatggtctggcataatgcaaattgaaattaaaattggaatgatttttttctatatttaattcttttgttataaatatcattgatataactgtaatagaataataacaaagaatcttaaaacatggatcaaaataaaagcagaattgcataaatatagctctcaactctggaaattaccgatctaaaaaatatacatgttgcactataaacatttctaaagttacctcattcttcatatcttcaaactatagtgccagcattcgaacatccaatatcttgggccccaaactcatgctataggttgtcttgcacttgggttgatgatgaagaattgaaacaacatgttgcatagcacacgcttatagtaaattgatgatctgaaaaaatctacatgttgtgcttcaatcacttttagagtctcctcatccttcatatgaccaaaactagtgctaacatgcgacaatctaaggtcgcatactcatgttatggttgtcttgaacatgggttaatgatggtgtatgtgaaacaacacgttgggtccatacataaaaactgtctgtctaaacaatacaacatttagggcttcaaaatgcatcgaagttgacgcacattagaaatcaatatatcatgcagcaaacttgtacaaatataatacccattagacccatactcatgatcggccttaaacttgggttgcagtgttcacaactgaggaacgtttcaaatagcacaatatatgttacaaggtaacatgcctaaacaagtatgtcttttagaaaagagtaatgaatgcagaaatataaattttcttccattaactatttttccattaatagaggtcgtaactctgcaaaatagtttatcttgaaaaatctgcaaattgcaattcaaatacttttaaagttacctctttctttaaaacactgaactttaattggcatgcgaccatctaattatgtgggtctcatactcaagttattgattgtgttgaattttagttcatggtggagcgtgtgaaacaacatgttggatcattctgtaaatctaccacataatttatggctttgaaaagcttcaaagttttcgcatggttcatgccacaatcttttcgagataacatgcacgaaatcatgaccctttactcacaaatcagtgtattgcgaaaactttcatgtcaaaccttgttgggtcctttttgcgaaaactaccgttctaaacattacatcatttagggctttgaaccgcttcaaacatacattaatgtccataaccatgaaacatttaaaaaatttccacatattttatgagataacatgcccaaacaagtgatgtttacagtttggcaatgagcaaattgtaatgtatttttccttggttaaattgttttgtgataaatatcatgagtcacataattgttttttgagtggcctcaaaacatgcattgttgttcaaaaccaagaatcatttaaaataacacttcatatg

SEQ ID NO: 640 - DNA, 2176 bp, Zea mays
gagcaacctaaagcttttgaatttaactgcatttcaggccaagtgtcataggcaatcgaattataaaatgaagttatcttcaatgtaatatactaaaccatgcatgttttcaagtagagatccagatatgagaagttataaaagcttataattgcagggtcaaaagggtcatatatattgcttgcttagggataccaaactgcaatgtaaactcttttgggattatgtatgaataagtagcaactcactttccatagattggcaagataaggtatgccttgtgaaatatattggtatctttccaccatcttctcaacttcgagtagttgtcctacaataaaaatccatcaaagacaaatacaaatattgaagcccaacattattatctgaagataatacaacaatgataaaaacaatagaaggtagagaacagtagctataaatacaatgcatctacagaaccgttacagaattaggctactatcaagtagcaattgtagcactgatataaaagatggtattattgatgctgcagctaataatctgattgcatggaaatatgggaggtttctactcctaagcactcatgtatccaccatagtgaaatcaccacgtttgcatcatgacatgccacgaaatgcacttggaataagaggtatgagtttgagacaaaaaaaggtacctcatcctccttcaaaactttttcaagcttggtataaaaaaatgtattaaatatgtagaatttgtctctgtaatcattaccacacaacttagtccttataatgtacctgtcacatgcataagacaaagtttggtacacttggaaccccacccccaaagaagatagaaaataaaatttcatcctaataattctcctatgaatgaaaagttactcaaaattcaaaatttgagtgaatctgattatagtttggttcaaacttcagatgacaggagagagatcttcagttcttttgtgcgcatgtgttgtggggctagtggggaggggcaagtttttgcaatataaattcagatttttgatataagatgcaataaatatgaattcagaatgcccaactttatgcagatttaatatattttgtgcaattcgaatgatttctttggattacaagggtttgttgttgtcagaagtgtaaacgatctcacataattttaaatagcttgatcatgctctagatatttcattgccagcaagtcatacaacattgactttataattcttattatacaatatattaccaacatcaggacaaggagatgcattcttactctatgtaatagtttatcactgatgatgacaaagaaactctaggattaaggcatttaatatccgagctactgagctctttagcttttggatcatccctgttcacgtaaaaaattatggaagttacaacattataagttaagagaaaaaactctccatgaatccaatgttctgaaagaatgcacaatgttcaccttaatggatagtagctgtcatgaactcgtttcagataatgtatttgccgttccagtaaaaagaaaagaagcttaccgtttctcagtgtgtctctctggttgcacatcttcatcatccaggagaaccacaccgacatcacgatcctgacagggaactacctcatagggcaccacctcaagaacctgatagagaacacatcaggaacctgatagtgatagtgatagggcaagggcacatcatagggattagggatataaatttatacgacatatgatggcctagtttctaaggaaaagaatcaattatcatgaagccatgaacacagactattccaggaaagtaagatatagttaaatgcacaaccctatgtggtggacacaaaagcaaagatatcagtagtctcgtgtccctctaattgattatagaattattgagtcatcaactctcaattatgcaccatgtagtttcgagaaaattggaattgtgcgccattcatcgagagggcttcatttaaatgccattataaaacttggtacaaatgctttaatgtcatttcgctgtttaataaaataaaaaaagacacaacagagatagtagaggaaatctgaaatttagcacagaaattttattggttgtcagcaaaaaccttcatgcccgtgttgatgccccggcggcgtgcctcggcctcgagcaatg

SEQ ID NO: 641 - DNA, 2176 bp, Zea mays
ctatcatagtagtaacagcagttagtttatttagttagaatctcatggaggccacattactcattatgtaaattgtggtgcttctgcttggcaatttgcagaaataatgataaagcttgaccacaccaattgtgccactttacagactaatgaaagtatataaaggaaatgaaatgatcagttgtcactacctgccacaccagtggcatgtattttgcctttactatcattctcctcttcccaactaaattgtgctgtagaccaaacagagcatatttaatgatgccttttcctaatctaaacctttctcttagctggttcctattgattaaattctgatgagaaagctggtccttttgttgttttttactttactgattattttagtcacctatgtatttccatttttcttgactaggctatagcatcacctataaatctaaacaatttttttctcaaatttggatttatggccttgccatttcactgctttctgcatcatttaaaagctcaatgcacagctcataaaccagcatcttttgttgatggttgatcaggcacctacttgtttgtggattggcctgcagggtccataagcataagcataattttctttttggtttgataaggtaaagctttctgctacctgtttgtttataagttttatattcattatcctgtacgtcagtatgtgccagacctgcaggatccaaaagttaagaacaacatgcaaattgaaccaaacaaataattgcaacatatcatggaaacagtaacttgttactccagtagattgtcacagcaagctaaaatatgaaggctcactaatcttatctgcggtcttggatcttgatatggtaacgcaccatcacagccctagttgcctatgggcaagcaaagtcgcagaccaccagtaggggggaaataatgcatgaagaaacaatgatgtcttcatgagttctgcagttatctgcacaatttgcattctctaacccatgttagatgccaaatctttagtgaatacagacccacgtgcaattgtaagttagtcatggaagcattgttatctgattttcggagtacggtgaagggcccactctgctgtggacgtggaacgagttgaagtggttgctgttgaggattaaaagatggaaccatcctaaagcaatattgttcagctttatgagtgcatgccattagtaccatatatattgctaatgcatgtctagtattattaataccatgacacgcgtcatttttgctagacagaaaaggattccagcccccatagctttagtggagtgttcatttacctggttcgttggctgttagctggcaacgggggcgattaggctgaaacgacacatttgatctgagaggaacaggtctgcgtttcggaagtagtagtaagaccctggactggcgggtggttaaaatgtgaacatcagtgagtagcagctgatcgtgattggacggtcaaatttggcagtattaggatgcactagctagcactaggggtgagcagtggatacattataaaataatcgaattaagctagagttacctgcacgcatacaccaaactaatagcataggaccggtcaagattcgagatggtggacagtaagtagattagaacccccaattggcctgcacgtgtatgcatgattggccggcagacgtacgtatctggtaggtggggggaggcggtggcatactcaagcgggaaacttatacacatcatctactcccgccgttccaatgtacaggttgttttgggtttttttaggcacacaacctgtattatatatctaggtatatagtagtttaggacagaggatgttggttaaccgctgaatattgcttgcttttccgactagttaatgttttagtttaattaagcttgattggcagacaagcgattgtgataatctccttgcttgtattgtatgcatgcagggctccactgtgcctagtgaggcacgtcttgcggaaaacaagtgtatgttggtcattgccgaaatccaggaatcagttctccagctactcccttctctgccgttggattacgtcgtcacagggacggctgagcatggtgcaggggacatgtgaggcccccctcgccactggcgttgccggaggtacgcacggcacgacgcagtgaccagtgaggtgag

SEQ ID NO: 642 - DNA, 2172 bp, Zea mays
  misc_feature (64)..(67): n is a, c, g, or t
cactcaataaaatttgggtgttcttcaatattaccattttttagtaggagatgaattaaatttnnnnacagtacaaacacagtataaaagaatactttacactaccactaccatttatactgccgctagagagataggggatcaaaaccttgaggttttttcttttttcatttttagatttaagaatattcggaattttaactctatacctccgaagtgtaaaattacagatacctgtcgtaccaccaatatatgtgattggattcggatgcgccgcgttcctgcaccggatgtatatgtcatcacgagggaaaaaagtatacggacggcagcatgtgtacatacacacgaggaaacgattagatctaactaatgcttaaacgatctactattccactctacaacagatatgttttagattaaatctgctgttcaaacgatcagatctaactaatccttaagaaagagatcagatatgttgttgtaatggagttatctaaaaagaacttgacaacgtacgaataaaaaatcgttcaaaaatcgtatggattcctcacgtaacctcctctcgtctccctatttaagccgcgcccagtagacacagctagccagaaaaaatcgtatggattactcacgcctcgacgaccagcgcgacgcagggaacgccaacgacacggtgggccaggtcgacaccccactgtcgtcgcccacgccttcgtccgggtctggtcgcaccatcagcgatcagggcagctccacatctgggatcgtcgtcatctgctcgccgacaccagccgttgagtcaccgcaggattgcaccgacagctcatcgttgcatggaggcctcaataggaagcactacgctagcccgccgatcaggctcaacatcaaaaagaggtgtccgccacctacacccgtcagcgtgaacggcgaggtcgaccttagacttacgctggctatgtcatcgctgcctacaacgcccgtggctaacaccgtcggtgagattgaccttagacttatgttagccatgtcgtcgccgcctacaccacccgtagctagtgtcaacgaggtcgacattagacttacgctggccacgccgtcgccgcttgcaccgcccatggctgacatcgtcagcgaggccgatagcgtcagcgagatcgaccttagacttacactggccatgccatcgacgcctacaccacccgtggctcacaccatcagcgagatcgaccttagacttacgctggccatgcctctcgcacaagctccgtaagaggaacaagggtcttcgtccaccggtgaccagcagcacaagtaggcggacagacaagcgccaccattttgcccattggcgaccagcaggagaacaagtagacggccacaatggagaagtatcgcggtttctcgtagattagggagtatactttgtcgtagattaggttggtcgattatattattattagtttgagatctataatctggtatacgggtctacgggagagcactaatcattttgcatcccatgcatacattttttattattacccgatccacttggaacaacgcgtgtttattaaagtataaatatattgcttataacttatttatgcctggtttttaccctgtttactccctaatttataacgcgatcaagattttataaaatatacttggttcgagcatcggtaatatattatttaatcattatacttcaagcatcagttatatactctccccgtcccaaaattaaaatttgttttaccttttttactagattatatatatatagtttatgtattagaagccctaagctttcaataagtaaaacaagccctagtccaaagatttggttcagtccgctatctgtcccaaccaggtagcatatccgtggggcccacatctactataacctaccctatgactccctccccccgactatagatgctacagtgccaatttcttcgctcacacaatggttccctctccttcgtagcctcgccctctgtccggtcggcgtcgtctctctccccttgatgaaggggaccctatacacgtctgctcgcctcccattcgtggctctttttggaaaaggctcatgaaggcaaggcgaaagtcgatggcgcatatctcccagcgatcggagtggtcttcatctcgtcgtctacacgcaag

SEQ ID NO: 643 - DNA, 2171 bp, Zea mays
gatctatagaaagtattttagtgaagcaataaaaatttatagtttcatttgaagacggtacaaggatatctctcaccaacattacaaaattatctagtttaatatctgatgtggattttgcagtagcccttaaatttaaaacatgtttgtaagattttgatattatgaaaataagtgacaaagtaaacccaatagactaacaacagaaatgccacaaccttatacttttttcatgggaatgtttgtacatacataaaaagtttagttgtgttgtgaacaattaaatatacatcatttgtgacattggaccactaatgataagcaaaattagagcatgaaaagtatgtatttattattttaaattgcaagtatgacaaaccgttaaacaaataattaaacacttgtaaaaactattataagattacttatagaaacattacccacccctagtctttttatttacgagaagttttaaattaattaattaagtagatgatagttaagacatcaccagttgcagcaacaatgagatgaatcggaagtagtacaatcctacagtatacaaagatcaacaacattggaatatcaagtacacaattttaaaaaacataataatttgttaatagttgaagaaaatcgttaaaaaaatctaccaaaccccaaccaccaaactaaattttaaatgtatttattttggtttggtgcttggtgtttgatattttttgttgaaagtttttcttcaagtgtcaacaaattatgatttttttaaaaaatttgtcattgatgttcttgtgttgtcgatgtaggtgtactctgggattgttttgcttcggttctcctctatttgctataactagtgttgctctagctattatctctaccaataaatctgcctaattgattcatgacttgtcatcaatataaagactagaagtggtcaatgttcgtataagtgtttaataatatatttaagagtttgtcttaattgcaatgaaaaactctaaacacatgcttttcatactctggttatgcctatcattaagtgtttattgtaacgaatgttgtatattcagttatttacagtacaactaaactctgcacgtctttataaactttactagaaaaagtatgagattgtgatcatttcttttgtcagtctatttgattttctttgtcacctattttgtactatagaaatcctacaaatatgtataagtttgggagctactgcaagatcaacaccagatgttaaaatagatgagtttgtagtgttggtgagagatgtacttagaatgtttccatttgactataaaatattttgaagtctcataatttagcgcttaacccaaatactttctatagatcagtggttgtgacaaaccacacaaagatacttctcttgatatatacagtgagggattgttttctttacctttttgttatgttttcctatatgcttacaatacatgtctaaaaaaatactacccacacaaaaagaaatagaaattttttctatcctgatcacattgcacactaataaagtataccaagaaatcgaaggtcataagcacaaaattgtttgtcctgaaatcatatatgcaaactcgaattgaatgtaattttgagggcattaagcttactcataggactcgagtctttagtcttattggtaaaaaggttgatacaattcaataatataatgagtagattaaggaattattactaaaatggaggctgaacagaacactatacttcatgacaaacaacattgtgctaccattgtcctctcgaattggagattcgtcgccacttcttcatctcagacttcgcatgctcaagtatatgataaatgcgcatttatggaagctcaaataatatgatctaacctttaaggaaatcatatgagaagcaaatcaaacaatttgtggtttatgttgttgtctttgtcattgtttttttatatggtacatctcactgctatctctactgttacattttagaaaacctagaggagaagctgctcttgctcaaagtagtgctggaccaaccaaaaatcaagacggtcttggacacctatctttctcaaattccactcattgtattctttgcatcgctatctactgttcttattgttacccgttagggttttggttgtctcatgtgtatttacc

SEQ ID NO: 644 - DNA, 2171 bp, Zea mays
gtatatttctttacacgttgagaacagaacaacatatatgcaatgattgtcttgttactaagttaatttacagtaatcactcgataagtttacataaatcactcagtagtttgacatcatttgttcgataattccttaagcacacactaatttcatttacccattgataaaataacaacagatatgtagtgattatctagttactaaataattttacattctccactaagtaattttgcaccatttattcagtaatttcaatcacccagattgagtagttacatagtaatttacagtaatcactgattagttttgcagcatttgttcaacacttcctcagttatccagtaattttattaacacactaagataataacaataaatatgcagtaattttgcagtatttgttcaacaatttctcaatcactcattaatttataacgtttgaactataattatcaattatccagtaattttctttacatgttgagaaaagaacacatatatgcaatgattgtctagttactcagttaatttacagtgatcactcgataattctacataaattactcagtaatttgacaacatttgttcggtaattctattaatttgcagcatttgttcaacacttcctcagtcacctagtaataatttcattaacacactaataaaataacaataaatatgcagtaattttgcagtatttgttcaacactttctcaatcactcattaattttataacatttgtactataattatcaatcatccagtaattttctttaaacgttgagaacagaacaacatatatgcaatgattgtcttgttactaagttaatttacagtaatcaaccgataagtttacataaatcactcagtagtttgacatcatttgttcgatatttccttaagcacacaataatttcttttacccattaagaaaataacaaagatatgtagtgattatctagttactaaataattttacagtctccactcagtaattgcaccatttattcagtaatttcaatcaccgagattgagtggttacatagtaattttacagtaatcactgattatttgtgcaacatttgttcaacactttcttagtcattcagtaatttcattaacacactaagaatgtaacaataaatatgcagtaattttgcagtatttgttcaacactttctcaatcactcattaattttataatttgtactataagtatcaatcatccagtaattttctttacacgttgagaaaagaacacatatatgcaatgattgtctagttactcagttaatttacagtaatcactcgataattttacataaatcactaagtaatttgacagcttttgttcggtaattccttaatcacacagtaatttcatttacccattgagaaaataacaacagatatgtagtgattatctagttactaaataattttacagtctccactcagtaatattgcatcatttgttcagtaatttcaatcacccagattaagtagttacatagtaattttacagtaatcactgattaattttgcagtatttgttcaacacttactgagtcacctagtaatttcattaacacactaagaaaataacaataaatatgcattaactttgcagtatttgttcaacactttctcaatcactcattaattttatagcgtttctactataattatcaatcatccagtaatttacattgagaacagaacaacatatatgcaatgattgtccagttactcagttaatttatagtaatcactcgataattttacataaatcacttagtagtttgacaacattttttcggtaattccttaatcacacagtaatttcatttacccattgagaaaataataacatatatgtagtgattatctagttacaaaataattttacagtctcctctctataattttgcaccatttattcagtaatttcaatcacccagattgagcagttacatagtgattttatagtaatcactgattaattttgcagcatatgttcaacacttcctcagtcacccagtaatttcattaacacactaagaaaataacaataaatatgcagtaattttgcagtatttgttcaacactttctcaatcactcattaattttataacgtttgtactataattatcaatcatcaag

SEQ ID NO: 645 - DNA, 2169 bp, Zea mays
atgttcaccgtatgaaacaagcatttcaacaaacacacctacatacttagcattaaccacaatacatggagattaaaccaaacaacgaacaacctggcggaatcgaactcaggtcgcgcatgcatgcatgtcttccacatgttcgactctttgttcacacacgatgcacaaggcgcgacatcgacagctagctgcacataacaatgtcgatttactgatttaatcattttgtcgagcacgagaagcgtgggttaatgaggacagcgaggggctgtccaaatagaaagacgacgacgcgtgtcatggctaggcagatcgacgacattgctgtgtgaggtcgacgttgagcacggcgagtgcgatgaggcggagcacacgatgcgagggagctgtcgttgccgcggctgggcttcttggcatcgacggagacaagcagggccagcggtgtccggctgctagaacgagcggagtttgaagacctgagggcgtcgcatggactggcgtctgggtggatgtaaactgggcaaggacgactggtgctagaaacgcgggctgagggctggcgagcgttggcacggttggagaaagagcggggcttagcggcgcttgtgccatggagcttggctgcaggcgagctggtgcagggcgctgggagctcgagcacagggagcagctcggttaccgccggcaaagaccaagcgcagacgagctctgaacatctcgagggagtcgtgtgacttcaggaatggtatgagaaaacagatgagctgcgttgctaggaaactagtggataacgcctgggagatgaaagacgtggctggtagaaaatcctaggctatctacgtggaggtggaggagataaaggaatgcatacaggaatttctagacctagtacgtggaggagtacgtggagggcataggctggagatgagctcctatggataaggagaagagatgacgtgattaggatgagagggaggtaagaaaattgagtttttcttctttttccattttaattttcatccactcgagtgattcacacagtacagaactcgtcgtctcgagagattcttaaattttaaacttcataaaatatttaaaatagtctaaatggatagaaatgcaggcgatacatgagatagtgttttagacgagatgtcaatggaccaaaccaaacgacatccgagtcgatatattaagactgtgcttaatttgattcgacttgaaacccgataattttatccgtagtctgaatagggaaacagattaattacgaatacacaatatcggctctaattatcgcggtccaatttaatctcgcatcaacactcttgtcgtcgatcttctaataaaatttactcgggtcaaaaatcacaagagtgggtcgagattgcaaattcatgttctcttaatccataaatttttaaataggcacaagactcgacatttcgcgaaataaatacgcgagatcgatgcggcatcaaaattgtgatcctttcgaaagcgatgtcacgcatcgctcacgtgggtgaaaggttgtgcgttgtctagacaccggttagcacctgccacgtgccacagagagacacgtgtaaagcaagcgtgaatgaatttcaaacgaagtttaagaaaccagattcgatttcaaggattagagtttggacaagacgtcgatggctcaacccgaacgatattggattcgatattttaatagacattcgatttagttgaacctaacgaattttgccgctatctgaacattcggctagtaatcaattcaagtaataattttacgtcctatttttcttagatatggaccatggtcgagtttataaaattaacccatttttttaaactacacccatcgactaaatcgatccgaacaacttagactcgacatctaaaaataatcgttatagtccgaactttgggcaatattcgagataaaccagatagataaagatggaaataatgtcaaactcagtataaacgaagaaaattaagatataggaactgatattctcattgttatttcgtgattaattccatgcacgttgtcaaataggaaattgtaatacccaacttgtaatttgtggaggataacctaaaaggagaaatgatattcctttgtatatatgtgtgttatccatatttatcatttcatgagaa

SEQ ID NO: 646 - DNA, 2164 bp, Zea mays
ccgcgacttcaagtcactctatctctactcctaagctcccagtgggagggaactccttggagccttctgagccactcccctcttcttctagtccagggtagcgattcagcaaagtggatgacaggagaggaccagactctaaaagggacaaggacaaaatgggatcaggcactaaacacacaccttaatctagaacagataacgatcgaccttctctcgcaagcgaccttaatctagaacagatcacatcaaataggtatttcatcgtcaggacaaccttgatttcctccacagattggcccatgacaactacagtgtcttgataagaatggaacaacaaagcgaaagggaggctaggaagagaaatgttaccccaaggtttttcatcttccagatcttgtgaacgtcgtagtccaccgcctgcaaacgacagataaccgattaggaatcgaagagacaaccctttgagatggaatggcagatctaggatctagtggcagagtaagaaggggagggagggaaggcgtacctgctcgcgcacgaaggtgctagctacgatgaaggtgtcatagacggcgttgcgatgcatcaccacacggtagagctgctagatcccatctgtggggaagccagaagtgaagttgttgcgagagaggttgaggtggatgaggctggagaagttggcgaggcgggccggcacgagcatgtagaagcggttcctggagaggtcgaggtagcaaagcgaggagagggagccaatgctaggggcaggcgggctgtcgcggtggggcggcaatcgcgctgacgagcatctcacgacgggggtaggggtggcatcgaggatgggtgcggtggcgtggatgggtgggcatcgtgcgcggtgatgtggtgcgcggaggcgaggtctccggcggctttgggcatcgcttgtgggaatgaggggcgagggcagcggtgggctatcttggggcacggtgggggcgaggtgctggggtgggggggaatggcctcgctcctatgcaggcgagggcacgacgggggctgggtggttccatgcacgcgtggggagggggcgtgcgggcgagggcacagggtgtggacgctctggttgcactcttaatagagtagtaatagattttgcttattggaaggaggggcacaagaaaagctttttcatggggatgaagccgaccatggtggtctagtaaaccatcagagtcacaatgatccatgtgtgcatgtgtggtcacattcgtccatagccctcattgcaaggaacataactatcagaatctacattggattaaggttggcagatcaatcaccaacttcaccaaacaactaattaacaaaacaagatcatgtacataagaaataattcccaaaatagcataaaaagttacgaaattaacaaaatggataccaaagtgtgcaaacactgaagtgttgcactcgttgcactattgttttacccagcatggttattttttttcttttttcaatataatcaaaagctcttctacctgattgtttcaaaaaaaaagaaaagaatgtctggctcacctaattttagctataagccatccaagggcaaagtatgcaacaccaaatggactaatcaaagatgcaatgactaagtactagtgatgatcatatcatttagaaccctggtgctacatcctagatccccatgagcccctgttgttttcacttcatcctctgctttgcattggtacttcgttttcatgtggaaataatgagcggaacctagtgagagagctcaaggacatagccaacaaagaatcggttaatgacaacagtcaaagagttatggtgtaaagttgctatcaaactcaaagatgttaagatagataattcggcactctaaaagtgagactacaaaattgcttcagcacgactaatgcgaggaataatgttgcacttcacatgttcttggcaagcatattcacaatctcggcaggatgatcgagaatggttgtcaaagatttgaacaatgtgcttccaagcgtatagcagaggaagacattagaaatgatgaaatagaactattttcttgatgatgcactgactgcatagctctgcgaagggatcccttctagttttgagagacataagtgtgggaaaccctaaccgttgagtgggg

SEQ ID NO: 647 - DNA, 2163 bp, Zea mays
gataataaggttatctacaacttttctatatggcttctctatagaaaacatgattttgttcatcaaacattcaacacgaggtcatcactgcgtgcagtccaaaacagcaactaataattttcagcttctatttacttcaaaaattaccctgtcctggcgactagaattactctaacactttaccatttgttagagttacaacaatcaaattaggatcaacaagtcgacttactaattttatccaagttatttcgggcgctagaagtaccatacttaattaacaacgtgttctccccgataatcaatatcgaagcgcttttcacccaatattttgcattttagcttagacaccgcatgagcactactaatttttacccgtgtcttttagtgccctaaaattatcatcaacattcaacaaacacattcaccacataaatagcatcatcacacatgacctcgacttaaccgtagaggaagcgatgactacttcggcatgtcaccacctctctacagtccactcaatattaactacatcgatcgaacctcatattgcgcaactcttataatttactatctcaaatacaaccatagcacgacatgcacttgagactctttgtttaagttaacgcaatcactactacaacgcatttcggcacacatgtttgataacacatctttctaaattaatctatctcatcttccaaacaccaattttatgtcacgaaatttacatttttcacctaatttaacctacaccaacgatgaacacataaatataattatcctagactgactcactagccgagtgcggaagtcaccaagcatgctttaagatttaccaaatttttgccgcagtaacacattaatgtacgatgaagcatgttagcaaaccattaacacattcgcgaccaatacctacgacgcaccaaggaactatcgcagccacatatctatccaatccaacaacaaaataacacctcggctcgcccacgcacctacgtgtccccataatacgcacaaggcatcaaccgcacaagtgactccaacaggattactcatactcctcattcgcctcgactatcccaatcactgatcactcgcataaaacatttacacttttcacataaacacctatcgatgcatctcccaaaacataatccgcattttgtaacttagtttttcgcatcaaacaacgcatcgcatatttttcctaccaagatataaaaacatccaagttcttgttctacttcattttcttctatatacgcgtgcattcatacaattataatttcacgcacatattcacacatgcacatcatcgaccaaatacgtaaataaaacaaatcgcgaatcattcaaggcgaacaacctggccgaaatccgatcggagttgcacatgcatgccatcagattgggctctttgccgacgagcgacgcgcgaggtgtgacgacgacacgggctgcgagcacggcacagtttattacacgatttgttggtgcggccattcaatcgaacacgaaaagcgcaggacagcggggtctcaccacgggtttcaacgacggcacgccggcgctgcgcagacccggtgaagcgagacgaggagacggttgaaccgcgcagatcaacgacgcagcatggggctgtccaaacacccatgtgatgccttgggtcaggactgcgtagctccgtgtctgcgtacagaaatccagagcttgctactggggagacggagtcgagcagaggcgctgcgcggggcactggcaatgtagaggcaaaccattggagctgaggggaggggggcctcctgttggttttccatggaagaaaatggggcacagggataagcagggggaggggcgttgagcgctatggagaagaagggcacagctccctgcacttgagctcaagggaaaaagagaggagggagggcgctgggcagaggatatgagctgggcacagggaggtggaggcgccatgggagggagaaactggctccctgtttgccgccatggaaaccagggaggaagaaggggtgcgctggccatggagaagaggcatcgctgggggaaaatgccggcctgctcaagccagggcagaggcatggagcacccaagaaaaaccaggaaggagggagctcgtggggaggtaccctgctgccgagc

SEQ ID NO: 648 - DNA, 2162 bp, Zea mays
caatctgatttcaaaaatcaacatcggcgatgaattttagatgtcgcgatttatctctttcaatcgtaaatccgaaagccggtcatatctcaagacgatttattttcgaatcatgcgtacggaattattgccgagcgaagtcagatcagactctcggccgagttaatcgctcaatcgtctgttcgtcggaactctaattcgttatgttctccatagagacaaattccactggagcatttttattctgggaaatatttagcgcagcccgattacgtgtattgggccagccaacccagtccatttggtaccctaaccctaggactcctctataaatacaagtgcctcaccttgcaaattggaaaatttgcatctaccccctagccgccacaaccttcttccttctctcccacacgcacgcacctctcttcttctctgttcatggcgcaggaaatttcctccccgcccatggcgtccttccctcctcccccttcttcttcctcaagcaagcaggccgacctctcctcctctgccatttctcagcgccttctcccatggcgctcggcgcccctgcagcacggcgcccttcttccccaacaacgcctctgctccagccgaccttcttcctttcccccatctgagcgcccaagcctgcgcccttccctgctccatgggcgcgagctccacctcctgcaatggatgctgcatgagctcaacccatgggcgcgttccctgctccacggctagcaggaatccagcgcccctctcctactcggccacatctgcgcacagagagttcttccccacgcctccctctttctttcccacgaagcaagcagggaacacggccaacgttatcttcctcccatggcttcctccctaccgcatctcacctctggtcgacgccttgcacagtgccctctctcccatggcgagcagctttcctcactatggtcatggtctgcgacaggaagtcgcgcgctacatgttcgatgttttgcacagcagccccgacaactcctcgtggacagcacgccgtcgacgctcactggttgtttgctgtttttacgcagccccaacatcgacttcgttcacccccgatgagtcacccctctgcccttgctgttatcatatttttgtgctcggtaaaatgttgaactgttgtgtgtgtctaatcgcagctatccgtcaatgacatccgttgtgcacgcgtgttcgattcaaggtcggtcgggtgaaccacatgcatgcacaactcgaatctgatctagtccaggtttattgatttatagtttaccatacgtatgatttggttgatgtcatgcagtgcatgtatatgtgtggatgtgtgtaaaatgtttcggttatacacattagtagggtcgcatttgcggttggagaacaagaggttgtttgatgtgtgcgatttgtagtttgtctaattatgttttggtcgatgtggtgtatattggtgtttgaatatatgtggctgcgatggttcatttatgtgtcacaaggatggttcgtggaggtattaattgtttgttaaaatacttcgtcgtaaagcattgtgttaattgtggtaaatctaaaaaagcaaaaagaaggcttggtggtttccgcagtcggctaatgagttagtctatgttaaatatattttatgtattcatcgtggtgtgggttagagtgggttgaaaatataaattatgtgacatgtgattagtgttttaaagatgagatgtgcgaataatcagttggtgtttcactcgtctagtcgataagtgttgtcataaataattgtgctaaaatttggtcataagaatgcagtgggcacgtggtgttggttggatgtgataagtagattggaagtgtgggtttgtctaagcactgtgttgtcgaacgtctatgtcgaagtgcattgtagtaatgattgcgttaaacaaaaagtaatgtctcgagtgcacgccacagtatggttgtatgcgagacggggttacgcgcatggtgagtttagtaaaattccatcggtgtcacatgtgttaagttgaggtttatttgtatatggaaagtagtaatgtatttaatacttagaactcttagtcgatggtagaaattgtcttggcttaaatagagaggtggtgacatgtcaaggtagtcatcatttc

SEQ ID NO: 649 - DNA, 2161 bp, Zea mays
ttaaaagacactagggtttgaggcgctctccgcgtttcgcggcagttccgccccacggtgtgccgacgtgtggccgcattattcgattcgacggagctgtcgatgcgttcgcccctcccaccgtgtaaaaaaagaaaaaacatggactctcctccccttctctcgagtctcgatagcaaaatgtcctaccgtcgccgcgacaaggagaaggcctgcgaccgcgacaaggagatgccccgaccgtccgccgcgagcccgagtgaaagcgctcctggtcccggtctccgttggcagatcgggaccgctctcacagtcacaccaccgccactctcagtgttgccgaggctttcggcggtgggtgacgacgacgtgaatgcggaggaaccgaagatgaatatgatgagcattcccgttgggttcgactccacagaggtaatgcccctctctctccctcgcatctctgtctcctaacccgagattagctaatccgtcgcttattcctattctcgttcgaggtaccgaacgagccgacggtgtcgacgaagtcagggctcctgttcgagcgatagctcatccaaggctacatcgaggtccgtagctaggtcccggatcttgtgctgcaaatcttttgttgggatcgggaaagatgtttgtgctaaattgatgtcgtgatggcgtgcgatcgtgctctactgggtatacacagttaccttctcggccatcgtgctctactgggtgtacgccgacggctaccagctgttccttcactgctggctgcttgaacggtacatgctccacacagtcacacactggacgatggggaggagaacctcgtcagcctctccacggttgtccgtggcgtactcctacagcagctcgtgcatgccatgcatcgacgtgatggtcttgttcatggtaaggagatagtctgtcttggaggttcaattcgatcggtggtacttccattgagatgaacaaaaccgagataagaatggtaaccattttgcagatgatgtatgtaagaacttcaccaggagatcaatccttgggtgggtgaatcggctagcaaagtagcaagcatgggtcagtatcaccagtttaacctgtgtttgccctgtcatgcttcagagtttaggtatctgattatttttccccaatgtctaccagaaagcatccagctttccagggtaagacacgttcttactcatcgtgcatttttctggtgaatttgtgcctgaaaattcttcttattaggatttatgcaattgacctgggtttttttaataaactgttacgtacgtagacagtagacagcaaccgatgagcagtatatgtttttttaacatcctgcaatgcaatttgtgttcatgtgatgctgccctatttctttataccttattatttgtccagaacggatctgcatctgctacacacagcagcaacaacagacttattcccgggccatcttttcttagttgtgcatgaatactagcactttatctgctccttctcttcgacttctgtgcttgcaagcatgccaagactatccttatggacagtacaaagttggatcagtagcagcatcacaactgggactggcagaatcctcccatgggacaatattattttctaaacaattcgtaatgtaatttaatatgtttctattctttcaacagacaacaccctacaacttctccgtgtagttttatatggttcatgtatatagctatgtggattgcattagccccaatatcatgtatataccaggtacacatcctaacataggcttcgatcctgtcatcttattttggattagtttcctacatcttatttttgattagttttatgctataccacgtctgatcattccactatgttacacctctatgtatgataacttatagtaaaacataaaacaactacaactttaatgtaaattatgttcggtctctttatatgttattagtctgaccattgctttgttgctctgtttgtctcgcactaatcagtttcgagggagattacatcaacaattgtgtactaccgatttctccttgtggataggacgcccgaagtgagatttccccttgtgttggattgggcgcacattaacaattgtgtactaccgatttctccttgtggataggacgcccgaagtgag

SEQ ID NO: 650 - DNA, 2170 bp, Zea mays
gagtccaccttcatcccacgcggactctggatgagttggaagatatgatcgggtggcatgacaagtggttttaaacggaacagaacatagaaaacagagtgcaaacaccacttgtgtccttttgtgtcattaactctttctcagctgatgcaacatctagatatttcacccactagtctggacgctctgctcaaatctaccctcgcccaagttctctactcagttttcccctcccacctccacactatactcagaaatcacctcacggcggcattttctcccgtcaaaggctcttccgtgtggacctaagtccttacaagtgggaccggtcctcacttcactcccctgcttctcccccaaatcgatcccaatcgaaatcgcacgctccaggctccaccgcgcggctcccctgcgccgagacgagcagcagcagcctgtgcactcgtcgtcgtcgctgtcctccaagcgctcgctctccatcgacagcgggggctcctcctccatccaccttcatcccggccgcacaggcaggcggacgccgcgggccacacaggcaggcggatctcggccgccgcgatgcgctccggcgggcggcttctacgcgggcgagctcgacgcgggggtgggcgcggctgggaacggccagccgcaagcgagatcgacgcagagtgggtgcggccggtagctcgacaccaaatcgacaccaaaactccatcccaaatcgacaccaaatcgacactcccactgccagggatgacgcccggccgtgagaagacgacgctcggtcgtggccatcctcgtcggcgccctgctcgctgcatctcccttggcgcgtgcagcaagctgtatctgcgatggcgcacgcggctgctgcatcttccctgggctgctgttgctgtctgtttctgaataatgtctgaattgctgtaatgaatactgaaatctgaactgctatctgtttctgaactgctgtcgcactgtttttgaactgaatggcactggtttttggtcacataacgttgttctgtctgttcaacagaaacaggcgtgtgtcgtagtggtctgggctgacgtgcagtaaaggtacttgaggtgctaggttcgattccaatctaatttttttttgcattttgttgcatataggagacgtgtccattttgttgcacacttttgtctatgtgtctcatttttttatctcaagcaactaggtccaaattatgactccctaccaagtttcactattttttgacaatatttggtatttatttatttatttttggccctaaaaggcatttaaaccatataaaccaataaataataaaaaagtggattctttacatgaagtaagtcatcaatgattagatgaactaatggttcaatttttaagcaaaaacaaagaaaaagtaagagatatagctcaaagagtgacgttgtaatcgaatgttatgaaacttagtgagagacgtgtccatttgtgaagcacctattattacacttttgcaaaacctcatagtctttttatctcaagcaactaggtccaaattatgactccctgccaagtttcactattttttgacaatatttggtatttatttatttttggccctaaaaggcatttaaaccatataaaccaataaataataaaaaagtggattctttacatgaagtaagtcatcaatgattagatgaactaatggttcactttttgacaatatttggtatttatttatttaattttggccctaaaaggaatttagatgtgtaaggttatgtagttgcgtttgcatatgatactggaacatctaacttgtctacatggtgatatggcttgggtttgtagtgcagcggtgcaggtcgaatcttgtgcctgcacctttttttgccagttgtgtctaacttgtctacttgccttttttttgcatatgatactcgaacatctaacttgtctaacttgccttttttgccaattgtgtcgccagcacatctaacttgtctaacttgccttttttgccaattgtgtcgccagcctagctatattacacgacaacatttttccctttttttacagccatatgagaccttatttcatccataattcatctgtagtgcttacagcttacaactgaacacaaaaaaattcatagttcatccatagtgattacaacttatt

SEQ ID NO: 651 - DNA, 2154 bp, Zea mays
aaatttataccctcccatggaagggtggttgtaacaccccaggtgtttatcgtctgctcgaccacaagtgcggactttaacacgtgatagctatgaataacagtctctctattttaatctatttttgtgtgtcgcgagttcgacatagtttatatttttatctatccaggctcgtcctaaattttcgtgatgttcggaacataattgttccaaaaatcggcgagcctggtgattatttaaaattcatcgctcgcgccgaatttagaaacttagtttagtcctccgactttgtccgaaacgagatttattagaagtcgacgactaaagtttttagtgccaaataatttagtcccctcttgtcaagcgagacatcgtgtctgaggaattataatcatggtcggtttccaacaaattatcctcgacagagaaataaaacaggttcaaatggcagataaatatttgtctgatttcagctgcatcaaatatcatctgaattagtgaagccggtattattttggatctggctgtttacatgttgctcgagaaaaacaatacgccagctcattaatcgaatcgttctgtagtcaaatgaccgaaagcacgtgagactcgtaaaaaattgactggattaaatatagtctaaaatatcgaagccgaaatcagtttggttcagtctgtgtgtttctcgtctcgatctaaatcttcaaatagaaaaaatgggtacgaattaatctgactttggagtagtcatcaaatcaaatcttgtccaaatatttgttctcatacatataacgatgttgaaaaaaagaaaatatctcgtatcctcatctcccaccgttgatatgcattgatatttttttcttcatatgtggataccagatctttgttcctatccggaggttgatatttctgcaacgcacaagtgtgccagtcatatcttctttgcctctcggttcttcttggacactctctctctcacctcgtcattctctctcgcgggacgttgctccctgctagcgcttggacgcttgcctcactcagctctcgttctccttgcccccatgctccatccatggcatgtgcttgccagacgctgatgtgagcttcctatgttcttctcgccctgctccagtttgccatggtcgcgcgccgtttttcccaactcggatttcaccagccgcagttctctggtctgtgtgtcggtcgacgtggtggagttttgtttggttggctcgtcgttgtcctcgccggtgtcatcgaaccgtcgaaccccttcctcaatcgtgtcgggtctccatgccggttgtcgtcattcgtcgtcgcgtcgtgtgtgcaacaacgtcactgattcctccatggtgcatgtcgacgaacttcgcttcatcggttcctcgcttttggttcggatcacgtatgcaggcagaacgcatttgccgcttgaccctatgtctctagagctcatggcctcacgaacaacgtagtcctcactggattcgtgtcctcgccagagctcccactaacctgctcgaccacacctcaccaactcgctccagactcgatctcgtcgtcattccgtgcgtcatccagaaatcccaagagttgagtgaagatgaagctagcatcttgaaattcaccaagtatcgacgaaaagcctgaactataaatcactgtggttcttgcagagttcgcgtcgaatttaatcatgggtgagctgattcgctactactattattttgttttaattaatggattgatagatatgtaggttgcgaagatcctttttatttagcataggtgcacttagtgactatgttagatccattgttgtgtcggtgtgctgttccgtggtgacataattatttttagaattataaagtagtcgggtcaggggttaaggtctagaattttgataaaaaaagttatgcgacggatatcttgtctgtagcacaggcacgttgtggttttattatatgtttgataaaatgccttgttacatgtattgttgcaactgtgttcgtgattgacaaataattgtttcgcgtagagcttaggtttaaaatgcatattatgctaggagtgtattactgaatgtataaatcaagtgtgattggattaataataggaaaggcaggttaagtattttaaacggctggc

SEQ ID NO: 652 - DNA, 2152 bp, Zea mays
gtatgtatttcagaaccctgaatcagcatcatcgtctcaaaagatgagaccagacagtgttgttgttgatattactgctgacaagcataaggcggcaagcacctgcagtgagcaacaagaaggtggttcaaactgtgaccccaaacaacaacattcaagtgaaggccagcaaccccaaccccccccttcttattgccaggtggtggcctgcagcaagcccaataataatccctctgatgtgtcgcagtcgcagtcgcagtcgcagtcgcagtctgtcttgtttggatcatttggatcgttgaggccccttcctcctgtcgtgcagacccccgcagcagctgatgcacgctgcggccgagacatcgcttttgggccattctcttcactggtggtggagggtcgtgcttcacccatggcaacaccaccagctggctcctcctcaactccttttgtgaagacctctccaatgtgggcacacatcgaggctatggaggttttccgcggggcgctgccgcgttggcaaccaagcttcttcaacaggtggcagcagcatgccccggagctccgcgaagggatggccttaggtttgatgttatctttcgccaacctagctgagagcttgaggaggctgagcatagaggacggcgacacagtcttggaggagaagatgaaggccctcgcttcgctggaagctgaagggttcgacgtggagcacctcaagtcacggctcgacaccttgctagatataaagaggagccatgccaggctgcaatgcacagttgaagacctggagaagaggccattcagtcgccaacagatcgccgtgctgagtaccacagtccgtcatctcgagcagcaggcgcacttcctccgccacgtgatgcggtccactatctcgcaggaggtatgtgatgcatcggaggtctgcagcatgaaagcacaagtgcgcgagctggagcagcgcttcagcagcactgtgcttggtgaatgagtgagttagctagctagctagctgctgctagtccctgcacgcgcgcgcgtgccttttgtgtaataaataaaaatgaacacgtacacggtgttcagacagacactctagcttgtcagatatgcaatcaagcaactgaacactagaacacttgtactcctaagacttgggaactcctctcttgccagtttataaccccctactataaaacaatgcagagtaatacaaacaacacaactagatgcagggacattcagcccaaactagtataaaattgtgtcctttttgcacaccattcgttccaagatgtacaaagcaccataatcatcacttgtcggtggtatggtacaaaacaccgatagatgtctaaatgctccatcttcatactgcacctactctatgcagttttgtaccttgacttaaaattttagttggcgcctttaaaatcctgtttggccaaaacacaaaataacaaagttgatcctcacaaaattatctctaactttggtgtagaatgtttttgtcatatatttctctatttgcaccatgtttcatatttttactgagaggtcagatttgtagttcttaagatagataatatttgagtttaggttgtagttcttaagatagatatctttatagaaaactttctgcatttgacttggcaccaatttcatgtcctacacgtttgttgtataacatttaaaatcatttcaatcagaaagctgtcacttttatgtttttggtttggttacccaattgtcatcacaacttgatatgcatatgagatgagataaattataatcctcttatatcatcatgatcctttgtttatagcttacatcacatttggtggcatatatccatgattattccaaattcctactaagttgggcgttgatcaaggaattaaggcaattttggggtgtgatttctgatatagaaccattttttgccataatttccatgatgtcttgaaggggcaatcaaggtattggtaggtgaccctcaattggactccaatgccacccaccatagaaggcttcattttggtgggacgaagccagaggaagaaataatattggaacattggaaagattgggggattccgaggtaagcttcacacaaacaattatgactcattaaaagggaaatgggcttaat

SEQ ID NO: 653 - DNA, 2152 bp, Zea mays
tcaaccaaacactacctaattaaagcagagtcaacctatagcgcagtcacccaaaaagaactttttttgggggaaaatagatagcatctatatcagaccatttataatggaacaatgtcatgaatataaataaataaataatagtaattactaatccgttataatattgcacatgatatacttggctttaaataaaaactgactatgaaaccaaggaaacaatatgtgctaccttagttgtgcgcacaggtcaacacctcaccataaacgtagcaaatgaatttggtaaccaaagcaaggtcaacctatagcgcagtcagccaaaaagaactttgtgtgtgtggggtgggagatagataacctctataaattagacggagaccatttataatggaacaatgtcattaatataacagaataaataagagtaattttaatttataacagaataaataagcattgagtacttgcttgactccttggatttctaaaggtatgttacttgaccttttttcttatataaacatattttacagcatcttacaaatcatatttcctgctatcgtgaaagggtctctagcgtaatggttaaggcttccgaatagcacctccaggtctcgggttcgatccccctcgggggcgaatttcaggcttgattaaaaaaaatcctcttgctgtgccccacctgctctcggagatcgatatcctgcgcgccaacctccggctgggccgttgcagagtgggcagttgatcggcccgttagtgatggggccagggtttgagggttttctcggctggaatcatgtttcggtctcttcttaatataataccgggagggcggtcttttccttcccgaccgggtttttttatttcctgctttcatgatacatttgttttacttagtcttcttatatttgtcatggtgtatgtgaagatagaggggacatgagtgtctgtgggaaaagcaatgcacatatcgggaattatatggtggtcaggcaaatagttctagccttaacaatttcagtgatgagtgtgaaaatcaaacaaccagcaatgatgaaatatccatatcagagtctaatttgtaggtcgggttatgtcccgagtggagcgaaggtcctgaaggagctagagaaaatcctctatcttcacataaccctcaggacctccaaattggaatccatagatacaaagttttgttagtacaacaactacaacattaagctaccaaatatttttgcaagagttgtcagaggtactggattacaggtggaagcatgagaaatattcctgtttgtgatgaaaggcgcaagagcaagagctccagcatcatgatgattctaggagtactatagctactccttggggagaggcttccctctatccattgtacgtagaaggatatcaagcaacaattaccttcgagcctgattctcctctatgcaactccatggcctctttgccgaagattggtgtaggagagcagattaagagttgcagccctgcttcagcagcatgacccagagaaacccaaatatgtccactttctactacaccatcagatggtccagggaatgaaccacaaaaaggaatgtcgagcgcaatcaaaatggttgggcatagcaactgagtcactttagtgcattttataccattcttaaaaaaaaggaataaaagaggaatgagactcagttcggtaccttgaaagcacaaatgtatacccattcccaagcatatcctaaaccattccctggcatggtgcttggtttgatcattccaagaattaatgcatctagcacaaaaacctagaattggtttttacttcgacattagaagcctcacttacaaattcgatatgaaaatgtgtactgcaaaaaggagaccctttgcacctgcctagaatatggaaatgaacacatgttattgtccatgcaaattattgatgcatgaaaataaaatggcacactgccccccagatggccagacccataggtaagcgtccgcacacttggcttcgcgtcttcatgtaacacccaaaatcctaacttgggatttgaggaaattctttgtaatttttttatcacactatacaaaataagtgcctttgataaataattgaactttagaatccaccgctctctaaagctaa

SEQ ID NO: 654 - DNA, 2151 bp, Zea mays
gacctagtttttggtgaattttgactttagcttggctcattatgagcatccgcaggagttacgcacgagttaggcaggagttatgtaaacaactttataaatatagatttaaatttaagaagtttataagaaaactcttctccaacagttatgtaaaacagatttctaaatttacaaactcctgaccaaatctaatttgatccctacatttatcatcttgttgggactcttgaaataaatgtttttgctaagatattgcgataagcatactctgactacggtttcgccgtctctttatctgccaccgctagataacctcttgtgccaaggtgtcgctagagcacctcctgtgctgcctccatgccgtagttgcgagggcgtccgtggatagtgtgtgctgttgttgcaatcatctggtccatcgacaactccgacctcccaaaacgttaaggaaggttattggtataaatttatgccatcaactcgatttaaaatagaaagtatgtcttttttttacattgacaacttaaaaaattaccaaccaatgttggagcataaacattttttactcaagtgttatagtaactttctctataatttagaatgctaaatttacataacttggattgctttatgtttgtcttgaagtttgatcttcaacagcccagggatataccaaatttaaagaaagctccataaatggtgcagttggcccgttaagtcagttattatgcacccctactgatgatagaatttggcaaaggtcattgttgttagttgtaactgctcaacattaaacctaaattaaagcaagtattatttacaccaggaagttttggccatatccccacaaaaactcacagaagaaattaaaattctctatatacagaagaacaacaaaagctgaatcactagtactttcctctgtttcaaacttttcagtgtatgccaagagcctggaatctcctcactagagcaagattggtcgcgttcctcctctgccagtcctccgtgctctccttcctctgctccagcttgtccagcacgtcttcgttgccgtccagaatgctcgcgatcttcctcatgctcggccgcgccgccgggtctgaccgggtgcacgccatgccgagccgagccagccgcacgagctccctacggtcaaacttgccgtccagccgccggtccgccagggcctccaccggccggtcctgctgctcaaggagctggaccttcctaacgaggaggacctccggcagcctcccgtccacggccattgtgccggtcaccacctccagcaccaccacgccgaagctgtagacgtcggccatggtggtcgcctcgcccgtgtccatgtactccggcgacatgtagccgaagatgccccgggccgagctggcggtgaccaccacgtggtgcccgccgccgtggcgctcgttcctcgacaggaactcggcgagcgcgaagctcccgagccgcgggttcatgtcggggtccaggaacaccgccgacgacgtgatgctgcggtggatcacctgctcgtcccactcctcgtggaggtacaggacggccgacgccagcgccctgacgatgctgtaccgctgccgccacgggaggaccgcgccgcagtcgcgccgccggagcaggtggtggctcaggaggctccccggggagtagtcgtagacgacgagcatctcgccgtggtccgtgcaccacccgcgcagctgcacgaggttcctgtgccggagcttggccacgttgcatagctccctggcgaaccggacgcgcagcgccgggcacgtcttcatgccgaggcgcttcacgaggacgtggacgcggccgtggccggtgtccaggaagccctcgtaccctgtcccgaagtccagctccgcgaccacctgcgactcggagaagtcgttggtgatggcgacgatctccttgtagggtatctcgcgcggcgtgtccacgtgcgggatcgccacgggcgctagccgagacgacgaccgccggccggagtcagcggacgcggacctggaaccggtcgtcctcccgtcttccgcggtgtggtagatggtgtccgcggccgcggtgtcgtagacggggttggaattggttagagacgtcgccgccgtgctcctgtcggtggtgacgtga

SEQ ID NO: 655 - DNA, 2149 bp, Zea mays
tgcatataattccacatagaaattactaatttaatccatattattactgctaaattaagcaattaacaaaagcatgcacgcaagaattttaacctcgcgatctaagttcagggtggattcttcattgtcagggttccccttgttttgcttgcattcagagttgaacttggaagaatttggagagggtggtcccgcgaaacaacaactgttggtggttgtcgtcctatatccctgactactgatttcaactacgaaatatttgaagttcttatgtgccttctttgcggcagtctatcagataagttaaagacaccaaaaccaagaggtgaaatacaaacacgcataaggaaagaaaagccattcaacactgaaggaactggtcatttgttcacttgttcatgtcaaaaagccaaaaaaaattatgagaaacctagctaattataagatgaagaagtcttaattatacttcccttagaatatataatagtaaatgttcttcgttagtaaaagagaaatgcatgcatcgagtactagctagataccattatcttgtggacaagcccaactttgtagacaatttgatggaagagataactagacaagtgatactttgtgaaaaaatttccaacaacatcactatatgattcttaagttgtctttggtatttcatgaacaaggagtgcaaataggcttggattttgcgttgcccttttgagatgaagggacgtcaacgtggcaatgtgcttcacctcctgcattgtagggaaaaacagatcagcaaaaaacattccaactacaaggagatggagcctttcagcaattcaaatgcgaaacaaatttacaatgtacagaattaagcatgttattccagaaattatgtattgcaccgcacaatggatcaagaggttgcatgcaaggaatcatcaaaacatacactttgttatattctacagtgctcattcttcttcaacttatcaagaagtgaatgaagaagcatggtggatgaattaatcaaggtagaaaacacttgtaagatgttgataactatcaaaacacacatatatatatatataattcaaaacacaagatttcaacatttgataataaattaaaagagagagagaaactttgctcggcttacctttttgattcctgtttcacattcgatactgtaaatgcatccattcgttccgaaggaattgaaacatgttgagtattctttccaaaataataattgactggaatacttcccaagagagccagaagtgtagcaatggagaagatgtgtatgcggttgaatatataaattaatatatgtgtttcagtctctgccaatttggttgctggggttggacatatgaactagtatgaatgcttgatgaaaaaggggacaaggaggtgaaaaggaagttttgtgtactgtacctaagtactataattcgatcaaaaacaactgcatccaacctagcagcaaataagagctcttcctcagtacactgcagggctttcactacccagctagtcgatggaacaaacctttcaaagttacaaccccctcggagtcgactgtattgctcaacaattctgcgtccgaagtaaatcttgacattggcgtgttgatttctcaaaacagagtagagcatcaagaagaggacacatataccaatgttgatgcccacagaggtcacaagcccgctggactccatcttgtaagaagtggcggagccatcccgcaataggagcctaggaaccattatgaatttctaaaattaatttacctaaagaattatatacatgtagcgacataagatcagacatctatcgagatagcccaactgaagtatcagtacttacttcaccaacctttcttttcaggaaggaggaaccaactgttgcagctgatatgggtcatatagtgcttgtatacacaccatccaggtcaaaagtgagaatgcaaaaataatgcagcctgaaactagtgttgatttacgccacttgttggatagccaaagattggaacaatacgtcttttggttctggagccagactagtaacccatttcattgggttagatgcctgcaccatatttgatgcagtaactgcgtcatagcgagttttgaaaaatacaaaagcagttgtgcattcctgc

SEQ ID NO: 656 - DNA, 2146 bp, Zea mays
aaataaatattttgctagaagatagtggtatataattatgtggcttcagttcattattcttcagaagacgtgttcctttggatgtgatcctgtttgttcctttcagctgagccttgttgctgctaagaagagcctagctgctgccgatgtggctactagaactgctcagactgattttactccaacacatgcccaatacgactctgaagacacgttgtccactgggacccatacacccgaagtgacagagtcgaggcaccgcaaccacaaccacaaccctgaagctaaagtttcagcaggaaactcggataggcgagtaaacgctgtgaaccacctagcgaaggagtttgaagacagacggcaggtgttcgaagacgacgcgggcttccttgtcgcagtcaggtccggccaagttggttcaaatacgaacccagacgaggaactccggaagctcaaggaccgctttgaaacatggaaaaaagactacaaatctcggctgaaggatacgaaggtaaaccttaataaggttggcactggcacccatgatgataaatcgcggaaaagatggtggggaaagaagagctccaagtgaaacgtgtgagaggtgccccagatcatttttctactgccccgggccaaggaaagcggccaagaatgccagggcagacatgaagaacccgccttggttctcgcactgcagaagcctggcaagataatgatgagctccatcgccggtgggtggcggcgctgttactcgtccagagtgtcaaacagatcaaattagccaataggtgaagcaagagttctgtacatgtatatcaattaaattagttctgagttttcagttgacagtgtatgtatgctatcgtgtatgtatgtagagtgataaatctgagatgtggaagggtaactagatacagattatccaccatgagcgaatagagatgcaaaaaagcagtattgtaatatgtgtacatacagtaaggaaattgttgaaatgtgcaaggcattttactctgaaactttgtttgcatctcgcagtattatgtacaaatcatttgaggtacatacactgcacagcagttgaatcctgagtttggacataatgtcctattgtaattgtcaggctctgaattctgcactgctgtgctgtcggatagcttgtgtttcaaaaaaaaaaaaaagtagacacaacacaactacatgtatgtacacaaatctgttagcaactgaaacggagcatacatgcatggaatgaagatcaaaactagtccagtacgtcctgagttctgagagaagcacacgaatatttgcattctttcatcgtacgaatgtaatgtcacaacacaaacgactagtctaaaatgtgggcacgccgtacgtggcccgctagctcaagaccgtggcgcgaacttggtggcgtagacccaagcgttgttggccacggggtcgtcaaggtggtcgagcaggttctcgaggggtcccttgccggtgacgatggcctggacgaagaagccgaacatagagaacatggcaaggcggccgttcttgatctccttgaccttgagctcggcgaaggtgacgggatcgtcggcgaggccgagggggtcgaagtactggccgccggggtagaggccgtcgccgtcgccgtcgtggccgttgacgcggaagccctcgacgagccccatgaggacgacctgggaaccgagcacggcgaggatgctctgcgcgtgcaccaggttggggttgcccaggtagtccagcccaccctcggagaagatctgtgcgccggccttgaacttaccacactggctccctgaagtccacgcgcacccagctctggagcacctccggggtgacgcagcccagcgcccccagcatcgcccaccgcccgtggatcacctccagcgccctgttccgcgcgacgcgaacggcgaacgcctccgggtccgcggacagccccgcggtgtcccagccgtagtcgccggggaactcgcccgtgaggtacgagggcgtctggtctcggtccgggccgtaccacagctcgttgccctgcaatggaagcggaagcgagcgctctcgttatattagttgatcaccggactggttgaaaccgaccaggcgtacgttacgtaccatggtgatc

SEQ ID NO: 657 - DNA, 2142 bp, Zea mays
aacgccaaacctagaacaatctgactaattaagcagggtatcgactacatcaattaaccaaatggacataataacaccagaaaatctatttttattcctagctttttattaactctttagattgtgtatcttaattacgtgttttaccgatttatccaaatcgatcaacatacatagaatatcattcctagttaaaccatccaccaattcactaacacgattaacaaatttacttaccctgactaatccgacgcgatagtcgcaagcatgacgacggttttcggttaacgtcatccaggggcctttttttcttcggtaatcaattgctgaagatctcctcgactgaataattttgacgaaccgaacttgagtcgcgcaggatgtccgagctttttgtcgcgcacttggtgaacaccacgctgctagcttcatcttcatccgacgcttgggatttcttgatgacgcgtggaacgacgacgagattgagtctgaagtgagctagcgaggacacgaatccagtgaggactctgaccacagcgagatcacgagctctaacgacacgaggttaaacggcgaacgcgttcggcggtctcacctgagccgaaccgaaggcgagaaactgatgaagcgaagttcgtcgataggcaccatggaggaatcagcgatgttgctgcacacacgacgacgaacgacgcggactgaggaaagactcgacgagcagtaacgcgaggagcaaagcgaggtcacggtcgggctcggacacaaacacacgtagcatttcatcgtgtccaacgcgcgcgtcacagactcaatgtcgactgcgagcagtttcgcgcgcatgacaacgctacggaggagaactaaacagggggcttcgcggcagcacgcgcaggaacaatggaacgctacgcgcgcgacgaggaagcagaaaaccacgacaagggagcgcggcgcgcagacagggcgatctagacgtgtggcaaggagactccagaagcaagcgccggcgagcgcaggggcgagctgaagcaggagcaccgattagaggaggaaaaagcacggcacgcagagacttcacgatgcggccaacagaggagcatcgagcgccatgggaggacgtcgagcacagcgcgcgcagacagagagcagaggagcacagcgcgcaggggagcaagcagcagagtcggctggggaaaatggaacttgggcgcagggaacagggaggtccgggcgccatggaggagagcgagcggcaggggagctcagcacggatcttggcaaggtgtggccatggaaggagcgaccggcacagagagcttgaggaacgcgcgacaggaagatggagcaggggaaacagtagctcggctgggcgcaggcgcgcgcgtagggaagctccgagcagagaacagcagcgcgcgtggggaaccgctcggctgtgcgcggtcagtgaggcgagtccgcagaaaatcccggcgccgagagcttggagacggactgggcagggaggaatcgccgagctgaagcgagcagagcgagagagaagcagctgggcggctgcggcgcggccgtggagatggggaaaatcacggcgcgcgcagagcagagattcgacagggagcgacggctgggaagcagggaagctcgcctgggagatacgcgcgcctgggagcttctgccggcgagcagagggggcgcggccccgaggagctccgagcagggaggggctttggctggagagaaatggaaggaggagaaaggaaaccgcgagctaggggagaggaaggcctggcgcggttggcctgggcactggggctggggcgcggtggagaagaagcagcgcgcagagggaaagaagaagacgcgcgcgtgagggagataagaacgacgcgcaggatttattccgcagcttgagcggcttcaggataggaacgtagatatttttcctttttcagatttttaatttctttaccgaaaaatctcagatatttgtggatcgagatttttagcgacaacaaaaggatcaacgcactagacgacaactggctacacactttattttccgaattaagaaacggaaaatccgaggtatacgattctgactaaatctcgttcggatagttttcgtgactgtttcgggcaaca

SEQ ID NO: 658 - DNA, 2141 bp, Zea mays
cagaagcatcaacaacaaaaaaattagactacatactccacaaactccatacaaatagagatcctaacttaatatacaacagccacaattccacgaactctgtctaattatccttgctatagtttacaaagaagaaagaatacacaactctgtctgtttttgaattagcagaatgtttatgttgctacatcttggactattcccgcagttagtttgaataagggaaatgcagcatgtgtattctcactgcgtcaggcccaggtcggcatatgcgcaacgcacaatggcatcgagagagagagagaggaggggccagccccgtccgctagcccgaaatacatcagtcgcaatgacaagaccctcggtgcggtgcccgagcggcgtgcaacagatgcgtcggacctgtcatcatggcggtacgagcgatgcgaccaacagagccgccgacattgtgctgcagcgcgcatgcaagcaggagacttggcgcgccggattatgacctggccacgcacacgacgtgcacacacgcactagctagacgacctccttgcagcatcggcgctaaacaaactcacgtaaataaaaacaaccagcggctgcatgcacacagatggagcatgcatgcagtcgacgcagtcgacagtcgccaccgacatgcacttcccccacgagcgatctcaagacttgatggatcgttgttgtttgcttggataagaactgaacaaattagggacagaaagcagagtggcgtacgtgtgccatgcatattgccactggcggcttctattaatatacttcccttgcatgcacacagatggagcatgcatgcagtcgacgcactcgccagtcgccagcgaggcgcgcttcccccgcgcgagcgatctcaagactcgatcgatcattattgttcgcttggataagaatggaacaaattagggagaggaagcggagtggcgtatgtgtgccatgcatattgccaccaggggcttctattaatatacatcccatggccttcagcgcgatagatctaaaaagaatccctgttgttatagcttattatcattgcgcttaagtttgcttccagacagtcagacctcagtcgtgacccgcatttttatgtgagttttcttatgtacgtacccctctcttaccagtaaatgtgctagcttatatgtatatgtatatgttttttttttgtgatttctttcattttttcttgtagatggaaaatatgacccaagatgagggtaggttccgctggtatccggatatagacactgtgttctgcaggggctgcatcgacttgcttgacagcggcatcataaagcagaggcaatccaccttggatgatacagctctggaatatttgtcggaaaaactttataaggtgacaacaataacaatttcaaataaaacactcataaacagatggaaccgtatgaaacagttgtatgatgaccatgttctgcatcgtatccactcttcaaacatgggggagacgaaaagccgcaagatgcatattaaaaaaacaagggtattctctgtctctctttgattgaatccagattatatatattctaattatacgtttgtttcatttttagaaatgtggcaatgatttcaagcatatgataaatgaaccacctaagaatttggatctacttgagagattgtttcacgaacaagatgaagcgacaccgccatgacatgcgccattccagccaccgccgacgccccccaacacgtgtgccatcaaggacaccatcgatgtccccgccagcgtcgtcgtggcatgacatgtctccctccaaggtagacgtttatgtcatccacaaacaactaaacgtttgggcaaaaggatggatgtccggaaagaccaaatggatggcgttagcaagtcaaaatcttgtcagtgtcgtgacagatgagtttttgatatgttgggctatttgcagccgagtagtggaatcaataattattcacttttgtgtgttcagattacccattaataaattttgtcatcgatcaccatgatatattggttcaaggaacttttttagtgttgtttcttttgattcctttatgtgtctagcttgcatctttttacaatcggccatgataatagagatagagaaaggggc

SEQ ID NO: 659 - DNA, 2140 bp, Zea mays
cagaagcatcaacaaaaaataaattagactacatactccacaaactccatacaaatatagatcctaacttaatatacaacagccacaattccacgaactctgtctaattatccttgctacaatttacaaagaagaaagaatacacaactctgtctatttttgaattagcagaatgtttatgttgctacatcttggactattcacgctgttagtatccaaattttgaattagggaaatgcagcatgtgtattctcaccgcgtcaggcccaggtcggcatatgtgcagcgcacaatggcatcgagagagagagaggaggggccagccccgtccgccagcccgaaatccatcggtcgcaatgacaagaccctaggtgcggtgcccgagcggcgcgcagcagatgcgccggacccatcatcatggcggtacgagcgacgtgaccaacagagccgccggcattgtgctgcagcgctcatgcatgcaggagacttggcgtgccggcttacgacctggccacgcacacgacgtgcacacacgcactagctaggcggcctccttgcagcatcggcgctaaacaaactcacgtaaataaaaacaaccagcgggtgcatgcacacagatggagcatgcatgtagtcgatgcagtcgacagtcgccactgacgcgcacttcccccacgagcgatctcaatactcgatggaccgttgttgttcgcttggataagaaccgaacaaattagggacagaaagcagagtggcgtacgtgtgccatgcatattgccaccgggggcttctattaatatacttcccttgcatgcacacagatggagcatgcatgcagtcgacacactcgccagtcgccagcaatgcacgcttcccccgcgcgagcgatctcaagactcgatcgatcgttgttttttgcttggataagaacggaacaaattagggagaggaagcggagtggcatatgtgtgccatgcatgttgccatcggggcttctattaatatacttcgcatggccttcagcgcgatagatctaaaaagaatccctgctgttatagcttattatcattgctcttaagtttgcttccagacagtcacacctcagtcgtgacccgcagttttatgtgagttttcttacgtacgtacccctctcttaccagtaaatgtgccagcttatatgtatatgtttttttgtgatttctttcattttttcttgtagatggaaaatatgacccaagatgagggtaggttccgctggtatccggatatagacactgtgttctgcaggggctgcatcgacttgcttgacagcggcatcataaagcagaggcaatccaccttggatgatacagctctggaatatttgtcggaaaaactttataaggtgacaacaataacaatttcaaataaaacactcataaacagatggaaccgtatgaaacagttgtatgatgaccatgttctgcatcatatccactcttcaaacatgggggagacgaaaagccgcaagatgcatattaaaaaaacaagggtattctctgtctctctttgattgaatccagattatatatattctaattatacgtttgtttcatttttagaaatgtggcaatgatttcaagcatatgataaatgaaccacctaagaatttggatctacttgagagattgtttcacgaacaagatgaagcgacaccgccacgacatgcgccattccagccaccgccgacgcccccaacacgtgcgccatcaaggacaccatcgccatccccgccagcgtcgccgtggcatgacagtctccctccaaggtagacgtttatgtcatccacaaacaactaaatgctttgggcaaaaggatggatgccctgaaagaccaaatggatggcgttagcaagtcaaaatcttctcagtgtcgtgacagatgagtttttgatatgttgggctatttgcagccgagtagtggaatcaataattattcacttttgtgtgttcagattatccattaataaattttgtcatcgatcaccatgatatataggttcaagaaactttttcagtgttgtttcttatgattcctttatgtgtgtagcttgcatgttttttagaatcggccatgataatagagatagagaaaggggcaa

SEQ ID NO: 660 - DNA, 2031 bp, Zea mays
ccgatccaccttgagtttgagggtgagcggagcattgtggatataatagatctatcgtatttttacatgcagtctaatggggcttgtgcatatttctcctcttgtactagtgtctaatattgaaaacatttggtcaaagtaggatgtggtcctatagattacatatgggcactaggaactggaagtttggctgtctcgtccagtatcacgactcctagtctgccattctttatggaatactagtccacaatcctctatgggaattgtaacacagtgaggttggtgaatgacaaaagtttgttgtgtggagaaatcatacttaagaactttggctctatgaccacacatatatagttaatgggtgggacatgttaagaagaaagaatttgatgtaatcgacattgcgacatcatagatatggttaatgggcgagacctgtccttttgaggattgttagaggtttctttgctagtggacgtactcgagctagaacattgcttctcggcaccaccaacaatcttaatttcctctaagggtacttcttcaatattaaggaactcggaataagaagaatggagtatgtggtgaatttcctcccttcttcctaatcgttcaacttccatatccgtgtaaactaaatgttgcaaaatcacaaggcaacaataaatgccataagagaagagatcttgcaaaatcacaaggcacaataaactctagccatcaattattattctatgctctagtaaacctagtcacatctccacatgatcattttggaaaggaacatttcacattatattaacgaactaatattacctttgttggaacagtcttgaataacagaagactctttctatagtaaaggtgaaatgaaagagtacagctcataagaggtatggtcaagcaaagagctacccacgactctttagtgtcaaatacactagcacagaggatatgggtgtgcacgagagagaatatggttgtgttgtgtgcaattggccaatacaatcctcctatgtcaaaccttgttcggtaaacattgagaaactgaaaaagaacacatggtacattagcatgaatggacaaattttggggtaagtaagaaaaaaatatagtttctttgttctcacttgattgcggtatacaacacgaccaaggtaaaagtataccagcaggaacggtaaaatcataggagccaccacggagcatgtgaagcccaatagtccaaacaatagaagttttggcacctcatgctgactggggaatgtgggaacagattctatatcttctctatattttccctttctcaaaatatatttcttataaagctcattatcagattaaagaacagcaaaagttcagatgataaactagcccatcccgaggtcataacataggtgatgaagaaagtagcctgcaataaaaaataaaatcacagaaaagaaacagaaatgttagatgaaaattaaatacacaaaaccaacatattatctttccataaagaaaagggaaggtgtgctaaagctgtctagttaaagctctagcaaccttgacaggaatgtcttttgggcttaatatcaaattcaattgactcatgaatgtactagatagtacattaacaaagaatatgttccaatctatgaagcacaacagtttaaagcaagcactcatcttccttgcactgtaagatgtggcaccttccaatttagaaactttcatcatcaatgtcccaacaatatacagaataatttgttggatcacactaggaaggtatcctgcaaataggctgagtaatatatattcaatagatgcaacatggagacatgtcaaatggatagtatatatatttgtagtgacataagaacacacatctatggagatagcccaactgaggtttcagtacttacttctccaacctttctttcaaggaagcaggaatcaaatgttgcagctgctctgggttagatagttcttgtatacacaccatcagcatcaaaagtaagaatgcaaaaataatacagcctggaatta

SEQ ID NO: 661 - DNA, 2138 bp, Zea mays
acgtcccattagtatattgttagagtagataatgaatagcatatcagcggggaatttgctattttgtcactctcagttgtgaacttctctattttagattcagacccacaaatcataaacacagatggtcccacgagtcatagacagagggtcacataatagcatttagcccacgttaaaaaagctaaaatagcaaatttttcgacgacgatgggctcctcgagcccatggccacgactagcattgctactcgtgacagtcgcatatatgaggaagagactaccaaaatctagactctaggctaactttaacaaggtgacgacgttcgacggtaaatgtaaaaaggtaaggatctttgatatcagcaaaccatgcaagagtactgtcggagagaaaaaaatattaaattctctgagaaataagtgaaaagtaaatttgttgcagggaaagatacaatgtttgatgggctacagtaaaaatatgttgaacaatagaaaatacagtggcagtatgtctaaactacggaaaaagagtacatagttataaatgtttttttcatgaaactaaatactactttgtagtatagttataaatgtttttttcatgaaactaaatactactttgtagttgaagtacagaagagagaaaccatacctctataagttggtagccaaataattgtagccccgcagaaattgttgctattaaaacaatttttagaaatgtataagtgactttatgtagcagcacccatatcgagtagtagcaacagctcgaatgaaaataaactatatgtcagatgtatagaggacccatggtggactgccatctcgaaaccatacaaaaaattcttatgatgccaacagagaacaaatattgatagcaagagaaacgatggaagtcaatttaagataactataaacctttctccatgatcataaattgaatgttgtttaaaaatgatatttgagatctttgggaactcatctccatgttcctgtttatgctatctctgaatgaaatgttcttactcctaatgaaaataacattatagaactaaaatggccaaaagagcgatggaagtcatctttaagataattataaacctatctccatgatcataaattgaaagttgttataaaatgatacttgagatctttgggaactcatctccatgttcatgtttgtgctatctctgaatgaaatgttcttactcctaatgaaacaacgttctagaactaaaatggccaaaagaggtgtcgaagatcataagtgtataattatcagtataaacctatctccatgatcataaattgaatgttgtaaaaaaatgatacttaagatatttgggaactgatctccatggtcatgtttatgctatctctaaatgaattgttattactcctaacgaaaacaacattctagaattggaacggccaaaagagttgtcgaataccataagcctataattatcatgaacatttatataccaaattgtcactttcaggaagacatttacaatgaaaataatctggtttctgatttggatataacttttttgtattcaagcgtaagagaagaaggcagtacatatgtaagtcatcaactgaaagtgctgttctttacggagaatcattgttataatgaggaaatcagggaaactacatgagtgccaaaaaaacatgacaatactcatattgtttaccaaataaatgagtagactatccatatgatgtaatcatatatggggtccaaaccaaaaggaaatatagaatcatacgcggtttacaacattacaattgtaaaccgaataagtgttgttatttacgaagaatcgttgttgtaaacagaatttaggaaaactacatgtgtgccaaaaagaaagataacagtactcatatcgtttaccaaataagatgactatccataaaataagtagactatccatatgatgtaattatttatgggttgcaaaccaaaagctaatatggaatcatatgcagtttacaacattatgagaacagtgcttcaaaaattaaacaaagactatcggaacccaaaaaaacaaaagaatggtcacctaattcagtaacggaggctgggttgcactaattggattgattgattgtccctaccta

SEQ ID NO: 662 - DNA, 2138 bp, Zea mays
catcagtagagaactacgatacttgacgaagaagaagaagaacgattctattgtttctgcatacccgtcttcaattgttgttgctccttatgtattgtcagctaactgggcccgcaaatactatatgggctgggtacctaacacacgcacccggccctgcctctccatcaaactgcatctcccctcggctgtccagcaggaagtccagcgcctccctctgccccctgtgctcggcacccctcctctttgttccctatttagcgcaggagcccccatggtgccttgaatggccatggcgtttccctttttcttgtgccttgcctccctgccgggtctcttcttggtggctgcaacgagctcccttactccctgctatggacgagcctccggtgtgcattagctccccctcggtcgagctctcctctgttgctgtggccagcgactcctttaggcgggtcttcatcctgtcgcgttggacactgctccttttccctggccaccgtcgaaccagtgtggacccgatctacggtgctgcgcagcgtcggtctacatcagcagcctcaacatcgcctctgcgtcgcgcccttggcgtgctcgacaaaatgccacagcaagcagcagcagcgacgcctttcgctgcgtcgcgctagccaggacgggcctcacgctatcgatctgcgcagcatctgcgcgtcgtcgtcgaaacccgtggtgagaccccattgtcccgtgcttttcgtgttcgattaaatggccacaccaatgaatcgtataataaactgtgccgtgctcgaagcccttgtcgatgtcacgcctcgcgcatcgattgtcggcaaagagcccaaactaatggcatgcatgcgcgtcacgagtcggtcaggttgttcaccttgaatgattcgcgatttgttttatttacgtattcgatcgatgatgtgcctgcgtgtttatatgtgtgtgaaaatataattgtatgaatgaacgcgtgtagggaagaaaatgaaatagaaaagaactcgggtatttttattttgataggaaaatatgcgatgcgttgtttgatgcgaagactaagtttaaataaataaatagataaatgcggattatgttttgggaaatgcatcgatttgtgtttatgtgaaaagtgtatttgttttatgcaatgtgatgggattcatgattatatatggagtatatttatcgatgtgatgagtagtttagaaaatgctagtttgcgcggatgatgtattgttaagacatgagtgtcggagttcatatattagtggttgcgccacattgattgaaatgtctcgagtgcacgccaccatatggttgtatgcgagacgaggttatgcgcatgatgagtttagtaaaaatccatcggtgtcactggtgttaagttgaagtttatttgcgcgtggaaagaaataatgtgtttaaaacttagaacacttagtcgatagtagaaattgtttggcttatatagagaggtgatgacatgccaaagtagtcatcgcttcctctatatcttgagtcgggtcaatacgtgttatgtgttcatgaattgggaagtaagcgcatgatggtttcgagttagagattagtggtttgtggtccgtatgatttggtcgatgtgtgaatatacatgtgaatatgtatgtttataaaaatgttgtggtgtatgttgtgccttagataatgataataataggcaagccgacgtgtattttatttagcgggctatgccgttgctctagttagccgaagtgttagatgggttggttaagctcgtaatcacgatgatttgcttattatggcctaaatgcgcatggttacggtcgcgggtaaaaattagtagggttcatgtgatgcccaagttaaaatgcaaattactatgtgaatagcgcatcgatatatatgtatgaccggtaagattattgtggtagatgcgttactaattgtgtatggtaattctagcgcccaaaataacttgtataaaattagtaagtctacttattggtcctaatttggttgttttaactctaatagatggtaaagtgctataatggttcaagtctctagaacgcggcaatttttgaagtaaataagagctgaattttattagttgctgttttggg

SEQ ID NO: 663 - DNA, 2136 bp, Zea mays
atctctattatcatggccgattgtaaaaagatgcaagctagacacataaaggaatcaaaagaaacaacactaaaaaagttccttgaaccaatatatcatggtgatcgatgacaaaatttattaatgggtaatctgaacacacaaaagtgaataattattgattccactactcggctgcaaatagcccaacatatcaaaaactcatctgtcacgacactgacaagattttgacttgctaacgccatccatttggtctttccggacatccatccttttgcccaaacgtttagttgtttgtggatgacataaacgtctaccttggagggagacatgtcatgccacgacgacgctggcggggacatcgatggtgtccttgatggcacacgtgttggggggcgtcggcggtggctggaatggcgcatgtcatggcggtgtcgcttcatcttgttcgtgaaacaatctctcaagtagatccaaattcttaggtggttcatttatcatatgcttgaaatcattgccacatttctaaaaataaaacaaacgtataattagaatatatataatctggattcaatcaaagagagacagagaatacccttgtttttttaatatgcatcttgcggcttttcgtctcccccatgtttgaagagtggatacgatgcagaacatggtcatcatacaactgtttcatacggttccatctgtttatgagtgttttatttgaaattgttattgttgtcaccttataaagtttttccgacaaatattccagagctgtatcatataaggtggattgcctctgctttatgatgccgctgtcaagcaagtcgacgcagcccctgcagaacacagtgtctatatccggataccagcagaacctaccctcatcttgggtcatattttacatctacaagaaaaaaatgaaagaaatcacaaaaaaaacatatacatataagctatcacatttactagtaagagaggggtacgtacgtgagaaaactcacataaaactacgggtcacgactgaggtgtgactgtctggaagcaaacttaagcgcaatgataataagctataacagcagggattctttttagatctatcgcgctgaaggccatgggaagtttattaatagaagcccccggtggcaatatgcatggcacacgtacgccactccgcttcctctccctaatttgttccgttcttatccaagcgaacaacaatgatcgatcgagtcttgagatcgctcgcgcgggggaagtgcgcgtcgctagcgactggcgagtgcgtcgactgcatgcatgctccatctgtgtgcatgcaagggaagtatattaatacaagcccccggtggcaatatgcatggcacacgtacgccactctgctttctgtccctaattttttcggttcttatccaagcgaacaacaacaatccatcgagtcttgagatcattcgcggggaagtgcgcgtcggtggcgactgtcgactgcgtcgactgcatgcatgctccatctgtgtgcatgcagccgctggttgtttttatttacgtgagtttgtttagcgccgatgctgcaaggaggccgcctagctagtgcgtgtgtgcacgtcgtgtgcgtggccaggtcgtaagccgacgcgccaagtctcctgcatgcatgcgcgctgtagcacaatgccggcagctctattggtcgcgtctctcgtaccgccatgatgacaggtccggcgcatctactgcgcgccgctcgggcaccgcatcgagggtcttgtcattgcgatcgatggatttcgggctggcggatggggtcggcccctcctctctctctctctctcgatgccattgtgcgctgtgcatatgctgacctgggcctgacgcggtgagaatacacatgctgcatttccctaattcaaaatttggatactaactgcgggaatagtcaaagatgtagcaacataaacattctgctaattcaaaaacagacagagttgtgtattctttcttctttgtaaactgtagcaaggataattagacagagttcgtggaattgtggatcttgtatattaagttagaatctctatttgtatggagtttgtggagtatgtagtgtattttttttgttgatgcttctgtgtcaca

SEQ ID NO: 664 - DNA, 2136 bp, Zea mays
caaactaccagccgtgttcctccttatccccgccgcctcctacccctgataatctctaccgccgccctcgcctttagatttttctgccgccgcccatggggatcgattttatcctgcgccgtgtgcccatctcctctcctcccagcatcacgccccctttcctctgctcgctcggcgcccacacagagctctctccagctcggtcgcgctcgcccagctctccgcgccatcggagctccccgtgctgtgcgtccctctccccgagctccctcgcggcggccttcccctgctggtgctcgaccccaacggccagccatgcttctctccctctcggcctggcctgactgtcggtctttctctgcgccggtcacttctccctgttcttccatggccacaccaaattccctccgcgcgctggcttcctgctcggccgtccatctccccgtgcccgagctcgtccatggctgcgcgcccatcccccatggtcgtgtccgcccagacatccgctcgccctacgcgcgcgttcttccctcgccatggacgctgctctttcttcctgctgtacgcctgcgacatctccaactcggcatcgcctgctccagctcgcgaagctccctgcgcgcagtcgcgttcatatgcttggtcctctagtgcccagccgcttttccctctgctctatccaaaccgctactcccgccgtggagtttccccgtcgtcccagcacggagctcccaggccgtggttgtcgcgtgcctgcgcgtagctcccgccctgctcgcccctctgctcgtcgagctcatccgtccgcgccgtacccttttccctgtgcgcagcagtaccctctgctcggatttcgcttggtcgcccactgttccccgcgcgcgcccatttccctgttgttgcgtcgaccggagtttcctgctcgtcagcgcgccctctcggccttaatccccatcacgtcatcgacctcgccggttgtcgtcgttgtcgtcgcgtcgtgtgtgctcatcctcgccaagatctggccctgcgagttccacgcgccccggctgcgcgtcgccgtgatgttaccatttcgccgagtccttccccaatccgcgccataaaattcgctcggccacagtcccatcaaactgtgaagcttcctcgccgtgcgctctggcatcggccgccgccgattctgccataaagttcacgagcactccttgctcagtttgtttcgcagcgggcaatttctccacgtttcaattccatgctgctttccctgtgtgcgctcgctcctcatccatcgggttttggtgtgctcgcgtttaccatcgagtcatcgaacccgtcatcctctgctcgacccccacctcaccagctcgcttcaaactcgatctcgtcgtcgttcgtgcatccccaagaaatccctagaattaggtgaagacgaagctagccgggtgatattcaccaagtgctcgacaaaagctcgaacaagtcgtcgatcgtcatcctcgtgtacgccaagatccaagaagattaggcggagaaggaaataaatcagtacgcagccagagaattctcgatgtggacaaagaagaagcgcgattcgacacagcactcaccctattttcggtgaaatgttgagctgaaaggcgtcgtcaatttcgtggtttcaagtcggatgtcataagggtaagttgattcgtattcgagtcaactaggtctataaatagattaaatagaattgttggtcacaataaatattattaatttagcatgtgtatattgtgatgatcaatttagataaatcagtaaatcaagtaattaagatacaaagtttaaagagttaataaaaagctaggaataaaaatagattttctagtattattatgtcaatttggttaatggatgaagtcgatgccctgcttaattagtcagcttattctaggtttgctgtttaattcgctgtcgtataagtattatttaggtttgcgatattcctccttatatgcatacatgtgcattatgcatatcattcaggtacgttaattaatcacatgatgcggaagacgacccaagtcgaccccaagcacgggttactccgcatggtgatattgatggacgaacctgtctgatcaagtgctaggacaa

SEQ ID NO: 665 - DNA, 2135 bp, Zea mays
cagatgtttatatttcgctcgacaacgagtacggatttaagcacgtaatcggtggataaaatgaatgctaaattttaaacatcttcgtctatcgcgattttaatatcgcatctgattcggctgtcgcgagtgcgacatcgtttttactttcatctatccgggctcttactaaattttcgtgatgttcggaacatagttgttccaaaaatcggtgcgtccggtgactatttaaaattcatcgctcgcgtaaatatgaattcggaagcccgacccactcggataattttatccagtgaaaattaattagaactcaacgacaacgatttttggttcgaaacaaacccgaccaagtgcgctgtcctcagcaaagaaattaatggtgttcggaggacagatacattttcgtctaattccaactaaagcaaaccccatctaaatatcaaagccgatgttcctaggtttgatctgtcgacatctggctaaaactcagccttctaaatttttcctcaaacaaattcatttagaattcaacaaataaagtattcagttcaaaataatctcgaccccgtgtgttatctgagaaatcgtgttcgaagataatgacgtggtctggtctgttatttcttgctatactctgagcattcggataacagataatttttttatccgggttcaactaaattaatggcgtctcaagtatcgtatcttgatagtgttttggttcggtctgtgagtttctctccacgatctaattttacaaatataaataacaggtaaaaattcatctgactccagaatatttaccaaatcaaatcatatccaaatattattgtcgatctcgttttggtccggtccatttatatatcttctaaaccctaatttcttaaactatgtttatccataagctataacaaaaaaaagagaaataaaaagaaatatctttttccttgtattctcacggcctaagctatctttctctcccatacgctatttctctattctagaaattccttagatctgtggcagcatttatccacgcatccattttatgcaaaaaagttctacgtatttctctagctcatccactaccgccgttctcatccgttccagcgacgactaatctctgaaatatctccactacgtagatattttctggaactaatctcctcacgccagctccaaatatcggctcaccaccgccctttctcaatccatatcttgaagcgtacatgtccctggaagtcttcagcacgccatcatgtctccttcacggcttctccaggcttcggccttcagctctctcgtgcgtgctcacgtccgccatggacgttgtgccttcaccagccctgtgcggctagaccagccaccgtctctgacctcgccatggttgtgctgctccagctctggtcgccgtccatgcgttcgctcccaggccacgacgaacgccgctggccatgcggcttctgtgcctggcgtgctctccatcacccatgacgtcatcgcctctcctggcctcatgcagccgcgcgctcatacctttccctggccgcgagctcgtcgtgcccagctcggtcttgtgcagcgcgtcgacgtctcttgcagcctcgacatgtgttgttcgtctcactgcgtcatgccttggccatgctgtgcgctggtattccctcccagtagaccacgccggtgtctaaccttgtttgcttcgcggtgtcaccatcgtcatctgctagctccatcaccggccattcctagtatttttctctaacaccgagcctctctgacctcactgctcgtcggtgcaatttgtgtgtgtggatgaagaaagcgagaggcccatgtgcattgctcgtcaagtgttcggtcgaagacttcaaccggagactgtcgtcgttattgcaaatattgagtggagttgatgatggtgagctgattctctacttttattatttgttttaataaatggatcgatagttatgtaggttacgttggttctcgtatttttagcaagagcgatatgtattgaattaatcgcatcgtctagtattcgtcagttcgtaggtttcacgtgaaattagtattagtggattcgagctgaatttaatattggcgcacatttttggttattcctattagcc

SEQ ID NO: 666 - DNA, 2135 bp, Zea mays
ttgtcctagcacttgatcagtcaggttcgtccatcaatatcaccatgcagagtaacccacgcttggggtcgacttgggtcgtcttccgcatcacgtgattaattaacgtacctgaatgatatgcataatgcacatgtatgcatataaggaggaatattgcaaacctaaataatacttatacgacagcgaattaaacaccaaacctaaaataagctgactaattaagtagggcatcgacttcatccattaaccaaattgacataataatactagaaaatctatttttattcctagatttttattaactctttaaactgtgtatcttaattacatgatttactgatttatctaaattgatcatcacaatatacgcatgctaaattaataacatttaatgtgaccaacaattctatttaatctatttatagacttagttgactggaatacagatcaactaacccttatgacatccgacatgaaaccacaaaattgacgacgcctttcagctcagcatttcaccgaaaatagggtgagtgctgtgtcgaatcgcgcttcttctttgtccacatcaagaattctccggccgcgtactgatttatttccttctgcgcctaatcttctcggatctcggtgtagacgaggatgacgatcgacgacttgttcgagattttgtcgagcacttggtgaatatcacccggctagcttcgtcttcacctgattcttgggatttcttagggatgcacgaatgacaacgagatcgattttggagcgagctggcgaggtgggggtcgagcagaggattacgagtttgacgactcgacggtaaacacgagcacaccaaaacccgatggatgaggagcgagcgcacacggggcaagcatcacagaattgaaacgtggagaaattgcccactgcgaaacaaactgagcaaggagcgctcgtgaactttatgcaggaatcggcgacagccgatgccagagcgcacgacgaggaagcttcacagtttgacgggatcgtggccgagcgaattttatggcgcggattagggaaggactcagcaaaacggtaacatcacggcgatgcgtagccggggcgcgtggaactcgcagggccagatcttggcgagaacgagcacacacgacatgacgacaacgacgacaaccggcgaggtcgacgacgcgatggggattaaggccgagagggcgcgctgacgagaaggaaacttcggtcgacgcaacagcagggaaatgggctcgagcggggaacagcgggtgaccaagcgaaatccgagcagagtgcactgccgcgcacagggaacagggtacgacacggacggacgagctcgacgagcagaggggcgagcagggcgcgagctgcgcgcaggcatgcgacgaccacggccagggagctccgggctgggacggcggggaaactccacgacgggagtcgcggtttggacagagcagagggaaaagtggctaggcacaagagggccgagcagatgaacgcgactacgagcaaggagcttcgcgagctggagcaggcgatgctgagttggagatgtcgcaggcgtacaacaggaagaaagagcagcgtccatggcgagggaagaacgcgcacgtagggcgagcggatgtccgggcagacacgaccatgggggatgggcgcgcagccatggacgagctcgggcacacggagatggacgaccgagcaggaagcagcgcgcgcagggaatttggtgcggccatggaagaacagggagaagtgaccagcgcagagaaagaccgacagtcaggccaggccaagagggagagaagcacggctgggagttggggccgagcatcggtaggggaaggccgccgtgagggagctcggggagagggacgcacagcacggggagctccgatggcgcggagagctgggcgagcgcgaccgagctggagagagctccgtgtgggcaccgagcaagcagaggaaagggggcgtgatgctgggaggagaggagatgggcacactgcgcaggataaaatcgatccccacgggcggcggcggaaaaatctgaaggcgagggcagcggtagagattatcaggggtagggggcagcagggataaggaggaagacggctggtagtttg

SEQ ID NO: 667 - DNA, 2134 bp, Zea mays
agtttatgtttgttgatgcatgtgagtgttatgaagatgcacatggatcatagcacgaattggtgatgctgaccccttgcggcgtgctcaaagttgaaatgtttgatggtattttgcatgttatttttcactttctttataacttttcagttggtaaatttgatatacatatgcaaataaccgatgttagatatatatagatacaatatagcttgtttctttatatagggtactaggtatttgcacgatgtagctgttgttgacacctaattgcactatttacttgccaaatcaagcttagtgcctcattggttacaattatgcacttgtagccatttgtcagccaccctacaaatatacaaataggtcagatttgatgtattttctatttctaataagcttctatgatgtatgaccttgcaataagaattttagtgccatgatgataggatcagcaagacagtttctaagccaatctgaaacacttgacagtttcacagggatgtgtcaaccatgcccacatttcttgtttatttgttttggaaccaaacttaaatctgaacatttttgttgtgagcaataagaatttcagtgccaagattttgtagacaaaattataaaaatttgttgcttgaataaactaaagaattgaaggaggaaattgttgtttgtgtctgtgttgcaggtgatggggagtcaaaaaggaaggaggagtacatgtgcttcctagagcaccactgcacctgatactcatacgtctatgacgtcgtcgcggtgagcagctcagcgaaagtacccttactgtagctactgcatcatgaataagaaaattctatctatgcaaaccttgggaagatcaagactaaatggagtatcatttgtcaacttttagctcattgctactgaaacaggagctgaatttgggctattaattttgtgtttgtatttgtaatctattttgcagtcttgattatgtctatttcatattctaatctggaggatgttggaggtccttaggtttgtgaatgaaccttatatattttataaacctttttatcaagcttatttcgataataaatgaagcacacatctttgatgatgaatttgcaccggcctctgatggttccttgtgataatgtgaagctttgctcattttctagagttagggtgtgagttttcgcattattaaaataaagataacattttcgtctagctgaaatagttttgtatttcatatgtactttaattaaatatatttctactgaaactacgcagtgaagttgtttgacgatagacttaattgaaatctaatgtcttgggcaaggagccgaggaaacaacgtgaagccagggacgtcgcacgctgaccgatggacacaaggccacgtgacgctgaaagcccacatgcgtcgtacattagggacatcgatcggtacctccactccctggaggtgaagacctcttgagaatcccaccctttccactgtgtttgggaacatgtgcgcgagcgtattgagtttggttgatctagactgtgaatgtgtggtcgtagttgtagatgatctaatggcctcattttagaggcgtgttcatgttgtactcttcggtgctaagatttgaccagcttaattttagtgggcattatgtgattcaaatttttgctagagtgagacgctcatctcttttcttgttttaggtttttagctactgttggctaggtaagtgtagtgcagctatggtgaagatccttgtctagaggttgcgagacctatgttcagaggctgcaacaccttcacaaatgaaagtgaatctttggagctcaattcatttaccttagcatttgtacggagatgtggaattgttagcctttaaggtgccactttctctaaactctctgaaactgctaggttgaactgttgagcaaatagcctttcttctgcagaactttcaattgcatatgtttatttcccatgggccatacatagatgatcgaaacacacttctatttctgtatgcaacacaggtggcgaaaatggtggctgacttggtgaaatctcttagctttcagattgtgggtcccagtataactgttggcagatatttctatgcaaagatggtggctgacttggtgaaat

SEQ ID NO: 668 - DNA, 2133 bp, Zea mays
attatcatggccgattgtaaaaagatgcaagctagacacaaaggaatcataagaaacaaaactgaaaaagttccttgaacctatatatcatggtgatcgatgacaaaaaatttattaatggataatctgaacacacaaaagtgaataattattgattccactactcggctgcaaatagcccaacatatcaaaaactcatctgtcacgacattgagaagattttgacttgctaacgccatccatttggtctttcagggcatccatccttttgcccaaagcatttagttgtttgtggatgacataaacgtctaccttggagggagacatgtcatgccacggcgacgctggcggggacggcgatggtgtccttgatggcgcacgtgttcggggggtcggcggtggctggaatggcgcatgtcatggcggtgtcgcttcatcttgttcgtgaaacaatctctcaagtagatccaaattcttaggtggttcatttatcatatgcttgaaatcattgccacatttctaaaaatgaaacaaacgtataattagaatatatataatctggattcaatcaaagagagatagagaatacccttgttttttaatatgcatcttgcggcttttcgtctcccccatgtttgaagagtggatacgatgcagaacattgtcatcatacaactgtttcatatggttccatctatttatgagtgttttttttgaaattgttattgttgtcaccttataaagtttttccaacaaatattccagagctgtatcatccaaggtggattgcctctgctttatgatgtcactgtcaagcaagtcgacgcaacccctgcagaacacagtgtctatatacggataccagcggaacctaccctcatcttgggtcatattttccatctacaagaaaaaaaatgaaagaaatcacaaaaaacatatatatatatatacacataagctagcacatttactggtaagagaggggtacgtacgtaagaaaactcacataaaactgcgggtcacgactgaggtgtgactgtctggaagcaaacttaagcgcaatgataataagctataacagtagggattctttttagatctatcgcgctgaaggccatgacaagtatattaatagaagcccccggtggcaatatgcatggcacaagtacgccactccgcttcctctccctaatttgttccgttcttatacaagcgaacaacaacaatcgatcgagtcttgagatcgctcgtgcgggggaagcgcgcgtcgctggtgattggcgagtgcgtcgactgcatgcatgctccatttgtgtgcatgcaagggaagtatattaatagaagctcctggtggcaatatgcatggcacacgtacaccactctgctttctgtctctaatttgttcggttcttatcgaagtgaacaacaacgatccattgagtcttgagatcgctcgcgggggaagtgcgtgtcggtggcgactgtcgactgcgtcgactgcatgcattctccatctgtgtgcatgcagttgctggttgtttttatttacgtgagtttgtttggcgccgatgctgcaaggaggccgcttagctagtgcgtgtgtgcacgtcgtgtgcgtggccaggtcgtaagccggcgcgccaagtctcctgcatgcatgcgtgctgcaacacaatgtcggcgactctgttggtcacatcgctcgtaacaccatgatgacgggtacggcgcatctgctgtgcgccgctcgggcaccacaccgagggtctttttattgcgaccgatggatttcgggctggcggacggggccggcccctcctctttctctctctctcgatgccattgtgcgctacgcatatgccgacctgggcctgatacggtgagaatacacatgctgcatttccctaattcaaaatttggatactaacaatgggaatagtccaaaatgtagcaaaataaacattctgctaattcaaaaacagatagagttgtgtattctttcttctttgtaaactgtagcaaggataattagacagagttcatggaattgtggctgttgtatattaagttaggatctctatttgtatggagtttgtggagtatgtagtctaattttttttgttgatgcttctg

SEQ ID NO: 669 - DNA, 2132 bp, Zea mays
agctagcatgttgcattatatctataccgaggaagatggtaactgtgttgttagcgataattgaaaatttaacattaagtttgttgcaatttcttatccccttgagtcatatgtgttggcaaactgttgtttatgtaatactgatgtattaccactgtttgatattttccattttgttctttcataggtgactttctccttactaagttccatttatttgcttcgttgttgaaataggttcgaatatggagtatggaatctgtgcataaggacaataccaacaatgattcgaagcaaaggttgcttgctacactgcgtgatcattttggatcagtgaactgtgtgagatgggccaagcatggccgctaccttgcttcaggatcagatgatcaggttatcctaattcacgagagaaaagctggctcaggtacatctgagtttggtagtggagaaccaccagatgcagagaactggaaggtcattatgaccttgagagggcatactgccgatgtggtaattatcttctaaaattccactgtgctgtgtttatgtttgtgataattattttgtaactatagaacaccttttccatttcttgtgcataaggtaggtagatcttagttggtcccctgatgattcaacgttggccagcggtagcttggataataccattcacatatggaacatgaacaacggcatttgcactgctgtcttgcgagggcacaccagcttagtgaaaggggttacctgggaccctattggttcctttattgcaagccaatcagatgataagactgttatgatatggcgtacaagtgactggagtcttgctcacaagacagaaggccattggacaaaatctgtatgtcgtatttttttatttctctgttagatctagctgtgatcaacctgtcttactgaatgcctttctcattttgtttgttcctgcagcttggttcaacattttttagacgacttgcttggtcaccttgtggccacttcataactaccactcatggtttccagaaacctaggcattcagcacctgtgcttgaaagaggcgagtgggctgcaacttttgactttctagggcataatgcgcctattgtggtagttaagtttaataactcaacgttccgtaagaatttctcaaatgaccaagacccaaaggctgcaccagttggatgggccaatggagcatcaaagacaccaacaaaagagcagcaaccatataatgttattgctattggaagtcaagatagaactattactgtttggacgacagcgagtgcccgtccactatttgttgctaggcattttttctctcaaagtgtggttgatttatcttggtatgagatgtcaattatttctctacaaccattattaacttgtatgctcaaactcatgttgatattgtttgtttcccttgcaggagccctgatggttattcactttttgcctgctccttggatggatcagctgcaaactttcactttgaagtgaaggagcttggacacaggttaagtgactctgaaatggatgaatggaagaggaacaggtatggtgatgttggaggacgacagtcaaatctagctgaaagccctgcacagttgctgctagagcaagcatcagcaaagcaatcagctggagaaaaggtgacttcaattgtcgagcaaggtaaagcacccccaaaagtttctgcaggtgtgcctaacccaggtcttgttgtgctaagtctcgaagttcctgaagtgtcacatgaagactctaagaagacagcaggtccaactgctgatgatgtaaaaaaaggcaaccagttatctagtccagtgaaacagagagaataccggcgccctgatggccggaaaagaataatcccagaggcagttggatttgcttccaaccaggataacatacccaaccattctcagaatcatcctgtgaatttttcatccctggatcaacgaatgaatggaacaaaaccatcttatggcagtaacagcaactctaataactgtggagttaaggatcgcactagtgtcacagcaagggcaaacataactgagagtcttgttattcaaaaagcttcagccggtgctggcaatgatggaaggctgagtatagaacacacc

SEQ ID NO: 670 - DNA, 2132 bp, Zea mays
atctctattatcatggccgattgtaaaaagatgcaagctagacacataaaggaatcataagaaacaacactgaaaaagtttcttgaacctatatatcatggtgatcgatgccaaaatttattaatggataatctgaacgcacaaaagtgaacaactattgattccactactcggctgcaaatagcccaacatatcaaaaactcatctgtcacgacactgagaagatttttacttgctaacgccatccatttggtctttcagggcatccatccttttgcccaaagcatttagttgtttgtggatgacataaacgtctaccttggagggagactgtcatgccacggcgacgctggcggggatggcgatggtgtccttgatggcgcacgtgttgggggcgtcggcggtggctggaatggcgcatgtcgtggcggtgtcgcttcatcttgttcgtgaaagaatctctcaagtagatccaaattcttaggtggttcatttatcatatgcttgaaatcattaccacatttctaaaaatgaaacaaacgtataattagaatatatataatctggattcaatcaaagagagacagagaatacccttgtttttttaatatgcatcttgcggcttttcgtctcccccatgtttgaagagtggatacgatgcagaacatggtcatcatacaactgtttcatacggttccatctgtttatgagtgttttatttgaaattgttattgttgtcaccttataaagtttttccgacaaatattccagagctgtatcatccaaggtggattgcctctgctttatgatgccgctgtcaagcaagtcgacgcagcccctgcagaacacagtgtctatatccggataccagggaacctactctcatcttgggtcatattttccatctacaaggaaaaagaaagaaatcacgaaaaaaacatatacatattagctagcacatttactggtaagagaggggtacgtacgtaagaaaactcacataaaactgcgggtcacgactgaggtgtgactgtctggaagcaaacttaagagcaatgataataagctataacagcagggattctttttagatctatcgcgctgaaggccatgcgaagtatattaatagaagccccgatggcaacatgcatggcacacatatgccactccgcttcctctccctaatttgttccgttcttatccaagcaaaaaacaacgatcgatcgagtcttgagatcgctcgcgcgggggaagcgtgcattgctggcgactggcgagtgtgtcgactgcatgcatgctccatctgtgtgcatgcaagggaaggatattaatagaagcccccggtggcaatatgcatggcacacgtacgccactctgcttcctgtccctaatttgttcggttcttaaccaagtgaacaacaacgatccatcgagtcttgagatcgctcgtgggggaagtgcgtgtcggtggtgactgtcgactgcgtcgactgcatgcatgctccatctgtgtgcatgcagccactggttgtttttatttacgtgagtttatttagcgctgatgctgcaaggaggccgcctagctagtgcgtgtgtgcacgtcgtgtgcgtggccaggtcgtaggccggtgcgccaagtctcctgcatgcatgcgcgctgcagcacaatgccggtggctccgttggtcgtgtcgctcataccgccatgatgacgggtccggcgcatctgctgcgcgccgctcgggcaccgcaccgagggtcttgtcattgcgaccgatggatttcgggctggcagacggggctagctcctcctcctctctctctctctctctcgatgccattgtgcgctgaacatatgccgacctgggcctgacgcggtgagaatacacatgctgcatttccctaattcaaaatttggatactaactgcgggaatagtccaagatgtagcagcataaacattctgctaattcaaaaaacagacatagttgtgtattctttcttctttgtaaactgtagcaaggataattagacagagtccgtggaattgtggctgttgtatattaagttaggatctctatttgtatggagtttgtggagtatgtagtctaattttttttgttgatgcttctg

SEQ ID NO: 671 - DNA, 2129 bp, Zea mays
accgatccaaaaatatacatgttgcactttaaacatttccaaagttacctcattcttcatatctacaaactctagtgccagcattcgaacatctaatatcttgggccccaaactcatgctataagttgtcttgcagttgggttgatgatcaagcatgtgaaacaacatgttggatagctcacgcaaataataaattgatgatctgaaaataatctacatgttatgcttcaatcgcttctagagtgacctcatctttcatatgaccaaatctagtgctagcatgcgacaatctagggtcgcatactcatgttatggttgccttgtacatggattaattatggtgcatgcaaaacaacaagttgggtccatccgcaaaagctgtctttctaaacaatacaatatttagggcatcaaaatgcttcgaagttgacgcacatcagaaatcgatatatcatgcattaaacttgcacaaaattaatacccattagtcccatactaatgttttgatgtgccctaaacttggattgatgtgttcacaactaaggaacattgcaaatagcattatatatgttttaaggtaacatgcctaaacaagtatgtattataatacgacatttagaaaagagtaatggaagtggaaatataatttttcttccattaactattttccattaatagaggtcgtaactctgcaaaatagttgatcttgaaaaatttgcatattgcaattcaaatacttttaaaattacatctttctttaaaacactgaactttaatcgacatgcgaccatttaattatgtgggtcccatactcatgttttgattgtgttgaattttagttgctggtggagcatgtgaaacaacatgttggatcattctataaatctaccacataatttagggcttcaaaaagtttcaaagttttcgcatggttcatgacataaccttttcgagaaaacatgcacgaaatcatgacccttcactcccaaatcagtgtattgcgaaaactttgatgagaaaccttgttgggtcgttttgtaaaaactaccattctaaacattacatcatttagggctttgaaccgcttcaaacttacattaatgtccataaccatgaaacatttgaaatctttccacatatcttatgagataacatgcccaaacaagtgatgtttacagtttggcaaagagcaaattgttatataattttccttggttaaattgttttgtaataaatatcatgagtcccatacttgttttttgagtggcctcaaaacatgcactgttgtccataaccaagaaatatataaaatagcactacatattgtttaagatagcatgcctaaactagtattgtttatagtctcgcatagagcaaattgtaattaaaattggaatgaaattttttctatatttaattcttttattataaattgatataaatgtaatagaataataacaaagaatcttaaaacatggatcaaaataaaagcagaattgcataaatattgctctcaattccagaaaattacaaactctagtgccagcattcgaacatccaatatcttgggcctcaaactcatgcgataggttgtctatgttttaaggtaacatgcctaaacaagtatgtcttacagtacgacatttggaaaagagtaataaaagtggaaatataatttttcttccattaactatttttcctttaatataggtcgtaactctgcaaaatcatttatcttgaaaaaactgcatattacaattcaaatacttttaaagttaccccattcttcaaaatactgaactttaatcggcatgtgaccatctaattatgtgggtcccacactcaagttttgattgtgttgaattttagttgctggtggagcgtgtgaaacaacattttggatcattctataaatctaccacataatttagggcttcaaaaagcttcaaagtttttgcatggttcatgccacaatcttttcaagaaaacatgcacgaaatcatgaccatttactcccaaatcattgtattgcaaaaactttgatgacaaaccttgttgggtcgtttttgtaaaaactttcattctaaacattacatcatctgtctcttatacacatctgacgctgccga

SEQ ID NO: 672 - DNA, 2128 bp, Zea mays
tgaccatggaatcatgtattctaaccgcagatcaaatatctcgtgcttcgaatcgaatcaaaccgtgtcacaaatactatcgaccctttgattatcgctacaaatcgtgactcaaaatatcagcgattttctttataaaaaaagagaaaagagaaaaaaataaaaatatctcccagccgtcttctactctatgttctccaccgctcacgttatcaaattttctttcactgtgttggccgtcggcctcatccctggccgttcttatctactggctaccactgccttctttgatattccccaccgtgtacagctaatgactttatccggttatcccaacgtgagctcatcttctctccatcccctgcctttatcttctcctgccgtcctctgtttggtgattttccagcgggcccagtccagctcgttccccatggtggccgcgttcgcctctccctggcgcgctctacacccatcgccgtgcaccccttgctcctccagctcggcgcccatctccatggctcgccctgcgcccagccgccgcccctgtgtacttctctgctcatcggaatccctttgccgttgccatggcagccgtccagccgagctcaacccctgcccatctccctggtcgtgacccccctcagcttcttctccgtggaactcgcctctgcgcctggctcctgctcatcgaatctccagcgatgtcgtcgccttgctgctcgccagcgtcttctctgcccctacgcatccatggcgatttcccttgcggcagcttcctcgatgcgcagcctccctcccagcttggcctcttccccgtgccggcttcgagcttccacggccgcaccaaattccccatgcgtgctgccgtccgctgctcgaagcttccatgtcgcgcgtcgtgcttctctgctagccatggtggcgcgctctgctctccattttctttgtttgccacgcgcacgaattttatctgcttgccacagtgtgtcgagctcccgcaccatcatcgcttctgtcgcaagctcgttagccacaattatcttgaccgcatcagcatgtgaccgtggtcgtgttcgtcaggttcgacaacacgttgttgcctattcgactgtcgtcgcggttgtgtgcctcgctgcgtgctcgccgagtgttgttggttgtacctcagcactcgtgcttgccgttggctcgcgttaacgctcgcgtgtctgctcattgtcactgcgggcactcactctcctctatcgggttttgcgtgtgctcgcgtttgccatcaagtcatcgaacccgtcatccccttctcgaccccaccccaccagctcgctccaaacatgatctcgtcgtcattcgtgcatctcctagaaatcccaagcgtcgggtgaagacgaagaccagcagcgtggtgttcaccaagtgcgcgacaaaaagctcagacatcctgcacgactcaagttcggttcgtcataattattcagtcgaggaaaagatcttcagaaattgattatcgaagaaaagaaggcctctggataacgtcaaccgaaacccgtagtcgtgtttgcgactatcgcgtcgaattatttagggtaagtaaatttgttactcgtgttagtggattggtggatggtttgactaggtttaatatttattgttttcctgagtcgttttagtaatttggtcgatgtcgtaagatgaaaaagatctcaataggtcttagtggttgtgggactatatgtgttaaaaatgaaaagttttattaatatataaggtacacagtttaaagagttaataaaaagctaggaataaaaatagatgttctagtgttattatgtcaatttggttaatagatggtgcttaatggtgcttaatgcttgattttaagagtttcatcctttttagtatagactatctatcttatactcgttatactcgtgctcatacatgtgcatcgtgcatctcatgaggtacgataattaatcgcgtgatgtggaagaaaagccaagtcgaccccaagcgcgggctaattcgcaggatgatgctgatggattaacctaaagatggataatcagaacaatgcgaagacaaaggatggtcgtcaagtggacgccatctaacaacactaacctagtgt

SEQ ID NO: 673 - DNA, 2128 bp, Zea mays
atagcttctctacagaaaacatgattttgttcatcaaacatttaacacgaggacatcactgcgtgcagtccaaaacagcaactaataattttcagcttctatttacttcaaaaattaccctgtcctggcgactagaattactctaacactttacgtttgttagagttaaaacaatcaaattaggatcaacaagtcgacttactaattttatccaagttatttcgggcgctagaagtaccatacttaattaacaacgtgttctccccgataatcaatatcgaagcgcttttcacccaatattttgcatcttagcttagacaccacatgagcactactaatttttatccgtgtcatttagtgcactaaaattaccatcaacattcaacaaacacattcaccacgtaaatagcatcatcacacatgacctcaacttaaccgcagaggaagtgatgactacttcggcatgtcaccacctctctacagtccactcaatattaactacatcgatcgaacctcatattgcgcaactcttataatttactatcccaaatacaaccatagcacaggatgcacttgagactctttgttcaagttaacgcaatcactactacaacgcatttcggcacacatgtttgataacacatctttctaaattaatctatctcatcttccaaacaccaattttatgtcacgaaatttacattttcacctaatttaacctacaccaacgatgaacacataaatataattatcctagactgactcactagccgagtgcagaagtcaccaagcatgctttaggatttaccaaatttttgccgcactaacacattaatgtacgatgaagcatgttagcaaaccattaacacattcgcgaccaatccctacgacgccccaaggaactatcgcagccacatatctatccaatccaacaacaaaataacacctcggctcacccacgcacctacgtgtccccataatacgcacaaggcatcaaccgtacaagtgactccaacaggattactcatactcctcattcgcctcgacaatcccaatcaccgatcactcgcataaaacaattacacttttcacataaacacctatcgatgcatctcccaaaacataatccgcattttgtaacttagtttttcgcatcaaacaacgcatcacatatttttcctaccaagatataaaaacatccgagttcttgttctacttcattttcttctatatacgcatgcattcatacaattataatttcacgcacatattcacacatgcacatcatcgaccaaatacgtaaataaaacaaatcgcgaatcattcaaggcgaacaacctggccgaaatccgatcggagttgcacatgcatgccatcagattgggctctttgccgacgagcgacgcgcgaggcgtgacgacgacacgggctgcgagcacgacacagtttataacacgatttgttggtgcggccattcaatcgaacacgaaaagcgcaggactgcggggtctcaccacgggtttcaacgacggcacgccggcgctgtgtagacccgacgaagcgagacgaggagacggtcgaaccgcgcagatcaacgacgcagcatggggctggccaaacacccacgcgacgctttgggccaggactgcgcaactccatgtcggcgtacagaaatccggagcatgctgctgcggagagggagtcgagcagaggcgctgcgcggggcaccggccatggagaggctcaccattggagttgaggggaggggggcctcctgctggttttacatggaagaaaatggggttcagggaacaacagggggaggggcgttgagcgctgtggagaagaagggcgcaactccctgcacttgagctcaagggaaatagagaggagggagggtactgggcagaggatatgagctgggtgcagggagggataaactgggctccctgctgaccgccgtggaaaccagtgaggaagaaggggcgcgctggccatggagcagaggcgtcgctgggggaaacaccggcctgtgacttgaagtcgcggccgcactgaccctatagtgagtcgtattaatttaaatcataccaacatggtcaaataaaacgaaaggctcagtcgaaag

SEQ ID NO: 674 - DNA, 2127 bp, Zea mays
caaactaccagccgtcttcctccttatcctcgccgccccctacccctgataatctctaccccgccctcgccttcagatttttccaccgccgcccatggggatcgattttatcctacgtcgtgtgcccatctcctctcctcccagcgtcgcgccccctttcctctgctctctcggtgcccacacggagctctctccagctcggtcgcgctcgcccagctctccacgccatcggagctccccgtgctgtgcgtccctctccccaagctccctcgcggcggccttcccctgccggtcctcggccccaatgcccagccatgcttctctccctctcggcctggcctgactatcggtctttctctgtgccgatcacttcaccctgttcttccatggccgcaccaaattccctgcacgcgttggcttccagctcggccgtccatctccctgtgcccgagctcgtccatggctgtgcgcccatcccccatggtcgtgtccgccaggacatccgctcgccctgcgcgcgcgttcttccctcaccatggacgctgctctttcttcctgctgtacgcgtgcgacatctccaactcggcatcgcctgctccagcttgcgaagctcccagcgcgcattcgcgttcatctgctcggtcctctggtgcccaaccgcttttccctctgctctgtccaaaccgtgactcctgccgtggagtttccaggccgtcccagcccagagctccctggtcgtggtcgtcgcgtgcctacgcgcagctcgcgccctgctcgcccctctgctcgtcgagcttgtccgtccgtgccgtaccctgttccctgtgcgcggcagtgccctctgctcggattttgcttggtcacccgctgttccccacgcgcgcccatttccctgctgttgcgtcgaacagagtttcctgcttgttagcacgccctctcgtccttaatccccttcgtgtcgtcaacctcgctggttgtcgtcgttgtcgtcgtgtcgtgtgtgctcgtccttgccaagatttggccctgcgagttccacgcgccccggctgcgcgtcaccgtgatgttaccgttttgctgagtccttccccaatctgcaccataaaattcgctcggccatggtctcgtcaaactgtgaagcttcctcgccgtgcgctctggcatcggttgtcgctgattccgccataaagttcacgagcgctccttgctcagtttgtttcgcagtgggcaatttctccacgtttcaattctgtgttgcttgccccgtgtgcgctcgctcctcatccatcgggtttcagcgtgctcgcgtttaccgtcgagtcgtcgaacacgtcatcctctgcttgacccccacctcgccagctcgccccaaactcgatctcgtcgtcgttcatgcatccccaagaaatcccaagaatcaggtgacgacgaagctagctgggtgatattcaccaagtgctcgacaaaagctcgaacaagtcatcgatcgtcatcctcgtctacgccaagatccgagaagattaggcgcagaaggaaataaatcagtacaggccgaagaattctcgatgtggacaaagaagaagcgcgattcgacgcagcactcaccctattttcggtgaaatgctgagctgaaaggcgtcatcaatttcgtggtttcaagtctgatgtcataagggtaagttgattcgtattcgagtcaactaggtctataaatagattaaatagaattgttggtcacaataaatgttattaatttagcatgcgtatattgtgttgatcaatttagataaatcatgtaattaagatacacagtttaaagagttaataaaaagctaggaataaaaatagattttctattattatatgtcaatttggttaatggatgaagtcgatgccctgcttaattagtcagcttattctaggtttggtgtttaattcgctgtcgtataagtattctttaggtttgcgatattcctccttatatgcatacatgtgcattatgcatatcattcaggtacgttaattaatcacgtgatgcggaagacgacccaagtcgaccccaagcgcgggttactccgcatggtgatattgatggacgaacctgtctgatcaagtgctaggacaagg

SEQ ID NO: 675 - DNA, 2127 bp, Zea mays
ccgcgacaacttgtccacggtggctccgacgggaggcgctcgcccaccaccgttttggcatcttccccgacatggatccagcgcctccatatcgatgtcttcctcaaatgctcagatctgccccctccaccacctctagcctcacgccgcgctttgacagctttcccgcctcggatccagacgccccgccaccaagcctatgtactgtttctcggtatattgtaattgggtcagccttgatgtgattcgctaaccctgtgaaaactgtgcatatctagaaattgaagaggcagaggttgatctgcatgtggcgttggtggatgatctattttcattcgcttgcaataaaggaattggtttgcttatatttttctctcatttccagcatgaaatttgctactatgcgatgtcactggggaacatcttttctatcttccttttgttctgggatgtatgacttttccctattcagaatgtttttatcattatggaatgtaggcagtatctgctcattctcttgtacatttttgctattgcttgatacttgatagaccatttcactacagtttgttaggacaactcaactgttttaggcatgtgcaaggaaagtaatggagatgctaactgcatgttctgatgcattgatggattagtcctttatcctccactttgtgtgatatatgcctttataattccactcgttatgtgctgctttttcatccttcaaatttggcagcaacaaatgcttctcggtcctcactgcgtagatagtggtacttcagattggtagagcatcggttaatctagggaatatttattccacatttatgacctgccattttcgcaaaagattaaattgttatggggaagtcggctatatatttcttctctgttatcttaaatatcatgtgcttctcatacaaatcaactatgtattttcctctcctcttccttgtgttttatcctaccttgctctaagcttcaccatacactgaattctcttgagtcttaaccagaattgtttcattgttctttttatcaaaaccatatactggcgatgcagcagtaggctcgtttataataggcagaacttccatcctgtaagtattgtgacaccaacaacgaactcaaattggtccatctctaatgatgtactcaccatgtgtaattcattatccaaaagtagttcgtgacatgcaattttattttgtttccatcactattcactggaccttttcatttacctcatgttttatgggtgatttggataaacatgagtatatccttcaggtttacatattttcttagaaaacgatgacatagtcattagagtgagggaaaatatgttgcatatttatagcttctaaaaccatttttaaatgtgtgaacatgatgtcatgttatttcctgaaattgtttatctttacatatttatagctactaatagcatttttaaatatgtgaactcggatatcatgctatttcctaaaattgtttgcctttatgtaactacctcgccttctgtttcctgaaaaactaaaacaattcaaattggtttcagacaatttttggcttagtttgactgtatttgcttccattagggaaaaaccatcataatgattgtgacgtggcttaatgattttcctccaaattgtcgtagctgatgaatcacattttatgaagaatggacaagcaaagaaacggttgcttcacttctattttgcaggtttggtgcttcttatgaggaaaacacattttctttgtgagtataaatattatatgccaaattcttttcgaagagaacacactaaattctacttaatgattaccttctcatattagataaacaccttctaatgtctatgcattgttttttgattcatgaactttttttgttctttcttgcagctatgaaggccggtatttgaggtcatttcatgcaactaatgattttggtgaagactgtccaaccttaggatatagcaggcatcaattagacgtatctatcatgatcctttcatagtttaacgagtattatgtttttctgtaaatcatagaaatgtttatttttttaacgcatagaaaatcaatgacaaagatgtagagtttttatgaaagtaaaaatgg

SEQ ID NO: 676 - DNA, 2126 bp, Zea mays
taatccaatcacacttgatttatacattcagtaatacactcctagcaaaatatgcatttaaacctaagctttacacgacacaattatttgttaatcacgaacacagttgcaacaatacatgtaacaaggcattttatcaaacatataataaaaccacaacgtgcctatgctacagataagatatccgtcgcataatttttttatcaaaagtctagaccttaacccctgacccgactactttataattctaaaaataattatatcaccacgggcacaccgacacaacaacgtatctaaacataatcactaagagtacttggtgaatttcatgctgctagcttcgtcttcactcaactcttgggatttcttgatgatgcacggaacgacgacgagatcgagtctggagcgagctggtgaggtgtggtcgagcaggttagtgtgagctctggcgaggacacgaatccagtgagtactccgacatcggcaaggtcacgagctctagcgacatagggtcaagtggcgaatgcgttcggcgtgcatacgtgagccgaaccaaaagcgaggaaccgatgaagcgaagttcgtcgacaagcaccatggaggaatcagcgacgttgttgcacacacgacgcgatgacgaacaacgacaaccggcatggagacctaacgcgattgaggaaggggttcgacgattcgtcgacaccggcgaggtcaacgacgagccgaccaaacaaaactccacgatgtcgacaggcacacggaccagagaacggcggctggcgaaatccaagctggggaaaatggcgcgcgaccatggcaaactggagcaggggccagggacgcggcggccttggcgagcctgaggctgaaggagggtgccgacgctaccgagcagggatgcaaggtccgagcataggggcgagctcggggtggccggtgaaccacgcgtgcaccagagaagagctcgcaccggagcggccaatggcgcagagggcagagcacagccagaagaacatatgaagctcacatcggcgtctggcaagcacacgccatggatggaggatgagggcaaggagaatgagagctgagtgaggcaagcgtccaggcgctagctgggagcaacgttccgcgagagagaatgacaaggtgagagagagagtgtccaagaagaaccgagaggcaaagaagatacgactggcacacttgtgcgttgcaaaaatatcaactaccggatacgaacaaagatctggtatccacgtatgaagaaaaaaatatcaatgcatatcaactttgggagatgaggataggagatattttcttttttttcaacaccgttatatgtatgagaacaaatatttggacacaatttgatttgatgactactccgaagtcagataaattcgtacccattatttttatttgaagatttagatcgagacaagaaacacacagactgaaccaaactgattttggcttcgatattttagactatatttaatccagtcaaatttttatgagtctcacgtgctttcgatcatttgactacagaacgattcgattaatgagctggcgtattgtttttatcaagaaacacgtaaacagccagatccaaaataataccggcttcactacttcagatgatatttgatgcagctgaaatcggacaaatatttatctgccatttgaacctgttttatttctgtgtcgaggataatttgttggaaaccgaccatgattataattcctcagacacgatgtctcgcttgacgagaggggactaaattatttggccctgaaaactttagtcgtcgacttctaataaatctcgtttcggacaaagtcggcggaataaactaagtttctaaattcggcacgagcgacgaattttaaatgatcaccaggctcgccgatttttggaacaattatgttccgaacatcacgaaaatttaggacgagcccggatagataaaaataaaaacgatgtcaaactcgcgactcacaaaaacagattaaatcagagatactgttattcaccgctatcacgtgttaaagtccgcactcgtggtcgagcagacgataaacacctagggtgttacaaccacccttccatgggagggtatagattt

SEQ ID NO: 677 - DNA, 2170 bp, Zea mays
tgtaacacctcaggtgtttatattcttctcgacaacaagtatggatttaagcacgtaatatcagtggataaaacgaatgctaaattttaaccatcttcgtctatcacaattttaatatcgcatctgtttcgtctgtcgcgagttcgacatcgtttttatctatccgggctcttgctaaattttcgtgatgttcggaacatagttgttccgaaaattggtgcatccagtgattatttaaaactcatcgctcgcgtgaatacgaattggaatctcgacccactcgaatgattttatcccgaacaaattaatttgaacttgacgactaaaatgttcggggcaaaataatctgaatcgcgcattgtatgagaaaaatcatgcgcgagattgctaaacaaggaattataattgagatttaattctccaataaatcatctatggcagagtgatcagctgttcgagtggcagacgaagttatctgatttcatgtcgtatcaaatatagtttaaaatatcagtctcaatctcatttgggttcattctatttgctccctatccgaacccgatattatccgagacaaagagattaacgtttgattttatagcagataatactgggtccgaaagaatactccggatcgcttgcattaccaagcaacagtgcacaagattaacaattgggattattcaatagtgtgctattctaggtagagaaatcaaatcgatttggaaaacggataaatttttatctgagttcaactaaattaatagagtctcaagtaccgtatccggatagtgttttggtccttgtgtttctcggacagatccaaaacttcggatataaataacaggtgaaaattcatctaattccgagagtattcatcaaatcaaatcaaatctaaatattgttgtcggtctcatttttgtttgagccttttgtatattttttagactctaatttcataccctaaaatatgtgtattttattgttttaaaaaaagaaggaaaaatagggaaaatccttctctaaatatttccaccgtttcttagtatgattttcaacgtatttggatttttcactatagaaaatatctctctatcgttgttttctcgttgttttcttctcatgtacgtaaacttcctagaatatcattggccgtcatcgatattttctttgccagcaatcgtattcgatgcattttttccttgtcttcgtcgtcgcttaagtgggtaaccggtagaatatcttcttctacgtgcgcatactctcccagccttatcttcttctgcagattttttttactcatcattatatctcctctccacacggcagcaggcgctcattctcacatcttcctcctgcagccgcgccctagtcccggacatcccagcgctgtcccatctcctctctcccagtcgactctctgctcttccatggctgcttgctccactgcgcagcctctcagctcctcgacctcccctcgactttctccagccgccggtgctcgccaagtcaatctcccatgggagccggtcagccctgctctccatcgcaagccacgctcctccatcgcgtcgttcctccgctcgcccacctcgtccatggctgtcgtgccgagttcgccctgcgcgcagcttgcgtttctccctgacgcgctcgcacagccatctcccatggcgcgcgcctcccctgcacgtccgtctccctgctccaccttcctgtcgcgcctctctccgtcgaagctccctgctgctcgccatggcgtcttccagtctctggctcgccctactcccagttgccgcgagctctagctcggattcagcccagctcgaatcttttccatggtcgctgcgcactggccctgctcggattctcgtcgtgcgtacttgggcgctgccccagtggccgactgctccaatcgtcgggcccagccgagttcacccctgcgcgcaaccgtggtttcgctgcgcagcgttcctgctcccggcctccgtcgtgctcggcagcaagtaattcatgtcgaagcagcagctgcgatcccttgcgtcgtgctcgccagatcgagtctcgcgtcgtcgatctacgcagttcctgttcacctatcggttccgcctacgtcgatctcctaatttccatggatcgtgtatcgacatcccattacaacagcccatcg

SEQ ID NO: 678 - DNA, 2124 bp, Zea mays
atctctattatcatggccgattgtaaaaagatgcaagctagacacataaaggaatcataagaaacaacactgaaaaagtcccttgaacctatatatcatggtgatcgatgacaaaatttattaatggataatctgaacacacaaaagtgaaaaattattgattccactactcggctgcaaatagcccaacatatcaaaaactcatctgtcacgacactgagaaaattttgacttgctaacgccatccatttggtctttcagggcatccatccttttgccaaagcgtttagttgtttttggatgacataaacgtctaccttggagggagacatgtcatgccacagcgacgctggcggggacagtgatggtgtccttgatagcgcacgtgttgggggcgtcggaggtggctggaatggcgcatgtcgtggcggtgtcgcttcatcttgttcgtgaaacaatctctcaagtagatccaaattcttaggcggttcatttatcatatgcttgaaatcattgccacatttataaaaatgaaacaaatgtataattagaatatatataatctagattcaatcaaagagagacagagaatacctttgtttttttaatatgcatcttgcggcttttcgtctcccccatgtttgaagagtggatacgatgcagaacatggtcatcatacaactgtttcatacggttccatctattaatgagtgttttatttgaaattgttattgttgtcaccttataaagtttttccgacaaatattccacagttgtatcttccaaggtggattgcctctgctttatgatgccgctgtcaagcaagtcgacatagcccctacagaacacagtgtctatatccggataccagcagaacctaccctcatcttgggtcatattttccatctacaagaaaaaaatgaaagaaatcacaaaaaaacatatacatagacatataagctagcacatttactggtaagagaggggtacgtacgtaagaaaactcacataaaactgctggtcacgactgaggtgtgactgtctggaagcaaacttaagcgcaatgataataagctataacaacagggattctttttagatctatcacgctaaaggtcatgggaagtatattaatagaagcccccggtggcaatatgcatggcacacgtacgccacttcgcttcctctccctaatttgtttctttcttatccaagcgaacaacaacgatcgatcgagacttgagatcgctcgcgtgggggaagcgtgcgtcgctggtgactggcgagtgcgtcgactgcatgcatgctccatctgtgtgcatgcaagggaagtatattaatagaagcccccggtggcaatatgcatggcacacatacgccactctgctttcagtccctaatttgttcggttcttatccaagcgaacaacaaggatcaatcgagtcttgagatcgctcgttggggaagtgcatgtcggtggcgactgtcgactgcgtcgactgcatgcatgcagccgctggttgtttttatttacgtgagtttgtttagcgccgatgctgcaaggaggcagcctagctagtgcgtgtgtgcacgtcgtgtgcgtggccaggtcgtaagccggcgcgccaagtctcctgcatgcatgcgcgctgcagcacaatgctggcggctctgttggtcgcgtcgctcgtaccgccatgatgaagggtccggtgcatctactgcgcgccgctcgggcaccgcaccgagggtcttgtcattgcgaccgatggatttcgggctggcgaacggggtcggcccctcctatctctctctctctctctcgatgccattgtgcactacgcatatgccgacctgggcctgacgcggtgagaatacacatgctgcatttccctaattcaaaatttggatactaactgcgggaatagtccaaggtgtagcaacataaacattctgctaattcaaaaacagacagagttgtgtattctttcttctttgtaaactgtagcaaggataattagacagagttcgtggaattgtggctgttttatattaagttaggatctctatttgtatggagtttgtggagtatgtagtctaatttattttttgttgatgcttctg

SEQ ID NO: 679 - DNA, 2124 bp, Zea mays
cttcgattgaagtcttcaaccgagcacttgataagcgatgcacacggacctcgtttatgtttgcctaatgtccgggattcggggttcgacgagatcgagcagggaagaacgaggttcgacgggcttgacgatgaacgacgataaccggtgaggtcaatgacgcgatggggattaaggccaagcgagccgagaggacgcgctggcgagcgggaaaccgcgcgagcactggacagggaaaacgacgatgctgtcgcacacagtgcgaaggcgaacgacgcgacgatgaggacctagtgacctaggatgtgcgagtcagcgtgtcgtgcgaccgagcgatgacgacgaacagccgagtgcggtaagcagctggagaatgacgacgggccaagcagaggagctcgcgagctgtgatattcggacttggcgacatcagcgagcaggcgattcgacggcgagcagagagcttcgagcgcacaaaaagcagagcgcgcagaggagctaagcgcggtccgagcagggagctccacggcgcggcatgggcggaccagggagggagaagaagagggtctaggcacacggctggaagaggggcgccgtggaggagctgctcgaccgggggatgtgcggccgacagagatctgagctggggctggacgccggcaggggaagggacgagcacagggaaccgcgagaaggagagatgggcgttctgacgaggaagctccatggcgaggtccgagcagaacgcaggcgcgcagggacgagcgggtgtcaggcgcgcgcggggaaatgaccagggagaggagagatccgcgcgcgcagagagctctgctgggcgctcagccatggcgagcagagaaacaggagggagagaagcaagggggcagctgggaacttggccgggcgcggttggagaaaggcagtgccgagcggacgccatgggagagcttcagcagggtgcggcgagctgaaggggagagggcagggaaggagcggccggcgctgggggagatgggcgccgatcagggaacctgcgtacaacacctagaagaagcagtctgcgcgcaggagataaaaagcttgcgcgtggaaaaaatcaagcgattgagcggcggtggataggaacgcagagaagattttcctcccgtgcgcggatgagaacgaagactggagaaaaatttgcttagcgtacgtgaggagataaggagagagagcactgtcagatgatttttcttgattttttttctattttccctttcttatttttttaagagatttgcagatattttaggtcacgatttatagcgataaataaagtgtcaatatgctatacgactatatatattatttttctcggattttgaaacaggaaaccgaattggccaacaacagttccggattcagtttatttgaacagcctgccccagacagcgcatttaccgaatttatagagattgcccaaaccaagcgaaatacttaagcgaaaatcttagttcatcttgaccaattaattttaaactagcactagactcgacactttagaaagaaataaattttaaaccgtgcaagccgaatgcgacatcgcaatcggaattccccggagacgatgtcagcatcgtcacgggagcgagctgtagacgggttcaaaccggacgagatcagattcaatattttagtcgacatttgatttagttgaacctaaacgaatttcgccgttatctgaatattcaatcggagaacaactcaagcaataatcccgcgcctggtttttcttggattccgagtgtggtccgatttaattttgcattaacacttctgtcgtcgagttcaaattaatttgttccgggtaaaattatccgagtggatcgagcctccgaattcgtattcgcgcgagcgatgaattttaaataatcaccaaacacacagattttcggaacgactatgttccgaacaacacgaaaatttcggaagagcccggatagataaaaatgatgtcgaactcgcgacagacgaaacagatgcaatactaaaatcgcgatatatgaagatgattaaattttagcatctgttttatccactgatattacgtacttaaatccatactcgttgtcgagcggaatatag

SEQ ID NO: 680 - DNA, 2123 bp, Zea mays
attatcatggccgattgtaaaaagatgcaagctagacacaaaggaatcataagaaacaaaactgaaaaagttccttgaacctatatatcatggtgatcgatgacaaaaattattaatggataatctgaacacacaaaagtgaataattattgattccactactcggctgcaaatagcctaacatatcaaaaactcatctgtcacgacattgagaagattttgacttggtaacgccatccatttggtctttcagggcatccatccttgtgcccaaagcatttagttgtttgtggatgacataaacgtctaccttggagggagacatgtcatgccacggcgacactggaggggacggcgatggtgtccttgatggcgcacgtgttcggggcgtcggcggtggctggaatggcgcatgtcatggcggtgtcgcttcatcttgttcgtgaaacaatctctcaagtagatccaaattcttaggtggttcatttatcatatgcttgaaatcattgccacatttctaaaaatgaaacaaacgtataattagaatatatataatctggattcaatcaaagagagacagagaatacccttgtttttttaatatgcatcttgcggcttttcgtctcccccatgtttgaagagtggatacgatgcagaacattgtcatcatacaactgtttcattcggttccatctgtttatgagtgttttatttgaaattgttattgttgtcaccttataaagttttccgacaaatattccagagctgtatcatccaaggtggattgcctctgctttatgatgtcgctgtcaagcaagtcgacgcagcccctgcagaacacagtgtctatatccggataccagcggaacctaccctcatcttgggtcatatttttcatctacaagaaaaaatgaaagaaaccacaaaaaaacatatatatatatatacatataagctagcacatttactagtaagagaggggtacgtacgtaagaaaactcacataaaactgcgggtcacgactgaggtgtgactgtctggaagcaaacttaagcgcaatgataataagctataacagcagggattctttttagatctatcgcactgaaggccttgagaagtatattaatagaagcccccggtggcaatatgcatggcacaagtacgccacaccacttcctctacttaatttgttccgttcttatccaaacgaacaacaacgatcgatcgagtcttgagatcgctcgcgcgggggaagcgtgcgtcgctggcgacgggcgagtgcatcgactgcatgcatgctccatctgtgtgcatgcaagggaagtatattaatagaagctcccggtggcaatatgcatggcacacgtatgccactttgctttctgtccctaatttgtttggttcttatccaagtgaacaacaacgatccatcgagtcttgagattgctcgtgggggaagtgcgcgtcggtggcgactgtcgactgcgtcgacttcatgcattctccatctgtgtgcatgcagctgctggttgtttttatttacgtgagtttgtttagcgctgatgctgcaaggaggccgcctagctagtgcgtgtgtgcacgtcgtgtgcgtggccaggtcgtaagccggcgcgccaagtctcctgcatgcatgcgtgctgcagcacaatgccggcggctctgttggtcgcatcgctcgtaccgccatgatgtcgggtccggcccatctgctgtgcgccgctcgggcaccgcaccaagggtctttttattgcgatagatggatttcgggctggcggatggggccggcccctcctctctctctctctctcgatgccattgtgcgctacgcatatgtcgacctgggcctgacccggtgagaatacacatgctgcatttccctaattcaaaatttggatactaactgcgggaatagtccaaaatgtagcaaaataaacattctgctaattcaaaaacagatagagttgtgtattctttcttctttgtaaactatagaaaggataattagacggagttcatggaattgtggttgttgtatattaagttaggatctctatttgtatggagtttgtggagtatgtagtctaatttttttgttgatg

SEQ ID NO: 681 - DNA, 2123 bp, Zea mays
actcttgaaataaatgacatccagtttacagcaggtaaatagtttacagtttacagtagtttatagtttagtttcagactcttgtatttttaaggaaggcgccacttgttgttctgatcatgatgtgtggaccaaactttcttgaacctaagtctgagtcggtcttccaaatctaggggtacctgtccaagttacttagtctaagtcaaaattcctgactagacctaggttagtttctcttctcttttgatgttttagccatcaatgtacctgggatcgatcttccagggttctgttttatcaagatttgtaactcaaccttcctgggatcgatcttctataaagtttagaacctgaaaggattggtgctctatgttggatggaagcatagcctcaaatctgtacactagaaagaatgaggtctggctcgtagtagaactcagagacattcgaagcctcaaatcgttgtttgacccatcttcctgcataaggatgtgtcacagtgatgtgaagtccaaaaaggaatgtaaagtgattggtgagctacatctatccttttatcgcacctttccaaatttgctgttgtttttgcaagagatatgcagcttctggcccttgggaggactgtcaaatgcccatgcaaaggcttcatcccattcagatgttgcaccagtcgagacaatctatgatttaggccacgtaagtttaggtcagcaacactccatgcaataaaattaggaatgtcccaaaccaatagtcaaagaagcatgccaataaaagctaatgcaagctgttgcaagcaaagtctcagaacgaggataatggatagagaaggaccgatatccctagattgttggtgtacctttgtcagccttggcggattgtttccaagagtaagcttgcagaaggcactagggtttccgactgattgctttagattgttgccacgttttatcgtaacagtaagagtcacaagcaagcactgaagaagcaattctgccttttcttgaaatcgtggtgggccagactgtatcaagtactgaagtagaggaatagcctctgatgcagcgactgattgtgctttaaacacttcagctgaccaagcttgcctgagaagatatagtgaatctagtgctgcctcttgagttgcctcagaaccagttttaagggatgttacaagatgaggaatgcacaatgtggcaggttcagtgaccctcagacgagggaagttactcagcaaagcattaagtgctttgagatactcttcgttagcacttccagaagcccatatatccttttaaatagaagctgcatgaaaaatgtaagcattaaatgtataaaaactgggtatgatcgtaaacatatacatattccagctggctaggagaaataactaaactaagatagatggcctcttgggctataaacattcacacgtgaatgctgatgccggattattttcttttatctaaaaaaagatggcctcctttcacatactgtacacaaaatgtttgattagaactcacaaagtacacgtgaacttcacaaacgtgactcgattcatgtatttgctagacattacatagaaattccataaatctcatatatactaaaggtggatattgacatctttagcaagacaggcattgataacaatgaatttgctatgcaaaatgaacatgacagaacaagaaagggatattgtttaccagttataactctgactgtttcactggtcgcatactcttggatagtgtggttattgaatagaagtttgacaaacattgctgtctgaacagaaatgtcaggattgcttgaactgataagatccagcaggacctgaacaccaccgaattctgcaattgctctcttatttgctcggctgtacatgactagattctgtaaggcacatattgctaccactttcatctcttcagttggttgattttcaagaagattgactagagcgcggcatgctgcaacagcatcaatagaacgagcaagaccttcgttttggaaaagatctccaagagcaagagcagcaagcaatcttccctgttgagattgtgtctgtggatccagaaggtacatgcttgattcgaagcaagagcagcaacaacatc

SEQ ID NO: 682 - DNA, 2120 bp, Zea mays
ggacagaaatattggtgcataccttcatcatgacgacagaaatctagatgtgtagtatacaagaggtcggtcactgtccagtcgctgctgcagaaccatggtttttaaagcggtaaggcggtccaaggcgttggaccaccgcctagacgccttaaaaacagtgtgcagaactgaaggcagcgattttctacttgggcacttcccaactgtaaggtgacgaagagatgagtattcctgtggtcctgcccgcgcgcagggcaaggatgccaggctttcgcaaccacgcagatcgaggctttccagtgatgggagatctacgatgcatgtttctagtgatcgcaactccgggcagtcgacaattagtaagttattcagtgcatccagctgccctgacatgaatcgtagtttggagcaatttcgaatatctattttcctgagggacgagggaagattgacaacctctgacaacccgtgacagtcccatatccttagagattctagagatgacaacaacccgtgacagtcccatattgctagagatgatggaaggagcttatccgatggtgacagcttctcctcaacaggtgcggatgccatcacggcatcgctactactggcctcttcattcaactgttgctttccgtatagggactcaagcttaggacatcctatcacatccatcctcttgagaacaggggaggaattgaatacctctgctagacattgacacccctcaatcagcagagactctagatggggcaaaagctggctccttcctgaagttgcctggtcaggaccattcgccgttgcgtatccaattaggttattgcacccggcaatccgtagcctccgcaaagaaatcaaactttggaatgctttctccggccagtagacaagatcatcacatccggtaatttccagatcttgcagctgcccaaagcaaacccaccacagtgctagtgcacgtggttggaagaacaaaatgcagctccatagttgcatacttaccacagacggaggctggtcccatctctccttaccatcctccagcttgacaccctccaaaaacaaagtggacaatgaagtcacacatttgatccctccaagagagatttgttcatttgattcacgcaagaccagttctttgagcttcggtgcccaaggtagagttgttaactttgggcatttcctgataacaacaacctcaaccacaggaaatagtgcatgtccttcaatttcaggggcagcctcccatctctcaaagatacacaaatcttccaatatgagcctcttcagttctggaaatgctgagcgggccactgtataatctccactgcaatatgcttctcccagcaccgatgcatctggtagagctactagatttccacaacccttaatgttcaatttctcaagccgaggaaatgctactgcacctccatccactgcctcacaaattccttcaaaaacgtcaagaccaactagcttaagatccttaagctttccaaatgtagacgatgtacagctgctacacaagaaccgcaaatttcccaatcttttcaaatgaaggagttgcagttctgctagctgacacagtggtggaagctgctctgctttcctacaattggacaaccgaagctcgaccatgtttttcaacatacccaaccaagacggaaaactggtgcctttgtagtaatatatttctagggccagcaatccatcatgagtttcaaggctctctagcacctcatgacactgttgttcctcctccttaccacttgtccattctagtgacagctgtctcaattccttcttattctcaaggctggctgcttttgcatttcttctccctggcacattttcgagcttctttagtattaacgaacctccaatatttaaatcctttagctctgcaagactactacaactcaagccacttcccactacgaaccatgtaattgttcgaagcgaggtgatttgtccaagctctggaggcatgcactccaacctcgtgcacccatctgtgtacagatgacgaagggcactcatgtgcttcattctcttaggaagtctaataagattgaaacatccagaaagtttaagtgtctgaagattataaagga

SEQ ID NO: 683 - DNA, 2120 bp, Zea mays
catgtaacaaggcattttatcatacatataataaaaccacaacgtgcctatgctacagacaagatatccgtcgcataatttttttatcaaaattctagaccttaacccctgacccgactactttataattctaaaactaattatatcaccacagaacagcacaccgacacaacaacggatctaaacataatcactaagtgcacgtatgctaaataaaaaggatcgtcgcaacctacatatctatcaatccattaattaaaacaaaataatatagtagcgaatcagctaacccttgattaaattcgacgcgaactctgcaagaaccacgatgatttatatttcaggcttttcgtcgagtacttggtgaatttcacgctgctagcttcgtcttcactcaactcttgggatttcttgatgacgcacggaacaatgacgagatcgagtctagagcgagctggtgaggtgtggtcgagcaggttagtgcgagatctagtgaggacacgaatccagtgaggactccgatgtcggcaaggtcacgagctctagcgaaacagggtcaagcggcgaatgcgttcggcgtgcatatgtgagctgaaccaaaagcgaggaaccgatgaagcgaagttcgtcgacaagcaccatggaggaatcagcgacgttgttgcacacacgacgcaacgatgaacgacgacaaccagcatggagacccaacgcgattgaggaaggggttcaacgattcgatgacaccggcgaggtcaatgacgagccgaccaaacaaaactccacgacgtcgaccggcacacggaccagagaacggcggctggcgaaatccgagctggggaaaatggcgtgcgaccatggcgaactagagcaggggccagggacacggtggccatggcgagcctgaggctagaggagggtgccgacactagcgagcagggatgcaaggtccgagcataggggccagctcatggcggccggcgaaccgcgcgtgcaccagagaagagctcacgccggagcggccaacggcgcagagggcggagcacggccagaagaacataggaagctcacattgcgtctagcaagcacacaccatggatggagcatgggggcgaggagaatgagagttgagtgaggcgagcgttcaggcgctagcaggtagcaacgtcccgcgagagagaatgacgaggtgagagagagagtgtccaagaagaaccaagaggcaaagaagatacgactggcacacttgtgcgttgtagaaatatcaaccaccggataggaacaaagatctggtatccacgtatgaagaaaaaaatatcaatgcatatcaactctaggggatgaggataagagattttttttcaacaccgttatatgtatgagaacaaatatttggacacgatttgatttgatgactactccgaagtcagattaattcgtacccattatttctatttgaagatttagatcgacacaaaaaacacacagactgaaccaaactaattttagcttcgatattttagactatatttaatccagtcaaatttttacgagtctcacgtgctttcggtcattttactacagaacgattcgattaatgagctggcgtattattttctcgagcaacacgtaaacaaccagatccaaaataatatcggctttactacttcagatgatatttgatgcagctgaaatcgaacaaatatttatctgccatttgaacctgtttgatttctctatcgaggataatttgttggaaaccgaccatgattataattcctcagacacgatggcttgcttgacgagaagggactaaattatttggcactaaaaactttagtcgtcgacttctaataaatctcgtttttcggacaaagtcggaggactaaactaagtttctaaattcgtctttgcgcgagcgatgaattttaaataatcaccaggctcaccaattttcggaacaattatgttccgaacatcacgaaaatttaggacgagcctagatagataaaaataaaaacgatgtcgaactcacgacagacaaaatagattaagacagagagattgttattcaccgctatcacgtgttaaagtctgcactcgtggtcgagcagatgata

SEQ ID NO: 684 - DNA, 2001 bp, Zea mays
gtgcgacagaccaacgcgtagtggcaccgacaagctctaattcgccgtagaggagaagaaccgggcgggtcgagggtactctatagagaaatcctagccacggagtgggtcgatcgagcgcaccgaggacagcgcgggctctccagtgaggagtttgggacatctagggccacaactttggcaaggggtggagctgtatcggccggacgccgtggaggtgcggcgaaccgacgtgcagaggcaccggcaagctctaattcgccatagaggagaaaaactgggcgggtcggggctactctagcgagcaatcccatccacggagtggggcgatcgagcgcagcgaggccagctcgggctccggtgacgggtttgggacatctagggcctcaacttaggcaaggggtggagctgcattggccggacgtcgaggaggttctacggaccgacgtgcagcggcactggctagttctaattcaccgcagaggagaagaactgggcgggtcaggggtactctagcaagcaaatccaaccacagagtggggcgatcgagcgcactgaggacagtgcgggctccggtgaggggtttgggacatctagggcctcaacttgggcaaggggtggagttgcatcggccggacgccgtggaggtgcggcggaccgatgcgtagtggcaccggcaagatataattcgcctaagaggagaagaaccgggcgggtcgggggtactctggcgagcaatcccatccacatagtggcacgatcgagcgcaccgaggatagcgcgggctctggtgagggatttgggacatctagggccacaacttgggcaaggggtggagctgcatcagtccgacgctgtggaggtgcggcggaccgacgcgcagcggcaccagcaagctctaatttgtcacagaggagaagaaccatgtgggtcgggggtactctggcgagcaatcccagtcactgagtggggcgatggagcgcaccgaggacaacgcaggctccggtgagggggttgggacaactagggccacaacttgggcaaggggtggagctacatgggccggacgatgtggaggtgcgtccgaccgatgcgcagcggcactggtaagctctcattcgctgcagaggagaagaacggggtggatcgggggtgctctggcgataaatccaagccatggagtggggcgatcaagcgcaccgaggacagtgggagcttcggtgaggggtttgggacatctagggccacaacttgggcaaggggtggagctacatcagtcggacaccgtgtaggtgcggcagaccgatgcgcagcggcaccaacaagctctaattcgccgaagaggagaagaaccgggcgggtcgagggtactctggcgagcaatctagccacggagtggggtgatcgagcgcatcgaggatatcgcgggctcccgtgacgggtttgggacatctagggccacaacttgggcaaggggtggagctgcatcgaccggaggtcgtggaggtgctgcggaccgatgtgcagcggcactggcaagctctaattcaccaaagaggagaagaaccaggcgggttgggtgtacaattgcgagcaatcctagccacggagtggggcgatcgagcacaccaaggaaagcgtgggctccagtgcggggtttgggacatctagggccacaacttgggcaaggggtgaagctgcatcggccattcgtcgtgaaggtgcggcggaccaatgcgtagaggcaccggcaagctctaattcaccgtagagaagaaccgggtggatcgggggtactctgacgagcaatcccagccacggaatggggagatcgagcgcactatggacagggcgggttccgatgaggggtttgggacatctagggccacaacttgggcaaggggtggagctgcatcggccggacaccatggaggtgtggcggaccgacgcgcagcggcaccggcaagctctaattcgccgcagtggacaagaaccgggcgg

SEQ ID NO: 685 - DNA, 2005 bp, Zea mays
aggactaaataatgattcacaaaagcgaactaaacacttagacttgctacccctcgacattcaaatttggaataagcatagaaattgtttaactaacttgctaaattgattctctaggttaacttgtatagcacaataattaatacgacatcacattattcgctttatttacaactacaagaatacaagaacgtatgcaaggttaactttcagtcacaaatatcatgaccgatgggttaccactagttgagctacatgatcatatctacttaagaaggcatcaactccatacaaataaacaaaaaatcattatacgtaatactaacaacacctatcagatacgtctaccaatacattcttcacatgaattatactgcaacatatacttcaccacgcctcgcggctacttcacaattacggcggtaaccaagcagcacacaattacgacctttatcatgcatcaaatacacccacgacgcgtttaagctacaaatagaataattatcacgataaataagcctctaatccatctatcaaattaattagctagaatagcgaatcaaagtatgattaccatttcgactagcaatccacctaaacgacaacgatccttgttcagggctttcatcgagcacttggtaggcgtcgatctggaggttggtccaccacactcttgggattcgtttgcttgctgacgcgaacacaagtcggagatgtcacgtagggactagcattgagcattgaggcgaggcgacggaacaaccacaagcacctaggatggatctacaatattgttgtagacccgacacggagatgaacaacaatgaaccagcgagctaaaccatggcgagtgatgtcttgacgcggatgagcaacgacaactagcgaaatcagaacagcggggtgaggtgcatggccagcaaacaaggatgatcgcatgtggcaataaagcgaaagcaattgtcaacaacgggcttcgaggcctgacacgactgaggaggggaacagcgcgacatgtcggcgagggggaaaggagctcgacacccgatctcaggacaggctgttgggtgatcaacgtgccatggagtgagtagaggcgagcaaaggctgacgggatggcggacacggtcagcgaggagacaagcgacaacgtcgcggatgcgatgagtgcggacgagtagcacgctgatgaacccaacatagagctttggacgaggttgaggacgttggtactgcagcgaggacatcacaggaccagatcttggcgagaacgagcacacacgatgaccagctagcaccatagcgcaggagggatttgcgagcaggattccaagcgagtcatgacgagcaggctaggcacgagctcacggcagtgtccagggagaggagagagatccgatttggctgagatgaggaggggcgctgagaacggacgccatgggagggaggtacttggagcaggaatggagcagggggctggaatcgagcgcaagtgagcaagcgatggccacagagacctgggaaatcgacagcgagcagggagagagcttggacttgggatggacttggcgagctcaaccaccagggggcgcggctccacattatggcgaggaaagggagaagacgccgacgtcgaggagtgctaggggcacggccggatagggagcacgtgccggacctgagggagatgagggaggccggggagaagggacggacagccctgccatcactggcgagctccaagtcggccgcgccgcgatgatggaggagcaccggcgcggccatggatggagcgagctctagggactagggagggaggggcagccggcgccagaactcaaggccaggggatccgctggtgaggagccgaacgcgagagaggagcggtgcggccatgggagagacgccaagggagctgggagcagggacggatggaagctagcgacggataaggcctcagcccatgcgcggtgagaaaaaaatcaggaggaagggggcggcgtgg

SEQ ID NO: 686 - DNA, 2117 bp, Zea mays
gagatgtaaccctaaaggtaacgaaattcttattgaaaggtattttaattcacaatccatggaaaattttactagactaacaatataatatttcgaggtgttacaattgcctggaataacactaggttagtgttggttagacgacgatctcttggcaatcagcttttgttctggcactcactcaatctgtccatcttcaggttcgtccaccatcatcaccttgcggagtagccaactcattacatcatcttggggtcgactcaattcttgtcctccacaccacgtgattaattaacgtacctaaatgaaatgcataatgtgcatgaatgaatataaacaagaatagcacacgactaattattgctacaccgaagaggattaaatatttaacggcgaggcatatagtaacacttaaaagcaattaccaaatgccgatatattactaagtacaacctctactctattttaacttaaccgaacccgatttgaactagaagcgataataaacgaaacataagttctatatatattcctaagctagagaacacaccaaaatggcggaccagacttaggcttattatttagggacacctaactcagtctaaggataaaaacccttaattaactttctaacctaataatataatctaacctgaatagtatgccaactaagcaaatcagcacgttaatcttatgtctaatagataagacattatcaaaaggattatagtctcgtgaaactacatcctcaataatctagattttaaagcacttatacctcttctactatgaggtttcttgtatttcgactgaaattggctcgctaacgctactcgcttccaaattcttatggtagccggtaacatttaatcacgacatttgatcgaccaccaatcatagaatataatgactactagcacatggcatcgactccatcgtacaaacacactaaatataattaacatcgatagacttatcgataattgcttaaaacactaaatttaacctacgcaccaccaatataccacgcacttcaaacttacaaccggtttaaacatgcttgacaagtatacccccaagcactcttcccaaaacctatatctcaaactagcgattcaccacacgacatcgaccaaaccactgcaaacgactcggatattccagtaaatattatacctacaaccacgacacacatatgctaaaggcaagaggaccgatataattagtacatctaacaaatcccttcatcgaactaataacagaaatagaaattcgactcaccacagaatcatcatgattaatatacctagtcagatcattcatcaatccaactaacacaaataacaaattggcttaccatgaccaatccgacacaatagtcggaagaacgacgatggtttttgcttgacgtctttgaccgcacacaccttgcgagcgatgcaactcatgggattcattttgtcgagctggtggcgcgtggtcagcacaagagtgtcttcacggcttgttgtcgacacaaatggaagcaggttgatttagcgtgacgagaggaagcacacgtgacgcaaagaagtccccacgacaacgtcgtggaagcggcaatagggtgtggcaatgagctacacagacacggacttagcgtagacgaggatggtgatcgatgacatcgacgtgtcagcacgatgatttccattcgacgaagaagatggagcagccactcctggttcgggatttttgtcaaacatttaatgagcatcgcacgaacatcaccatcacacataggattaaacttggtagcttcggacaccactaaccaccgacgagcagcaaggtcagagaggctcggtgttggggaaaaataataggaacggagctggcaggtgatgatggtgctgcagcaaagcgaacaaggttagacgacggcgtggtctgccgggagggaacaccgacacacagcacggtggatggcgagagtaaatcggtgagatctgagtacgacgcgatagactagggacgtcgtgatgaccgacaatcgcagtggagatggcattgcaagcgtgcacaggaggtgaggacgagaccagtgaccatgggcaatagtgacttgaagtcgcggc

SEQ ID NO: 687 - DNA, 2116 bp, Zea mays
gttgacctacataaggtgttttcatgttgtgatgaattgaatgcaaaataattaaggagacaactctccattcttaagttttacaattagggtattacacgggggtactctggcgagcaatcctagccacggagtggcggcgatcgagtgcaccgaggaaagcacgggctccggttaggggtttgggacatctagggccacaacttgggcaaggggtggagttgcatcggccgaatgccgtggaggtgcggcggaccgacgcgcaacggcaccgacaagctctaattcgccgcagaagagaagaacctggcgggtcggggtactcaggcgagcaatcctagccatggagtgggcgatcgagcgcaccgaggaaagcacgggctccgatgagggtttgggacatctagggccataacttgggcaaggggtggagctacatcggccgcatgccgtggaggtgcggcggaccgatgcgcagcggcaccggcaagctctaattcaccacagaggagaaaaatcgagcgggtcagggtactctggcgagcaatcctagccacggagtgggggcgatcgagcgcaccgaggaaagcgcaggctccggtgaggggtttgcgatatctagggccacaacttgggcatggggtggagatgcatcagccgcacgccgtggaggtgcggtggaccgacgcgtagcggcaccggcaagctctaattcgccgtagaggagaagaacctggtgggtcggagtactccggcgagcaatcccagccacggagtggggcgatcgagcgcaccgaggaaagcacgagctccagtaaggggtttgggacatctagggccataacttgggcaaggggtggagctgcatcggccacacgccgtggaggtgcggcggaccgacgcgtagcagcaccgacaagctctaattcaccgcagaggagaagaacctggttggtcggggtactccggcgagcaatctcagccacagagtggggcgatcgagcgcaccgaggaaagcacgggctccggtgaggggtttgggacatctagggccataccttgggaaaggggtggagctgcatcagccgcacgccgtggaggtgcgacggaccgacgcgcagcggcaccggcaagctctaattcaccgcagaggagaaaaacctggcgggtcgggggtactccggcgagcaatcccagccacggagtggggcgatcaagcgcaccgaggaaagcgcgggctccggtgaggcgtttgggacatctagggccataacttgggcaaggggtggagctgcatcagccgcacgccatggaggtgcggcggaccgacgtgcagcggccccggcaagctctaattcgtcgcagaggagaagaacctggcgggtcaggagtactctggcgagcaatcccagccaccgagtggggcgatcaagcgcaccgaggaaagcgcgggctccgctgaggggtttgggacatctagggccacaacttgggcaaggggtggagctgcgtcggccgcacgcagtggaggtgcggtggactgacgcgcagcggcaccggcaagctctaattcgccgcagaggagaagaaccgggcgggttgggggtactctggcgagcaatcccagccacggagtggggcgatggagcgcaccgtggatagcgtgggctccggtgaggggtttgggacatctagggccacaacttgggcaaggggtggagcgcgtcagccacacgccgtggaggtgcggcggaccgacgcgcagcggcaccggcaagctctaattcgccgcagaggagaagaaccgggcgggttgggggtactctggcgagcaatcccagccacgaagtggggcgatggagcgcaccatggaaagcgcgggctccggtgaggggtttgggacatctagggccacaacttgggcaaggggtggagctgcatatgggtctgacgccgtggaggtgtggcggaccgcgcgcagcgaacagcgcacattctcacggcgtgcgtgggtgctgggcgagcgacgaggctaacaggcggggccagggcgtcagcgggcgagcgaacaacacgcgctaacagggcgggtccacggaacagagggagagaatgc

SEQ ID NO: 688 - DNA, 2116 bp, Zea mays
atgtttacaacaccctttcgagcactccgtagctcatgaatgacctgataattcacaaagagcaggcttgagttggatgaaaaagtacagtgcacttaaaaaatgtctgaagcccttaagtccaatttccctaactgcttgcagtcaaaagggaaaaagaaaataaataaatccttggctgtaactatactgatacgtccaatgaaacataaagcaaaatcaagaacattcaactattgcagaccccattcatccaccaggggtcgcaatgctgacaagtttcgctatgtttgcaatcacaagcagttgccggactgtcagagcctgcttgcaagaagcatcagcacaagcagcctggtggttaacgatctggcgagcgctccgcttctgcctggcgctccttgtagcgggagacatggatgcctagctcccggagcagtcgagacgagtgcgaggaggacgaccccgtcttggacccatcagtttcggcggtggcgacatccgcttccttgtcgccggccttgtgatggggttggggctggtcaccggggacggtggggtcgctgggtgggggcgctggttgggcaggcggcgaggggtggcctagtcgctggtcctggccgagcgaaggacaggaggagggatttagggagacgattgtacggaccgcgagggaagcgattgtacggaccgcccgcggtttggggaggcgggccgcgagggaggccagggcgccacgaaagggatagggatgatggcggtgtgattccactgggcgaggaaacgtggagtcgtggattgacgaactgaaatgtaggcctgaattacgaccaggttagaaactgtccggttggaaacccttgaggctttgtttggacactcagtactcaatccatatgtgttcaagtagattgcgttgtaaattagtttaagtcacaccctaatccactacaatacaattagattgaggtcaatactacagtacccaaactaagcctgaggtggtgtggccgtcgccatgaccattgtgggcaatggtggcggtgggcccatcctcatcctgcgctgtgccggggctagagcatctaatgaggcaactagagcatctaatgaggcaaaaaaaaaaatcacgaagccacaaaccatgggagtccgcgtcgtcagggaggagagggaagatgagacatagctcgggccgcgatcacctcttcgctgaccccgctgcctcctccacacagtcgttgtcgccttcaagggagaggagtgaggaagcattcttggcgagatccgctatggcctggtggcctaggaaccgcgtggaaccgtcccacgatcctggcgcagggcgccttcgcctccaggcgctccgacagcgatgaatgaggagatgacctagaagaggttcgcgaatgcgccggtgagagaggggtgaatccgccatggatctgggcaataggagtacgctccgacagcgatgaatgaggagatgacctagaagaggttcgcgaatgcgccggtgagagaggggtgaatccgccatggatctgggcaataggagtacctaaccggtaaagaaaaaccgaatctcaccgagaaacgtcacgtgtttctcggatttctcgattttttttttcgtttttctcaaaaaaaattggacaaaatttagagaaaaaagttcaatttaatcataacaatgtagattatttgtagatactggctaaaagaagtagatggtagcgttttgaactgaatttaaaatcgatgaaaattttggccgataaataaaaaaaaaaccggatcccaccgataaacgtgattttcaattttctcgaaattttttcgccgagaatgttttcgcacggccggacttgcggatgccgtcggcgtaggcagagcgggtgggcacgcggaggggcgcctttgtgagttcgtggggagggtgcgcgcggagcagggccgtgtggatcggcacgcaggccgacgaggcgttcccggaggcctggcactcggcggcggctagagtttggattggcgtgaggagagaggagatgagggcggttgacgatatggtgtgatcccgtgcagtgggctgaatggggctagcttttaggctcct

SEQ ID NO: 689 - DNA, 2114 bp, Zea mays
atttaacaaataagattgaaaattgcaagagacatctactttagagtttagtttgctattttataatatgcaatgtactgagtttttactataattttaacaagtaaattgattaattttgataaaaaaatcacggggcgggtacatagagaacgaggacggaggatggttccccatccccgcgaactgatgaggattaaattttcccatttagatctccgcgatactaaaatactcccatacccatcccgtaataggggaatttccagcgaggaatcaaagatcgggtccccattgccatctctacttgcgacgtaaccctcggcgatgatagcggtgtcgatctcatcgaagtgagaaaccatttggccaagggccgcaccaccaccttggcaaacaccttcggcgatagatcgctccacgtggttgggcagcacccgcaggagatcaaccaggagcgctttagccaacggcggaggagagaggtgggcacacaccatgccagcaactagacggatcacatggagttcagagctcctttccgaaagtagggcgttcgctcatcgtcccgtggcaacggaattttcttgagctagcgaaagctcgctcatttttctatggccaccaccctcacctcgtccaccgttgccttcgcatctcgtgcctaagcgagcatattgtagagctctacggtagaaaaggcacgaagcaatcagaggcggcagatgatcaagatgtgaagaataagaaaggaggcggaccttcggtcacatcgtgctcccttgcaagctctaagcccacctgctccaagcggacctccacctcccgcaaggatgatttggttagctcggcgtgagacttcactccacggagcatctccccgagtcgataacatttgtcctggaggtgatccacatcgccacaagcaccatcgcactccgcgcgcaaggatgacacctcgccttgaagacgtaggatttcggagcggaggtcagcaagcttgcgctcttcctcctcgatgtaggcggaacttgcccggagctgccccgcctccacctgagctgatcgcagtgcctccaccagagcctccgctcgagcaagaagtcactggagaaggaagccatacaaacaatctagatgaacaaaagatcaaggaaagagcaaatacaaaagaaaaacttacctgcctgaaggggacgaggtcccatgttaccgatgcccgagcaaacgagatcgcatccctgaaaccactgagcatgcgctcaataatttctaaggccacgtcagcttggatcggggccgactcaagccgcctccactccccggccttcgcattgccaccctccgcgagcggcgcgggcagcgcgaccctaccggtgaccatggccgctgtggatggctcctgaacattgaaggacccgggggctggctgccccacctctaagctatcaccagctaggatggcggtcggtgggggtgcaagggtaggaagaggcagtggtagagcaggtgagcccactagtgaaggcacaccagaggcactcgcgccctccaccaggggttcccctagggcggacgcaggtggtgacgactcaataaggaccacctccgggatagtcgcgctcaccgcccctgaaacgacctgagacgacggcactgctgccacaggggaagagggcggcgcatcttccgagggatcaaccacaggaaccagaaggggcacctcccagcgactgcaatctaaggctctggggggatggagttgtccttctcgcaaccaaggtcgagtcccacacagacttgtgtggcacgtacgtgcgggaccaaaagaagaaaagaaaagagcatcaggaagagaacaaaggacctagagcaagaaggggagcaaattgacataccaggatgaccgcttcctagcaaccactttccctagcgcggccggtgaaggaacagaaggctatggtgcgacctaaggaaccgcgtccacgcagtgccccacgggatccgagggcatcatgggggacactaccgccagcgctgtccctctcgcagcaacagttgccacaacatcgacatcagacgccacgataggggtgggatccacgatcggccta

SEQ ID NO: 690 - DNA, 2114 bp, Zea mays
cacccctggtgtttatattccgctcgacaacgagtatggatttaatcacgtaatatcagtggataaaatggatgctaaattttaaacatcttctcctatcgcgattttaatatcgcatctgttccatttgtcgctagtgcgacatcgtttttatttatttatccggcctctcctaaattttcgtgatgtttggaacatcgtcgttccgaaaatcggtgcgtccggtgattatttaaattcatcgctcgcgcgaatacgaattggcaagcccgcccactttcatgattttatccctaacaaattcatttcaactcgacgactaaaatattcggggcggaataattgggatcgcgcgtcgtctgagtgaaatcgtgcgccaggatatgattcaatttacccttctgcaggctgttttgacgtgcatcagcagatatgatttcggctaatattagtggaatcacgcagattaaaataccgaagccgaactcgtgtcaatctggtccgtttacatcgtggccgaaatagtcacaaaaattatctaatcgaaatttagtcagaatcgtaaacctcagatgttccgtttcgtgatccgagaaaataatgtgcatacgactatttgtttgtcgctaaaaatcccgattcaaaaatatctatgaatttctgaaaatctgaaaaaaaaaggaaaatatttttctaaccgcctcctgctgatttttctcgcgtgaagcttatcttcaccaaatttttacctgcgcgcattcatctgcgggggaaaaatcttctcagccgccgttcagttcgtggatagaaaaatcccgccgtcgttcttcttcacgcgcagctggccttcttccatttctatccccttctccgattctttttcagccattcggccgccgctcaggggagaaaagatctccagccgccgggggataaaatcccgctgcccagtctattttcttctccaccgcgtcatcttcctccagctcaatccttccctgcgcgtggtacttcccccgctcgcccatggcgccggcgtcctctgcacgctcctcccagatctcggcgcccaacgctccctgtgcgcgcgctccccagccgagcggctctcgtccgcgctcctctctcctccctccactttctttttctctgctcgcgacgcgtgtccggcctgctcccatggccgtgcttggtaccgcgcctgctgccgcgagcagctcccagccgtggcgttctccctgcttccctctccctccagttcctccccatggacgccagccgtgcccctggctcctactcctccagcgcgtgaagccctctgctcgccgcggtccttccgtagctccctctgcccagcagcttctctttcctggagtttctttgcgttctgcccagccccagcgccctggcgtctgctcggttccctaccccatctccatggctggctgcagctccctgcgcgcctaactccagctcgatctccagccgttcctcccatgccgcggtcttccctgcttcagctcggatttggtcttgtcgcgcccctgcgtttgctctgctcggatctcgacttcctgcccagctcgctccagctttgttgtagcgcaggtcgccggtgtttctccctgacgcgcgctccgccttgccttgtccctatgctcgccgtggccggttccctgtgtcgtgcccaggattttgccgcactcccttgtcgtggctttctgcttcctcgtcgcgcgcgtagccttacgttgttcgtgcgcgcgtgctgccgcgaagctccctgttcagttctccttcgtcgcgttgtcgtgcacgcgaaactgctcgcagtcgacatcgagtccgtaacgcgcacgctggacacggtgaaacactgtgtgtgcttgtgtccaagtctgcccgacagtgacctcgctttgcttctcgcgtcggctactcgctggtgctccaactcgtcaactgtcgttgtcctatccgcgtcagtacgcgaccatggtcgtgttcgtcgagttcgccaacactctgttgccgattcgactgtcgtcgcggttgtgtgcttcgcttcgtgctcgccaggtgttgtcggttatacctcagcactcgtgcttgcc

SEQ ID NO: 691 - DNA, 2113 bp, Zea mays
tccccactagtgtatgtggtggctcttgaaatggcaccaattgaggaaaaaatcttcgtaagagtgtcgtagcaccgcgaagcaatagaggagttctcttgaagctgatttaaggttctcgatagctttggattttctatatacttatcagcattaccctttttctcagcatcgaggttggcctgaagctctttcataaactcgtcatgttttttaacatcaaaacatcagcatcatatatcttcctcgcttcgacaatttccttttcaacgttttctaccttctccttcaaaagtgccatctttgcgtctttctcctcaaaactcttacgaagtttgatagcttcatctttaagagaggagaattcttttacctcctttttttgcattctcaacaatttactcagcattagcccctacataaaaatgacgatgacgaatgatttaatcaaaacatggaagaattccgaagctgcatcaaaattaaaaaatcttcgtaccttgatactagtacaagtcaagctatgggataatatcttcttcttcacctggcacaacttctcctcgatgtccagaaagctgatgctttggattacatttcaaacaatcttcgactcatcgggatctagtatacacatcaacatttgttcttctccaccgagtagtaaagccttgggccgtaccccaaggcttcgcctttctctctaagttttgaaacttcttcttcactcagttcttcaccgctaatatgcctcgtgaagaagccaagttcctcatcttccccagtggtttgtgtagcttcggctacctcggcctcggccaaagtttcttgttgtttttgttccactttctcgcaccccaaagaatctccaccttcggcaccattgtttccaaatgatgaagagctaccgaaggcggcactgctgagtcccataatgcatggcttctccacctcttcatcagagtccttcgaagtcggtataaaccaaagtcaatgagggtcctaggggacttaaagaggaaaacagcagtggttgggtcattacctcaagaatccgagtgcagttcaatgatgaagttgtggttgtgctccccttcccctgttcttgaggagcaacaattttaatttgtagcacctcaaaatcttattctaggtgcttaataaaataaaacaaagagtttgaatcaaaataccttttaacaagagttttctcaccttttaagtcacatattcgaaaataaatatacttgtaataaaagattgaatgaaaagatcttctataagttaaattgctctctgaatcatatatttagatatattctctaattagggttaggttaaaccattttttagaaaatattatacaatagaaattatttcctcaaaacatatattttgagggtataaaatactcagaagaatttgtttaaatgaacaagataaggaataaataattcagataaaattttatgcttttgcaatcatgctgacattttgtttgtttgtgcatttaacttgtgtgtgaattccagaacaagatttaaaactaaaaattgaaaactgaaataagaaaaaagggagaaaggaaatttcctgcgcgttgggatggatttctggccgccaacccaacacaacccagcccccttccttggtcggatgggccaaagaatcccctactagcccatcagcttgccccttctctttttctctaggtcgttgatgtgtgggccctgctcgttggtcgggcagaccttgactccataggcccccgctccctatgacacttcttggtggggccttgtgggcagcctcatcaacccgcaggtgcgacctcttttcgtaactgcctagcaaccagattgtcgtggatcttgcaccgatcgactagatccctcatgggactttatataccgagccaatacacctcctctttcactcactatccccgagcgagggagccaagcatgccgccgagtccatgtgccaagatgaccgaacatgtagcatggagcaaggagagaagaagggaatcacaggcttgggcgtgcgctgtcagggagcacgacaaaggagtcgtgtgggatcggctcgctccaccccctgtctcttatac

SEQ ID NO: 692 - DNA, 2112 bp, Zea mays
accacaacctaactaccacttcctccggtggcagtgtccacaagcccgaagggcgcgcggctccgatgcacaaaggcgcgagtgcggccccagcccggacgcctcaggcgaggccccgtccaaccactggtgcgccgacacgcgggcatgcagccccgcagcgcgggcgtgcagccattcaggcttggcttcagcgcacatgtatgtttgtttcatggcaaatgcggttgtggatttaccttattgtttcttgtttgtcatcttctttgttttcgattcttgtaccaggctcttatcctttcctccgatagttgtagtgggatggggcgatccggcaaggacgattacgccaacgtattctagcaatcagcgttcttcaactcaagatcagtgagagcaaaagtgctgataacatgtttgagtatggagcaaaagcgagagataaatggcaagaatgaaaactttgtactctttattgatgggatgctttgtttatataaatacaaaggagtgctttgtactctaaacaaatgacacgtttgcgtgaaaccttcctaatcctgcgtggcgccgacaccaacgtgtttagtagacgagcctcgctcgatcagcgtctaccgacacggtaccacagccgccgtccacggtctcagcggacagctaggccagttcctgcatcaccgtccggttatagctacaatgatgcgtgggcgtggcatggccccaaccgtttgcctaaatatggttggcaagagtaatactggcatctaaaatgttctttaaccgtacccaagcaatgaccatagcactaggtatgtatgtgggaattcttctagttctagatcaaaaataataaaataaagaaatccatttttttgaattttaaataaggaataaatcaagtatatatcttaacaaccttttcataaatctaagcaaccctttcgtaaatccaaacaaacttttcataaatctaagcaaccttttcgtaaatccataacaacttgtagagtttgtagcttgtgtatggagaaggatggtgcttccgaaaaagattgtaaatgcagaaggctggtgcttctggaaaacagatacaaacatagacatactgtatatatttgctgttgaatttagtctccttgtatatgctctatttttctttcttttttgtcactgtgcaatactattaataaaagtttgtttgagttaccagataactggaaggatcagcatggttagtctttcgatgtccgagccatgtgaaaatttgatgcagaattggcgaggctattgtgacttgggttagcaagctattgggaaaaaatggagaaactaccaagcatatgcaagatgatttccatggaatccttcttaaattggcataacatggccatattttattgggtgggtacaaattcgcgaactgttctcttgcatgcaagcgaaaataagtatatagaaagtatcaagaatataatatataactctttgtctaaataaattaccatagtcactaatcaaatatgtttatgtcccgtcacaatatacgggcaatgtactagtttttcctaaaagaagacactacatgtaacaaccgcaattttcctaaaaaaagatggcgtacatacatgtttgatgttatacttgaaaaaactaatatctattaaatcgagtgttgaaattgaaaattgatttaccgttgtctttgtagcgatgaaatcttcaaaactagattccaattgacatatttatcttagagtatattagggttagtcattccatcttttagcctcagtcattcatgagaattactgagatatcagtcatttagcgagtcagttgttctaaaaaaaatagacattacgagaatgaaagtgaacaaactcaatcattgtaggaatactcaatcgttccatctttttagccccagtcattcatggtaataccgggatatgagtcatttagcgagcccgtcattctaaaaaacagtcattgcggaaaaagaaagtgaacaaactcaatcattatataaatgtcattcattctttcattttaggctcaatcattcatgagaattgtcgagatatgagtcatttagtgagttagtcattc

SEQ ID NO: 693 - DNA, 2112 bp, Zea mays
cagaagcatcaacaaaaaataaattagactacatactccacaaactccatacaaatatagatcctaacttaatatacaacagccacaattccacgaactctgtctaattatccttgctacaatttacaaagaagaaagaatacacaactctgtctgtttttgaattagcagaatgtttatgttgctacaccttggactattccagcagttagtatccaaattttgaattaaggaaatgcagcatgtgtattctcaccgcgtcaggcccaggtcagcatatgcgcagtgcacaatggcatcgagagagagagagagataggaggggccggccctgtccgctagcccgaaatctatcggtcgcaatgacaagaccctcggtgcggtgttcgagcggcgcacagcagatgcaccggacccgtcatcatggcggtacgagcgacgcgaccaacagagccgccagcattgtgctgcagcgcgcatgcatgcaggagacttggcgcgccggcttatgacctggccacgcacacgacgtgcacacacgcactagctaggtggcctccttgcagcatcggtgctaaacaaactcacgtaaataaaaacaaccagcggctgcatgcatgcagtcgacgcagtcgacagtcgccaccgacgcgcacttcgcccgcgagcgatctcaagactcgatggatcgttgttgttcgcttggataagaaccgaacaaattagggacagaaagcagagtggcgtacgtgtgccatgcatattgccaccgggggcttctattaatatacttcccttgcatgcacacatatggagcatgcaagcagtcgacgcactcgccagtcaccagcgacgcgtgcttcccccgcgcgagcgatctcaagactcgatcgatcgttgttgttcgcttggataagaacaaacaaattagggagaggaagtggagtacgtttgccatgcatattgccaccgggggcttctattaatatacttcccatggccttcagcgcgatagatctaaaaagaatccctgctgttatagcttattgtcattgcgcttaagtttgcttccagacagtcacacctcagtcgtgaccagcagttttatgtgagttttcttacgtacgtacccctctcttaccagtaaatgtgctagcttatatgtctatgtatatgtttttttgtgatttctttcatttttttcttgtagatggaaaatatgacccaagatgagggtaggttccgctggtatccggatatagacactgtgttcttcaggggctgcatcgacttccttgacggcggcatcataaagtagaggcaatccaccttggatgatatctggaatatttgtcggaaaaactttataaggtgacaacaataacaatttcaaataaaacactcataaagagatggaaccgtatgaaacagttgtatgatgaccatgttctgcatcgtatccactcttcaaacatgggggagacgaaaagctgcaagatgcatattaaaaaaacaagggtattctctgtctctctttgattgaatatagattatatatattctaattatacgtttgtttcatttttagaaatgtggcaattatttcaagcatatgataaatgaaccacctaagaatttggatctacttgagagattgtttcatgaacaagatgaagcgacactgccacgacatgtgccattccagccaccgccgacgcccccaacacgtgcgccatcaaggacaccatcgctgtccccgccagcgtcgccgtggcatgacatgtccccctccaaggtagacgtttatgtcatccacaaacaactaaacgctttgggcaaaaggatggatgccctgaaaaaccaaatggatggcattagcaagtcaaaatcttctcagtgtcgtgacagatgagtttttgatatgttgggctatttgcagacgagtagtggaatcaataattaatcacttttgtgtgttcagattatccattaacaaattttgtcatcgatcaccatgatatataggttcaaggatctttttcagtgttgtttcttatgattcctttatgtgtctagcttgcatattttacaatcggccatgataatagagat

SEQ ID NO: 694 - DNA, 2112 bp, Zea mays
gggccggccctgtccgctagcccgaaatctatcggtcgcaatgacaagaccctcggtgcggtgttcgagcggcgcgcagcagatgcaccggacccgtcatcatggcggtacgagcgacgcgaccaacagagccgccagcattgtgctgcagcgcgcatgcatgcaggagacttggcacgccggcctacgacctggccacgcacacgacgtgtacacacgcactagctaggcggcctccttgcagcatcggcgctaaataaactcacgtaaataaaaacaaccagcggctgcatgcacacagatggagcatgcatgcagtcgacgcagtcgacagtcgccaccgacgcgcacttccccgcgaatgatctcaagactcgatggattgctgttgttcgcttggataagaaccgaaaaaattagggacagaaagcagagtggcgtacgtgtgccatgcatattgccaccgggggcttgtattaatatacttcccttgcatgcacacagatggagcatgcatgcagtcgacgcactcgccagtcgctagcgacgcgcacttcccccgcgcgagcgatctcaagactcgatcgatcattgttgttcgcttggataagaacggaacaaattagggagaggaagcggagtggcgtacgtgtgccatgcatattgccaccgggggcttctattaataaacttcccatggccttcagcgcgatagatctaaaaagaatccctgctgttatagcttattatcattgcgcttaagtttgcttccagacagtcacacctcagtcgtgacccgtagttttatgtgagttttctcacgtacgtacccctctcttactagtaaatgtgatagcttatatgtatatgttttttttgtgatttctttcatttttttcttgtagatgtaaaatatgacccaagatgagggtaggttctgctggtatccggatatagacactgtgttctgcaggggctgcatcgacttgcttgacagcggcatcataaagcagaggcaatccaccttggatgatacagctctagaatatttgtcggaaaaactttataaggtgacaacaataacaatttcaaataaaacactcataaacagatggaaccgtatgaaacagttgtatgatgaccatgttctgcatcgtatccactcttcaaacatgggggagacgaaaagccgcaagatgcatattaaaaaaacaagggtattctctgtctctctttgattgaatccagattatatatattctaattatacgtttgtttcatttttagaaatgtggcaatgatttcaagcatatgataaatgaaccacctaagaatttggatctacttgagagattgtttcacgaacaagatgaagcgacaccgccacgacatgcaccattccagccaccgccgacggccccaacacgtgcgccatcaaggacaccatcaccgtcaccgccagcgtcgtcgtggcatgacatgtctcccttcaaggtagacgtttatgtcatccacaaacaactaaatgctttgggcaaaaggatggatgccctgaaagatcaaatggatggtgttagcaagtcaaaatcttctcactgtcgtgacagatgagtttttgatatattgggctatttgcagccaagtagtggaatcaataattattcacttttgtgtgttcagattatccattaataaattttgtcatcgatcaccatgatatataggttcaaggaactttttcagtgttgtttcttatgattcctttatgtgtctagcttgcatgtttttacaatcggccatgataatagagatagaaaaaggggcaaaaaagaaagaaaagagggaagtggaataagaataaaaaaggagaaaataatgagtaaggaggaggaagaaaaaattaagcggtagaaatggagaaaggaggaagaagccacaggccttcgcctgcgcagcccctcttggagccgatgatgctggtgattgtgcattgcgtaacacctccgtcaggcgccgacgatgatggtgatcgcggtgtttgtggtcggatcaggcacatccaccggcgccatgtccgtgtgcgtacgtggtggtcgagttagtgcgcgcgtg

SEQ ID NO: 695 - DNA, 2110 bp, Zea mays
attgaggaaaataccacagcccaaaattgacagttcagcctatcagttttctgtttaatgatgtttttaatgtaaaatagacatttcagacttatgtaatcctgaggtttgcagctcctttatgtagaacatttgatagaagagatgtgtcagttttatgatgttctaactcttgattttcaacatagagaaggtaagggataggctgacagaagaacactcagggctcattcggtacaatgggttccaacctgaacgattctaaggcaaggattcagtgaatccggtcggttcactcaaaccagtgctgtccgcgtcgttgccaagatccgatccggaggatagttagccgggattcgaaccggaccataaaagataggaaaaatcccaaaccaggtcactcccgtttttgattttggtctaaacgaatagctcattatgaaatggctagattctgatccggaccatttctttccacccggaacgagccagaaaccggctgaaacgcccaaaatgaacgaggcctcaagaggtttgaagctcctttctgtagctgaatctaggaataaagaaattgctgcatgaagttcttgaaaaggtagcacaaaaagaaggcgaagttacagacatgacagagaagctggctttgttagaaattgagaatagatgactggttcgaacgaagcattaaaagagaaagtggatgctatgctggtcatgtttgatgagctacaggaacggtttggttttactcatcaagctgagaaggaagatgatgcagagaagctagcagttcatgagaggacaatctcacacctgacagaggtacacacaagaatcttagagctccattctctagctaaatcaaagaatgaagaaattgaaactcagttccgtgaggctcttgaaataatatcacagaaagaaggtgaagttaaagaattgtgtaagaagctagatgcccttgaaattgagttgggaattgggatattatgaggagcaggcaacggaagctgctgccgctgaaaagaatcataaggttaaatttgatgtagcacttatgttatatctgcagcacatatagttagaagtgaaggctaccttgagattgtgataggcctctgaacccatctgcattgcttcttcaaagtttatagcaccagcaaggaacgatcatagtttcctacaaataagaaatgtttatagttactacggaactacaactaaacatgttgatatggtggatatagatgaacaactaactgtcttaatatgtttctatttaggcaaaaggtgactcaagtgggccaaaaaagggaatggtgccttccacttctcagattctgaaggtttggaggaatacttgaatgggaagaccatttccagcatgctttcaaccattaattattgtaattgcttacttatagagtggaacctgcatagcaacaagcatccaatgttccgagaataagaattatgtgtggtggcatgacacgtttatcaaattatgacgattttagaagaaaagcagcaccagctttgcaaactgcaattgacactatcagcatggcattggctccaagctcagcctgcatttcgtgcaatatcatatctatttatatttggataaatgtagttgccagaaataagggaacgaaatgaagatacaaaaaaatttaggttgtagtggtaagtggaaacacaaataaagtgaaaagaaaatcattatttccaaacaaccaaatataactgaaataattagcatcctactgcccttatattgactatacccaatgtaaagaaagaattgcagcaggccataggagtatcttacagttacagggaaaggaatctacaaacaaataaacaaacaggaattacgtagcagcggtacaactacaaacaaagataacgatccacgagatctgatgaaaccagaccagacaaagcgtcatgttgaagtcatggagacagttacgacagcaataatcagagacttcagaaactataacaatgggtcaatggtacaggtccttggactcacaaattaacaaaactaaattaaatagtatgcacacgaaagtgatacttgtggcgaaagaaattatgt

SEQ ID NO: 696 - DNA, 2110 bp, Zea mays
cagaaatcgatatatcatgcagtaaacttgaacggatataatatccatttgtcctgtaatcatgttttgatcagccttaaacttgggttgatgtgttcacaactgagaaacattgcaaatagcacaatatatgttttaaggtaacatgcctaaacaagtatgtcttttagaaaacacaaatgaaaatggaaatataaattttcttctattaactaattttccattaatagaggtcgtaactctgcaaaatagtttatcttgaaaaatctgcatattgcaattcaaatacttttaaagttacctcattctttaaaacactgaactttaatcagcatgcgaccatctaatttgtgggtcccgtactcaagttattgattgtgttgaattttagttgatggtggagcgtgtgaaacaacatgttggatcattctgtaaatctaccccataatttagggctttgaaaagcttcaaagttttcgcatggttcatgccacaatcttttcttgaaaaaatgcacaaaatcacaatgctttactcacaaatcagtgtattgcgaaaacattcataacaaaccatgttgggtccttttgtaaaaacaacagttctaaacattacatcatttagggctttgaaccgcttcaaacttacattaatgtccataaccatgaaacatttaaaagttttccacataccttatgagataacatgcccaaacaattgatgtttacattttggcaataagcaaattgtaatgtaattttccttggttaaattgttttgtgaaaaatatcatgagtcacataattgttttttgagtggcctcaacacatgcattgttgtgcataaccaagaatcatttaaaatagcactacatatagtttaagatagcatgcctaaaatattattgtttatagtctagcatagagcaaattgtaattaaaattggaatgagaatttttctatatttaattcttttgttataaatatcattgatataactttaatagaataatatcaaagaatcttaaaacatggatcgaaataaaagcataattgcataaatatagctctcaactccggaaaattaccgatctaaaaaatatacatgttgcactttaaacatttctaaagttacctcattctttatatctacaaactatagtggcagcattcgaacatacaatatcatgggccccaaactcaagctataggttgtcttgcacttaggttgatgatgaagcatgtgaaacaacatgttgcatagctcacgcctatagtaaattgatgatctgaaaaaaatcaacatgttgttcttcaagcgctcttagagtcacctcatcctttatatgaccaaatctactgctagaatgcgacaatctagggtcgcatactcatgttatggttgtctcaaacatgagttaacgatggtccatgcgaaacaacacgttgggccatctataaaaattgtctgtctaaacaatacaacatttagggcttcaaaatgcttcgaagttgacgcacatcagaaatcgatatatcatgtagcaaacttgtgctaatataatacccattagtccattactcatgttttgatctgccttaaacttgggttgatgtgttcacaactgaggaacattgcaaatagcactatatatgtttttaaggtaacatgcctaaacaagtatgtcttacaggacgacatttagaaaacagtaatgaaagtggaaatataaattttctttcattaactatttttccattaatagaggttgtagctctgcaaaatagtttatcttgaaaaatctgcatattgcaattcaaatacttttaattctttaaaacactgaactttaatcggtatgcgacccgctagttatgtgggtcctatactcaagttattgattgtgttgaattttagttgttggtggatcattctgtaaatctaccaaataatttagggtcctatactcaagttattgattgtgttgaattttagttgttggtggatcattctgtaaatctaccatgaaacatttgatatctttccacatatgttatgagataacatgcctaaacaagtgatgtttgcagtttggcaatgagcaaattg

SEQ ID NO: 697 - DNA, 2109 bp, Zea mays
acaactaaggaacgttgcaaatagcacaatatatgttacaaggtaacatgcctaaacaagtatgtcttttagaaaagagtaatgaaagtggaaatataaatttttccattaatagatgtcgtaactttgcaaaatagtttatcttgaaaaatctgcatattgcaattcaaatacttttaaagttacctcattcttgaaaacactgaactttaatcggcatgcgaccatctaattatgtgggtcccatactcaagttattgattgtgttaaattttagttgatggtggagcgtgtgaaacaacatgttggatcattttgtaaatctaccacataatttaaggcttcgaaaagcttcaaagtttttgtatggttcatgccacaatcttttcgacaaaacatgcacgaaatcatgactcttttactcacaaatcagtgtattgcgaaaactttgatgacaaaccttgttgggtcctttttgtaaaaactaccattctaaacattacatcatttagggctttgaaccaattcagacttacattaatgtccataaccatgaaacatttgaaaattttccacttatcttacgagataacatgccaaagaagtgatgtttacattttggcaatgagcaaattgtaatgtaattttccttggttaaattattttgtgataaatatcatgagtcccatactttttttagtggcctcaaaacatgcattgttaatcataaccaagaatcatgtaaaatagcactacataaagttaaagatagcatgcctaaaccattattgtttatagtctggcatagagcaaattgaaattaaaattggaatgaacttttttctatatttaattattttgttacaaatatcattgatataactgtaaaagaataataacaaagaatcttaaaacatggatcaaaataaaagcagaattgcataaatatagctctcaactctggaaattaccgatctaaaaaatatacatgttgcactataaacatttctaaagttacctcattcttcatatcttcaaactatagtgccagcattcgaacatccaatatcttgggccccaaactcatgctataggttgtcttgcacttgggttgatgatgaagaattgaaacaacatgttgcatagcacacgcttatagtaaattgatgatctgaaaaaatctacatgttgtgcttcaatcacttttagagtctcctcatccttcatatgaccaaaactagtgctaacatgcgacaatctaaggtcgcatactcatgttatggttgtcttgaacatgggttaatgatggtgtatgtgaaacaacacgttgggtccatacataaaaactgtctgtctaaacaatacaacatttagggcttcaaaatgcatcgaagttgacgcacattagaaatcaatatatcatgcagcaaacttgtacaaatataatacccattagacccatactcatgatcggccttaaacttgggttgcagtgttcacaactgaggaacgtttcaaatagcacaatatatgttacaaggtaacatgcctaaacaagtatgtcttttagaaaagagtaatgaatgcagaaatataaattttcttccattaactatttttccattaatagaggtcgtaactctgcaaaatagtttatcttgaaaaatctgcaaattgcaattcaaatacttttaaagttacctctttctttaaaacactgaactttaattggcatgcgaccatctaattatgtgggtctcatactcaagttattgattgtgttgaattttagttcatggtggagcgtgtgaaacaacatgttggatcattctgtaaatctaccacataatttatggctttgaaaagcttcaaagttttcgcatggttcatgccacaatcttttcgagataacatgcacgaaatcatgaccctttactcacaaatcagtgtattgcgaaaactttcatgtcaaaccttgttgggtcctttttgcgaaaactaccgttctaaacattacatcatttagggctttgaaccgcttcaaacatacattaatgtccataaccatgaaacatttaaaaaatttccacatattttatgagataacat

SEQ ID NO: 698 - DNA, 2108 bp, Zea mays
ttcatcattaatcagccattgaaggtacattacgaagagatatcataataccctaaacatgtgtaggagtgtaataaacatcaacactaatatgaatactataagctcatgtttgacaggatcacacgtgtgatacacctatattgaacaccaaaatccacaagcaagcaacataacaagtctccttagccatcacaggagccattgcatgcaaatctacctctacacatgaatgagaaactacttcttagtcttccaagcaagcaataatagaatcaccaaaacacgataggtagaaagagagtgacaattagaggaaccactaccccaagtaacattacaatatgtctaaaatcttttaagtgctggaatgagggaaaaacaggcaccaaacgacatgagatagtctcactaagataatgtaagaaatattacaccaacacatgaaaatattgcataaaatatctgtagatttttctatgcaagaatatattttatttgagaccaaaataaattttttgagttaaaatgattttgttactgattttatttcattatcgaacatccaagtttaaatttcaaataaccatatattggagtgtatcacatgtttatttcaataaaatagaggggttttgatgcaaaactagcattgttagcgttggatgacttaggcgctaaccaatatcggtgtgttttagccaacagatcacacgtgtgcgtcttagattaaaagaatgattgtgcgggtgatgcttagatagcagcctccttccacatgatagccatcagatctctctctctcttaatttattatcaagtgttttctgacttgattaattcacccaccatgcttcttcattcacttctttagaacttgaggaagaatgagcagtgtacaatatatcgaagtgcatgttttgatgtttacttgcatgcaggctcttggtccattgtgcggtactgtacataatttctagagtaaaatgcttacttgtgtacattgtaagtttgtttcccatttgaattgctaaaaggctctatctccttgtagttagaacgttttatggtgatctattctttttcttcaatgaggaggggaagcacattgccacgttgaggtcccttcatcttagaagggcaatgccaaatccaagccaatttgcaatccttgttcatgaaataccaaagagagctaaagaatcatacagtgatgttgttggaaaattctccacaaagtatcactcgtctagttatgtcttgcatcaaattgtctacaaagttgggaatggccacaagataatggtatctagtactcaatgcatgcatttctcttttactattatatattctaagcgaagtataaataagacttcttcatcttatgaatagctaggttttctcataattttttttgtctttttgacatgaacaagtgaacaaatgtccagttcctttagtgttgcatggtttttctttccttatgtgtatttgtaattcacctcttggtttttgtgttactctaatctttaacttatctgacagactggcacagagaaggcatataaaaagttcaaacatttcatagctgaaatcgatagtcagggatgtaggacgacaaccaccaacaactgttgtttcacgggaccaccccctccaaattcttctaagttcaactcggaatgcgagtagaacaaggggaacactgacaatgacgaatccaccaaaaacttagattacgaggttaaaaagcttgcatgcatgcatttgttaattgcttaatttagaattaataatatggattaaattagtaatttctatgtggaattatatgcagcaggaatgcacaactacttttgtttttttcaaaactcgctatgatgcagttgctgcatcaaatatagtccagacaccaaaccctatgaaatggcttactagtctggctccagaaccagaagacgtattgatccaatctttggctatccaacaagtggcgtaaatcaacactagtttcaggctgtattatttttgcattcatacttttgaccccgatggtgtgtatacaagcactatatgacccatatcagctgcaacagttggttcctcgc

SEQ ID NO: 699 - DNA, 2108 bp, Zea mays
gtcgtgtggatagaactgttgataataatttttagaatcttgaataatttcatcgatcttatgttcatgttttaataatcttccccacctcctttgttgacccttctctcatttgatttttcaataccatgccactacaagaaaaaggtaagaaaagctagcattatcgactaagtaacacactgcacatagattttttatcacacgtcaaccgggcaagtttgagagatagctgcccccaattctcagttttatttacattttactgacgaagggggtgtagacgatgaatgggctcgtcaaggacgtgccaacagtgaacgggatgcacaaggagcccatggccacgcatcccagattgctcatgatgcccaccgcgcatctgaaaagtgagtattgaaaacctggatattccatcgtgcttaggtttcaaacaaaaactaattggtgctttatacttttttgtggaagcatgatctaatagggaatgcttattcacatggtgaactattattcatgcttgatgctgatggtgcaaaataaaacttgccttactgttacaagtggaactaaagggtctagcagggttcaatggtacaaggcatcttcctctgaatttacgaatgaacatgagcttgaagcccttactccatcaaatgtttctaaggttatatcaatttattctctactactgccattgatgcactgctcaaaatttaagccatttgtgcaataaagccagtagtatccatcaataaatatcgctaaacatttggtctgcatatcgtattggctgttcattccaacaacataaaaatgtagctcatatcacagttaactgtgtcaaagtatagcccgacccgttgtttctttttttttattaggttctcctatgtctgaatatctgcttgtgcttccaaattctattttcttggcttacctaatccaactgacagtacatgtaaatcagtcagcattgaaaacaaaattattttgtaagtaacagttcatttagcagcagcatatatttatgcgtcggactccctactagcagcgtctgtagtactactatgctgatgagatgttgtggaccagtaagcatgattatttaattgaaaagaaaactaacacacgttgttccaaaatttagtgatgctaatattatttgtggatatctcgatacatgaaatgcatgtatgttgtttataaggaacaactttggctgaaccaagctgcgaccaacactctcatggctagattggaggtccaaagatttagttcccggtctgacggcaccagaagtttccggtcactactatcatcacggttgatgttagtaagagcctgctttgggaagcttctgcatgatcttgatgtcttgttcgatcatgtgcttcactttattgtccagttccaaaaaacggtgccagatttggttcctaaagcattttcttcagccgagtcatacttacattcttcatgggccatctgtgctacagtagttgtaatgtattactagcttacattttaatgtttaagtaactgtttgcttattttattgttttaatacatcactgataaagtacttatgttataaccaaacgtcaatggtgtctgatgttataaaagtcttatgctaataaaaggagggaagattacatcttttgtatatttggttgaaaatgtagtcggtatatgatatgtgaccatcagttcatttatcttttggaaacatggatgatgtgtttcatcatctacaatgtacattaaccatggaaacatatgtcaatcaggcaaacaagatagcatgcgccaataataaccattagctcggtcggggaggggcgcggtggcacatgcgccccgcgcgcttgcgggaccagggagccaaagtacacgtagtcgccaagggaattcaacgtgagacctgcaggctgcagcgtggcatctttgacgtgcgtcgtcacagtccttatctttgacgtgcgtcgtcaccgcggagaagacggcggcggtcgtcgtcggatccataagttattaacgagcgaggtttctggcacgccgacgacgtgcaacggatccagaatccatatggatcgagtgagtga

SEQ ID NO: 700 - DNA, 2107 bp, Zea mays
ctgcggcgaattagagcttgccggtggcgctgcgcgtcgatccgccacacctccatgaagtgcggccgatgcagctccaccccttgcccaagttgtggccctagatgtaacaaacccctcaacggagcctgtgctttcctcggtgcgctcgatagccccactctgtggttcggattgctcactagagtgcccctgacccaccaagttcttgtccactatggcgaattagagcttgccggtgccgctgcgtgtcggttcgccgcacctcctcggcgtccgaccgatgcagctccaccccttgcccaagttgtggccctagatgtcccaaacccctcactggagctcgtgttgtccacggtgcgtttgatcgccccactccgtggttggggttgcttgccagagtacccccgacccaaccggttcttctcctctgcggcaaattagagcttgccggtgctgctgcgcgtcggtccgccgcacctccatggtgtgcggccgatgcagctccaccccttgcccaagttgtggccctagatgtcccaaacccctcaccggagcccgtgctatcctcggtgcgctcgatcgccccactccgtggctgggatggctttacagagtacccccgacccgcccggttcttctcctctgtggcgaattagagcttgccggtgccgttgcacgtcggtccgccgcacctccaaggcgtgcggccgatgcagctccacccattgcccaagttgtggccttagatgtcccaaacccctcaccggagcccgtgctgtcctcggtgcgctcgatcgccccacttcgtggctaggattgctcgccattgtacccgcgacccatcggttcttctcctctacggcgaattagagcttgccagtgtcgctgcacgtcggtccacaacacatccacggcatccggccgatgtagctccaccccttgcccatgttgtggccctagatgtcccaaacccctcactggagcccgcgatatcctcggtgcgctcgatcaccccactctgtggctagattgctcgcaagagtacccccaacccgcccggttcttctcctctgcggcgaattagagcttgctggtgccactgcgcgtcggtctgccgcacctacatggtgttcgaccgatgcagctccaccccttgcccaagttgtggccctagatgccccaaacccctcaccgaagctcccactgtcctcggtgcgcttgatcgccccactccatggctgggatttatcactagagtatccccgacccgcccggttcttctcctctgcggtgaattagagcttactagtgccgctgcgtgtctgtccgccgcacctccacggcgtgcggctgatgcagctccaccccttgcccaagttgtggctctagatgtcccaaacccctcaccggagcccgcgttgtccttggtgcgctcaatcgccccactctgtggctgggattgctcgccagagtacccccaacccacacagttcttctcttctgtggcaaattagagcttgccggtgccgcacttccacggcgtccgatgaccgatgcagctccaccccttgcccatgttgtggccctaggtgtcccaaacccctcaccggagcccgcgttgtcctcggtgcgctcgatcgccccactacgtggctgggattgctcgctagagtaccctcgacccgcccagttcttctcctctgtggcaaattatatcttgtcgatcccactacgtgtcggtccaccgcacctccacggcgtccggctgatgcagctcgacccttgcccaagttgaggccctagatgtcccaaacccctcactggagcccgcgctgtcctcggtgcgctcgattgcccaactccgtggttgggtttgctcgctagagtacccccaacccgcctggttcttctcctctgcggtgaattagagcttgctggtgccgctgcgcgtcggtccgtagcacctccgcggcgtccggccgatgcagctccatcccttggccatgttgaggccctagatgtccgaaacccgtcaccagagcccgagctggcctcgctgcgctcgatcgccccactccacgtatgggattgctcgctagagtac

SEQ ID NO: 701 - DNA, 2106 bp, Zea mays
gggtcggccccgtccgccagcccgaaatccatcggtcgcaatgacaagaccctccgtgcggtgcccgagcggcgcacagcagatgcgccggacctgtcatcatggcggtacgagcgacgtgaccaacagagccgctgacattgtgctgcagcacgcatgcatgcaggagacttggcgcgccggcttacgacctggccacgcacacgacatgcacacatgcactagctaggcggcctccttgcagcatcggcgctaaacaaactcacgtaaataaaaacaaccagcggctgcatgcacacagatgaagcatgcatgcagtcgacagtcgccaccgacgcgcacttcccccgcgagcgatctcaagactcgatggatcgttgttgttcgcttggataagaaccagacaatttagggatagaaagcagagtggcgtatgtgtgccatgcatattgccacctggggcttctattaataaacttcccttgcatgcacaaagatggagcatgcatgcagtcaacgcactcgcaagtcgccagcgacgtgcgcttcccccgcgagagcgatctcaagactcaattgatcgttgttgttcgcttggataagaacggaacaaattagggagaggaagcggagtggcgtacgtgtgccatgcatattgccaccaggggcttctattaatatacttcccatggccttcagcgcgatagatctaaaaagactccctgttgttatagcttattatcattgcgcttaagtttgcttccagacagtcacacctcagtcgtgacccgcagttttatgtgagttttcttacgtacgtacccctctcttaccagtaaatgtgctagcttatatgtatatgtttttttgtgatttctttcattttttcttgtagatggaaaatatgacccaagatgagggtaggttccgctggtatccggatatagacactgtgttctgcaggggctgcatcgacttgcttgacagcggcatcataaagcagaggcaatccaccttggatgatacagctctagaatatttgtcggaaaaactttataaggtgacaacaataacaatttcaaataaaacactcataaatagatggaaccgtatgaaacagttgtatgatgaccatgttctgcatcgtatccactcttcaaacacgggggagacgaaaagccgcaagatgcatattaaaaaaacaaaggtattctctgtctctctttgattgaatccagattatatatattctaattatacgtttgtttcatttttagaaatgtggcaatgatttcaagcatatgataaatgaaccacctaagaatttggatctacttgagagattgtttcacgaacaagatgaagcgacaccgccacgacatgcgccattccagccaccgccgacgcccccaacacgtgcgctatcaaggacaccatcactgtccccgccagcgtcgctgtggcatgacatgtctccctccaaggtagacgtttatgtcatccaaaaacaactaaacgctttggcaaaaggatggatgccctgaaagaccaaatggatggcgttagcaagtcaaaatcttctcagtgtcgtgacagatgagtttttgatatgttgggctatttgcagccgagtagtggaatcaataattattcacttttgtgtgttcagattatccattaataaattttgtcatcgatcaccatgatatataggttcaaggaactttttcagtgttgtttcttatgattcctttatgtgtctagcttgcatgtttttacaatcggccatgataatagagatagaaaaaggggcaaaaaagaaagaaaagagggaagtggaataagaataaaaaaggagaaaataatgagtaaggaggaggaagaaaaaattaagcggtagaaatggagaaaggaggaagaagccacaggccttcgcctgcgcagcccctctcggagccgatgatgccggtgatcgtgcattgcgtaacacctcctgacctcaggcgccaacaatgatggtgatcctggtgtttgtggccggatcaggcgcatccgccggcgccatgtccgtgtgcgtacatggtggccgagttagtgcgcgcgtgt

SEQ ID NO: 702 - DNA, 2106 bp, Zea mays
caacaaaagtagcatgtgctagatcccttttgggttcagaaaatggagctgcacctgcaggtatttgatgagggtcacaacaaaaggatgaaggggaagagcgagacctcgctcatggaggtgaatagatgaaaccatgtaaccaggaggcggggtcggggcggggccagggcccctcggcacctagaatcagccactcaccatcatctagtaaaccacgctcgacaaggcctcgaaggtactcttgactcgtcaaggattggcgccagtccgtcaaagggagagcgacggaagacttgagtaagagaaggatgggccgagcgaagaagacaaggggtcgaggaattgaaaacaagatgaacaagacagggagggaggcgcgattaaataaaagtcgttctctgaaaccctgaccgcttggggctgacagaaaagacatgttggacaaggaagtaggcttggtccactggcgtgtcaggccacacgtcacgccaccacctcccgaagaaagactcaaagtaagtattcattcatgcaaggaggaacgacggtataaaaattgtacattagacacaggtctcccctgaactacatcattctttacataaaaggggtcccgagtctctagtaaactacaattttggactcgggggctgggtgtgaaacctagtgttcaaaagaaagaagcgaagaccgatgactaagaaaggagggaagcctgattgtccccccgtcttctttcttgatgcccggcacatcaatgagggtgactgccgtgcccgaaaaccaaaagatgatcaccggataaggcccctagggagcccactagatcaggtcctccgctgacacaatgccgcctacctcgcaggcggcctcgtcatatcccttgatcaggttctcaaagataatggatggggtgccctaaggaagcatcgctagggcacagaggtcaaccctagtgcgaaactaggcaacgactagggcgacggtgggcccacggtgaatgtcaaggtccacgacattcctaacgcgtatcggaatgttgagcaggcactacaggaaagttgctctacatgcatggatgctctaggtcacagaatcaacatcctagcgcagctccgccaactcggcctcctgccttgcttagagacaaaaaaacataagcctcagcgccttcggagtgaggggcgtactcaccgcacgggcctccatgatagttaatcgcgctagaagacctatggtacgagtgttggacgttcgtacgaccaattgagacgcctccagccgaccacgtagctcgcccatcgccaacagcggaagggccaaggacctgaccccgcaagacagcacatgaggggcagggaggaagaagcgatgaccctctatcataagataacacagtcaggttggggggccagcgccaaccaacctcacggccgtcacaagacgaccagcgatgaccggggcgccgacagtgccggccggtagaatcgacgatacaagcccgtcgtcacaaatactagccttcaattccctgtccggcgagctggaagatgaaagtgatatgacttcccctccaatgctcgagcccaccgccctgcaaggaaggtgaatcaccgatacaatggaacagcgggagatgagcgagtacctggtcactacccacctttcctacaacgggcggtgcttggaccgaccttagtgagagcattctagagccgaatgcttagcatgatccatgcccagccagcaggagaccgagaggttggaggtaacgaaaccctcccgactaaataccacttttggaaaacacgaggcgatgactagaatcaattggggcaagtacggagtggacccctacttatagcacccaactggttccaaaaagccagcagcggactttacgaatctcactcgacagtggcaagcgatgaaagggaataggacaatgtctggcccaccacatgtccaacccattatcagctcccaaagggagacactctcccctcaggggctcaggggctactgtcgaggaaatgatccccagttcttgggacccaccggtcagcgagcacactgggaaaggacccatggtctctatggcat

SEQ ID NO: 703 - DNA, 2106 bp, Zea mays
ttgggccgtgctggcccaagccaggcccatctgtgtgagccatgctggggtctgaagggccggaatttgaggcccggcccatacccgccttcggacagtgctagcctagtccatattattttgtgccgggttgtactatgggctctagtttttgggtcgtgctcgtactgcccaaaaagcctggcccatattcccagcactagatacgagcgccagaaagagagagtaggaggcgtgtagaagaagtatgttgactgtttgaacaaaggaggagaaatgacgaagaaatatccagatggagggcgccgcaggataaaggaaaagggaatttgtccactctaatttttctattatttcctcttttctctctttttaacacaatggatacaaaaatatcctatatctagaatcagggtttgaacgtgatgtaaatggctggctttgacattttaatctgtgatagattctcgacgaaactaaatcaattaacaattagtcgattttggatctatttaccttggtccaacatattttgcaccaataatttttaccaccgagttctaacaatatttgcttaagacaaaatcatatgacgaggtttgagcctccaaattcggtgttgcttacaccaattaatcctaagcgggcaagagactcgatatttcgtggaagaaacaaattctgaagtatgccagacggacgcaacatcgcaatcgtaaccccttcggaggcgacgtcatgcatcgtccacgtgggcgagaagatgtgcgctgtccacacataggtttgcacttgccacacgtcatgaaaccaggccacaagagagtcatgtgcttcgcatcgcaatcgtaaccccttcggaggcgatgtcatgcatcgtccacgtgggcgagaagatgtgcgcggtccacacatagatttgcacctaccacgtgtcatgaagccaggccacatagagtcgtgtgcttcgcagatgtgaaggattttgagatgaagtcaacggaaccggagtcggtttcaagggctaaagttttagatagattggatggaacgaatcaaaatgatactgacatcgatatttcagtcagtacttgactcagttgaaatcagacaaaagtttttccgatatttggacatgatttgatttggtaaatacttctggagtcaaatgattttttaccagttattattatctaaagatgtagatctgggtgagaaacacacggaccgaatcaacataatcgacgtcagtatttagactttattaaggaattcgaatggatttgttcgagcatgatgtaaactgaccagattaaaccgaatttggctccaatatattaaacaatgcttaatttattcgaaatcagacaaaaatcatcttatatctgaatagcttttatttctctgtcaggataacgtgctgagaaaaatcccgataatttttacccgatattcgacacttgatttctctgctttagacacttcactagaggacaatatgggtattaacccacacacgaatttcacggattacttgcgcgatccggattacaaaaagtcaagtgctcccaaatttgcatttgtctacttgagcaattcacacagtacagaactcgatgtctctggagattattaaacattgaactttgttaaacatttggaatagtccagatagacaaagatgaaggccatatcgaaatcaggataagcaaagatgattaggacatggagaccattattgacagctatctcatgcttaagtccacatctgttgtgaaacacaagacaaacacctggggtgttacataagtcaagatactagttatgcgagaggtatgggtagactactaggtattgttgagatgcctcgtttcatgcactaatgtaattttgtacctgagtatgacgtagacttgtctatatatgtggttatgttgaagggtttgctctaattaatcataaggcgttagagtattctaaatgtcaagaacatgataattgtagaagctaaaaattatagaagctaaataggaactaaattacttattgttgtttggactgcatgtccaattttaattatgcagtgaagtaaatcatgttttctgt

SEQ ID NO: 704 - DNA, 2105 bp, Zea mays
agaatctcggcacgatttttggctaacggacatcgggttgaagacgactctgtcagggtggccccatgtggcggtggctgaaagagcagaggcacgcggcgagggaatctaggcaatgggacccacgcgtcaaagtccccgcgtggtgaagagctagcgcgggtgtgggtaaagtgggccgcgcacaggagaagggatctagacgcgtgtgtggtagtgggctagggggaggaaaagccggtccatgacggtgaatcctgtgttttcttttcgttttctttttcctttctatttcaaatttcaaacactcaaatcaacttcaaatttaaattcctgtttgaactttagcttcagatattaaacacaaaatataatatgaataatgctcctactgcccgtcataatgtgtttgatttattatgattatcttatttaggtaatgaaatttacaccaaatttattacataggatattgtttggggtgtgtaatcaatttaaagatatatcccgaagttcatattcatttattttgattgaaatcattttccagtgtctaatcttcattaagacctgttttgaccaacattattttattataatcattctctttagagagcggtggattctaaagttcaattatttatcaaaggcacttattttgtatagtgtgataaaaaaattacaaagaatttcctcaaatcccaagttaggattttgggtgttacatgaagacgcgaagccaagtgtgcggacgcttacctatgggtctggccatctggggggcagtgtgccattttattttcatgcatcaataatttgcatggacaataacatgtgttcatttccatattctaggcaggtgcaaagggtctcctttttgcagtacacattttcatatcgaatttgtaagtgaggcttctaatgtcgaagtaaaaaccaattctaggtttttgtgctagatgcattaattcttggaatgatcaaaccaagcaccatgccagggaatggtttaggatatgcttgggaatgggtatacatttgtgctttcaaggtaccgaactgagtctcattcctcttttattccttttttttaagaatggtataaaatgcactaaagtgactcagttgctatgcccaaccattttgattgcgctcgacattcctttttgtggttcattccctggaccatctgatggtgtagtagaaagtggacatatttgggtttctctgggtcgtgctgctgaagcagggctgcaactcttaatctgctctcctacaccaatcttcggcaaagaggccatggagttgcatagaggagaatcaggctcgaaggtaattgttgcttgatatccttctacgtacaatggatagagggaagcctctccccaaggagtagctatagtactcctagaatcatcatgatgctggagctcttgctcttgcgcctttcatcacaaacaggaatatttctcatgcttccacctgtaatccagtacctctgacaactcttgcaaaaatatttggtagcttaatgttgtagttgttgtactaacaaaactttgtatctatggattccaatttggaggtcctgagggttatgtgaagatagaggattttctctagctccttcaggaccttcgctccactcgggacataacccgacctacaaattagactctgatatggatatttcatcattgctggttgtttgattttcacactcatcactgaaattgttaaggctagaactatttgcctgaccaccatataattcccgatatgtgcattgcttttcccacagacactcatgtcccctctatcttcacatacaccatgacaaatataagaagactaagtaaaacaaatgtatcatgaaagcaggaaataaaaaaacccggtcgggaaggaaaagaccgccctcccggtattatattaagaagagaccgaaacaatggtcccggccgagaaaatccccgaaccctggccccccatcactaacgggccggcgtcaactgtccactctgcaacggcccaaccggagggtggcgcacaggacatcgtaacccgagagcggatggggcacagcgaggggatttttttaacca

SEQ ID NO: 705 - DNA, 2104 bp, Zea mays
tgggcacattccaataactgaggtatgatgataactgagggatcggaggagaataattgagttagcccacaagaataactaaggtattggaacagaataactgagttctgtcgccataataactgagtgcatccattagaagaactgagttgttggaacggaacaactgagtaatgaacagataataactgagtagtgaacatggaataactgagtgtgcacaacagaataactgagtaatgaacaatagcataactgagttacttgaacgcaataactgactgtgaatagagaataactgagtaataaacaccgcataactgagtgggcacattacaataactgaggtatgatacaggataactgagggattcgagtagaataactgagtaatgtcacacgaataactgagtgcgtcgattagaataactgagtaatgaacgcacaataactgagtaacgaactgagaataactgagggatcagaaccgaacaattgagtgccaacaccagaataactgagtctgcacaccataatcactgagttagcccacaagaataactgaggtattggaacggaattactgagttctggcaccagaataactgagtgcgtccattagaagaactgagttgttggaacggaataactgagtcatgaacatataataactgagtaggcacattacaataactgaggtatgacacaggataactgagggattggagtagaataactgagttctgtcactcgaataactgagtgcgtcgtctagaataactgagtaatgaacgcacaatacctgagtaacgtacaaagaataactgagtgttgaacatggaataactgagggcgcgcattagaataactgagtaccgacattagaataactgagttaggaacatggaataactgcggtattataacataataactgagggtttagaataactgagttaagaacatggaataactaaggtattataacgaaataactgagggattggagtagaactgagttggcccacaagaactgaggcatgagcagagaataactgagttccatcactagaataactaggtgatgaacacagaataaccgagtactgaaccgagaataactgagaaatgaacatggaataactaagtgcgcccactagaattactgagtaccgactccagaataactgagacatgaacatggaataactgagtgcgcccactagaataactgagtcatgagcagagaataactgaggtattagaacggaataactaagggatcggagtagaataactgagttggcccacaagaataactgaggtattagtccagaataattgagtacgtccattagaataactgagttgttggaatgaaataactgagtggcgaacatggaataactgagttaatagaacgcaataactgactgtgaatagagaataacggagtccccactaccgagtgattacaaagagaataactgagtaatgagcagagaataagtgagtaggcacacgagaataactgagtcatcacaccagaataactatgtgcgcccattagaataactgagttctgacaaaagaataactgagtgacgaacatggaataactgagtcggcacatctcaataactgaggtattataacataataactgagggatcagaaccgaacaactgagtgccgacaccagaataactgagtctgtacacaataataactgagtgggcacattccaataactgaggtatgatgataactgaggcatcggaggagaataactgagttagcccacaagaataactaaggtattggaacggaattactgagttctgtcaccataataactgagtgcgtgcattagaagaactgagttgttggaacagaataactgagtaatgaacagataataactgaatagtgaacaatagaataactgagtgtgcacaacagaataactgagtaatgaacaatagcataactgagttacttgaacgcaataactgaatgtgaatagagaataactgagtaataaacaccgcataactgagcggtctcttatacacatctgacgctgccgacgactcgtgaagtg

SEQ ID NO: 706 - DNA, 2101 bp, Zea mays
tagcgaaaactttgaagcttttcgaagccctaaattatgtggtagatttacagaacgatccaacatgttgtttcacacgctccaccatcagctaaaattcaacaaaatgaataacttgagtatcggaccaacataattcgatggtcgcaagccgattaaagttcagtgttttaaagagtgagataactttagaagtatttgaattgctatatgcagatttttcaagataaactattttgcagagttacgacctcttttaatggaaaaatagttaatggaagaaaaattatatttccactttcattactcttttctaaatgtcgtactacaagacatacttgtttaggcatgttaccttaaaacatatataatgatatttgcaatgttcctcagttgtgaacacatcaacccaagtttaagaccaatcaaaacatgagtatgggactaatgagtattaatttcatataagtttactgcatgatatatcgatttctagtgtgcgtcaacttcgatgcattttgaagccctaaatgttgtattgtttagacatacagtatttacggatagacccaacttattgtttcgcacgcaccatcattaactaatgttcaagacaaccataacatgagtatgagaccctaaattgcagcatgcttgcactagatttggttatatgaaggatgaggtgactctagaagcgcttaaagcataacatgtagatttttttcagatcatcactttactatagacgtgagctatccaacatgttgtttcacatacttcatcatcaacccaagttcaagacaacctatagcatgagtttgggcccaagaaataagatgttcgaatgctggcactagagtttatagatatgaataatgagttaactttagaaatgtttaaagtgcattatgtatattttttagatcgataattttccagagttgagagctatatttttgcatttctgcctttattttgatccatgttttaagatactttgttattattctattatagttatacaatgatatttataacaaaagaattaaatatagaaaaaatttcattccaattttaattacaatttgctctatgcgagactataaacaatactagtttaggcatgctatcttaaaccatatgtagtgctattttatatatttcttggttatggacaacaatgcatgttttgaggccactcaaaaaacaagtatgggactcatgatatttactacaaaacaatttaaccaaagaaaattacattagaatttgctctttgccaaattgtaaacattacttgtttgggcatgttatctcataataaatgtggaaagatttcaaatgtttcatggttatggacattaatgtaagtttgaagacattcaaagccctaaatgatgtaatgtttagaatgaaagtttttacaaaaacgacccaacaaggtttgtcatcaaagttttcacaatacaatgacttgggagtaaagggtcatgatttcatgcatgttttctcgaaaagattgtggcatgaaccatgcgaaaactttgaagcttttcgaagccctaaattatgtggtagatttatagaatgatacaaaatgttgtttcacacgctccaccagcaactaaaattcaacacaatcaaaacttgagtgtgcgacccacataattagatggtcgcatgtcattaaagttcagtgttttgaagaataaggtaactttaaaagtatttgaattgtaatatgcagttttttaagataaacgattttgcagagttacgacctctattaaaggaaaaatagttaatggaagaaaaattatatttccactttcattactcttttccaaatgccgtactgtaagacatacttgtttaggcatgttaccttaaaacatagacaacctatttcatgagttcggggcccaagatattggatgttcaaatgctagcactagagtttgtaggtatgaagaatgaggtaactttataaatgtttaaagtgcaacatgtatattatttagaccagtaattttctagaattgagagcaatatttatgcaatttttcttttattttgatccatgttttaagattctttg

SEQ ID NO: 707 - DNA, 2100 bp, Zea mays
ccttagtgtggtaatgtgaccatattcagttcattcttcattcatctctcatcatgaaaccaaacaagagatggtgcagcttcaacccacttcaaccaagaaattgggttcaatcccgtcacttcaaccaaacaagatacgggtccaacccaacccacaaaattaggtcggtttcgacccaacccacctcgttccgaaaccaaacgcactagtattgaacccacgtcatgaggatcccctacacggtcccccatatagaggagagaggaaacaccccagggagcactattcgtcctatatttttatttcgtcatttatttatgatattaatcatgttcaagctgtataacatgataacaatgtgtattatggtagtacaaatactctataattttttaaaaaacttttaaaactgataaaaaatgttaaataatcgagttgtagtgtatagtgtagctggatatgaaaattgttgaagacactatatgtggaagaatgtatcctttagatgatgtaataaaatataatagaaagcacaacggggtaatatggatgaaatggttggagggctttacacgacaaccccagtcgcagtcgtcggtcatgtggcgctgggcctaccaggtctgatggaaagcgagagccaccccatcgaaacacctgcccagggcccattgatttgcggcttggcggtttgcaacaattgcgaaatggtcacgatctgatttaattttgaatagtacgaaattttagcccctcgattcttgcttctaaacatatcattagagcaactccaagagctgccgcatattaacgagaatagcatttttagcttccaaactccaccattctcacctccaagggactgctattcctttctcggctccccacaaaggcaacgatggatcccgcatatatgcgcgagaaaaactctccctaatcctgccgagcgcgctcaatcaagtagctttccgtgaatttttttccagctgcgcatagttttgttcgacgaaaggtgcgcggcggcggtagagacaccatcgtcgttggaggaatacattgttgttcttcactggagcggcgctggcggctcaaggccagttgcttcggacggtcaggatatggtgttcagcggcacacgtttcccccaattgcagatggtcgggattggagttcctagaggcagagttgaaccgcgaggtggaggtccaccacggccaccgatgtcagctcgttccagggacgattcggatccactagcagcagcgaccatggatttccaggcggctggtgatgaaattgtccccttcaatctttctgcagtggtagtcagggacgacggactgaaatctggctggtcctgttcgctacacctgcaatgcctctgctcggcgattttttgttaattccacacggagggtgtgggttaagcttggccttcaccatgagtcgtcatcctctagctgttggtatacgtctggtccttgtacaaggggataaagcttggtactgcgcgtgtcttgtatatggatttttcaagtgggagtggtttctgcaaagtgatatttaattgcctcatgaactgctagtctcttgtgcctagtttctcaagtaaaagttctaagaaatcgacaagactttatattcagactgatggttgatagaaatgacaacactagatatattattgcagacaatgggtattaatggttgatgatactaatcttgaagatttggataataataacaacgcatatgctgaccagcaatcccaatcaatgcaagtcaatcgtgcactctacaagaccaaaccataaaagatcaaagaattttagtgaccatgaagatgaagttttggtttcagcgtggctgaatattagtttggatcctgtggtaggcaaggataaaaaggtggaaggtattggtctcgtatctatgattatttccatgaacacaagacttgtgcatcaaagcgtatcataaattctcttatgcaccggtgggagaccataaaaaaagtgtaaacaagttctgtggatgtcttacatgtattgagttaagacgtcagagtggcactacaatgcaagacaaggtacatac

SEQ ID NO: 708 - DNA, 2100 bp, Zea mays
  misc_feature (558)..(559): n is a, c, g, or t
gtcccctaataaatttcgtgaaataaaatgacatactcgaccacgttggagtccattatcgtttagaaagccgtcattgataacaagatcaaggccgacttgatggggaccaacttattcacgaactaaatactcaaataatgtaatcccttttttgaatttgttgctttatttattacattaactattagctttaagtaagtacgaatgaccgtatataaagtttgtttttcttgaatattattattagttcattttttacggagacgtagaaagacgatcaaggtgccatcattgcactaggaccgaacagtgttgtgtgtggtgctgacgaccgcgccatactagtaccaaacatggatatggatcaatagagagcctaagagatgaagcaccagcactagcggctcgatcaaaagtcatttcctgctgcagcctttttcagatggagctagggagagcctctggcctctagcacgtacaacgagcttgaaagctctcgtgatctgctgtggctaggtgcaagaacaccagaaaagggaaaggctagcaagctannaccatcagtcctggatttcgactagagtgccatgccatatactagtactatgcatgagtttatataaaacctgctagagtttaacgatgagtacatgaaaaagtggagcggttcaggtggatcgcagagccaaaaaacgcgccccatatacatggagcaacggaggaggcgtgcgggctggcgccttgtgcatgcagaccatgcctgcatttagtgcgagtcttgcgtccactagttgaagaacgcgctctagtgcggcctatgtttggagagacacatacggttggcctgcagtagtgaccgcttctcatggtaagacgcgtgcatcatgtggcccaaatgacgagaggtgtagtttctaggcatgtcgtcgtctacttctatttatttaatgggtgctggcgctgtatgtagggatccatcaatgatgtgccatctagtgctatgagaaagtgtggtgctctggtaggagaaagctagcaagacgatgctcctgatactcacaagatagagttgtgtacatgtcttcttggtgagtgagagagagagagcaatagcacaagcctattgattttgtgagtcctgactattcatttatgtttgcagttcgtccgtgtgccaaatcttgctacaattgggtctgagtggtcagtttgaccaacatgcatgttattaattgcaactttctcgtggataagtaggtaacttttcgtctaacttttggcccacgagatcactaaaaaattgtctatagagaacaagttagtccacattattttatataggccatagttaaactaatctgcacctaactcttgtgtttactcttgagaagagtggatgtgacatgattcagggtttacccacatagcaaaatccaccggcatcaaaagtttctcacccaataagaacctagtaacctgttaaccacctattcatatagttaggcctcgtttggattagttaatctggacagcaactaaatcttgcattttagtctcttgttgattttatttttataaagtttcaagatctttatccttgaccaaatacaacaatttttgcaactcatcttcaagaaacaacatccactttttggcatttgtcgccactatttgtagtctaacaatttcatcatccttcttttgggcacccaattgcaactcatcaacattatgcaaaaactttttagcggctttagtaacctgctttacctctattttcttcctcttaatggtcccagtgtaatcttcttccattgtcttaagctggttccacacaaaattctttttttgcctgttgtgctgaattttcactgtcctctaatctcatgatcttggaagcttactttagttttcttatctcttacctaatatcttcctcacttttttggtgatctgaattgttgggactaaactttacttcatatattagtattgacaattcggatcccaaaaaattggagaagagattagggaagagattaaaaactaaagaaagcttactagatcctaagatgagagaagcacaatgaaatttca

SEQ ID NO: 709 - DNA, 2099 bp, Zea mays
aaagagctggattccggtagtgttgctcggtagctcggtgttgccgccgccaggttgcctgctgcccttgtggagcctgtttgtgggtcccgccgcccccaccgggtagcctcctgctctcgaggagtccgcccgcagatcccgctgccatcgctggggagcctatggctatcaccacctaggacgactttggccttcccaccctctcagacccactgttcgagctcgtcgggtgctcgttctcgagtgtttatccctgtcctgctttatgtagggccactctcttccgtagattagctgtcgtcgccaatgaaggcggccaataatgaaggtggccaatcttaaagctaacataggtctcgtggccactctcttctgtagattagctgtcatcgccaatgaaggcagccgatcttaaagctaacataggtctcgtctccaaccgtcgccatctgagttaccctctatcaccggccatatcatcgtcaacgatccttcctctttttagaccatgttgccaatgtcgccagatgctgttgcaaggagcaagttagacaagagttttgccttcaagaggtcggctcaggactgcatcacacatgatcaccaagttagctcatgcgagaaccccttccattgcatccgttggcgtcgccccagtcatcgagatgggcattgtcgcttttggtcttcctctcctgtcggtcgagttaactcctccgttcaatgtgatcatcatcaacaatcgaggacttgggctaaggtagtggccaagcctttgccatgtacgttgttagttgacgtcttcactaagtctccatcgcaaggatatcacaatcctctgtgagcttctcaacccatcattttgtgtggtaaggatgacgatcctgtctactatagctgttattgtgcctttcttgccttgacacctttgaaccttcagtccttgatcacccctttgacttgtttgaaggaagtgttgcaacctctcaatgaggaggcttctatcatcaagttgtgactagcacatgtagccaaccaattggagcatgtggaggcacatggggagcatgcttttgtcttcgacttgcccgagctctttggcacctattctccagtgaagcacgattcaccgtcgttgatccttgattctctcacatcggcttagatggctgtcgactccttggtgtgttaggacaccagtgcaaacaccacagtatttgtccttggcgagatgcctagaaggattactggtacatactttcatagatagacgtaccttgcccctaatgaggtggttgcaggggcttctaaagctgattctcgagaagaccattgaggtgccttcagagacctcaacattgcttcaggatgtcacctctatttaggatcttgctttggtggaggacgcatcagatgatgaggaagctactttggttgcacaaagtacatttgaggaccccatctatcttacaaccatcaaagacggtccttcacattctatggttgagaacaatacagaacctgtggtggtggaggacgcaacaaatgatgaggaagctaccttggttgtgcataatccttctctttgtttggttgacgacaatatagaacctcgactggtagaggatatgttgatactgacaaggtattcttcatccactagagctagtgacgatgaggaccttccatgctctcctttagctccatcctcacaatcgactacgacagttagacatgggcgtaagtcttataatagctcgtgtaacacctcaaaataatattttgagtaatctagagaatgtattttcaggatttaaagtttcatatgtgttataataaagaaattgaagaaactaaatgaaagcgaaaagatcttcatatgaactaaattacttctttgaataatatatctgagggacgttcttaaggaagtatggataaaattaccttttaatgaatgttacacattagaaattactcctttcttatttatggtttgtgtgttgaaagcataaattatactcttgcattcatgtgaagttttgtctgttcacttaaattagttgaacactatttgaatttatttcgaaattcgg

SEQ ID NO: 710 - DNA, 2098 bp, Zea mays
tttctgcaacacattccgtgtggctcaaattgaaatttcacggctccacaataacaacagtcaggtatttttcgcaatacattgtgtctatcgggcaacttatggtagacatagtcatatggatcttcggtatgactggagtacccaagcaggcgatatgattcaaatgcatcatctgggttaaaaaacaaatgcactatttgcagttattaaaaacagaaatgaaccatttctgggtaaaataatataaatcataatttatggttaccttctccatgaaattttggacttctagtatattcattatgttgagcaatattgaaatcatgtggtgatattggatgctctgatgtgtaaaccagacattagaaatgtgttaatgatgtatataccagtatatagcataaaagtatatacccatatgtaaccgtccagtttgaatgatgcaaacccccataaagaaaatgacccaaacaaccatttctcaaggatctataattattttctactcacacatatttagtaggaaaagaagtattagacagttaggtactatgtccttccaggcttggttgtgtaggctcaattaatacagtatcaaactctgtcaattcaggctcatgggtaggtgtgtcatggacaatatgttgtgtctgaattgataatggagcacctgatagagtgtctggcagcgtagaaagccatggtaagccttaagagaagacacattgatttttttttaatgattcacttgtgctcaccagttatcgtgtcatcttgtccacattgtctcaactttttgtattcacgtcgcttatgtagtagaatttctctatccacatcatccatattgatgtacctcgctcggttcattatgaggttgcccatggtagatgtagtagttgctgaagacaaacggaaatcaaataataaattatgtaagtagtaattataacaacgaattcctaccgtattgattataggttgaatgttgagaaatggttgaacatggttcccctgatgttggcagttggtgcaaagagcccctctcaccatcaggcgttaccggctctgccaccttcctgttattgtctccagtggttgtggtttgtattacgatcgaagatccagtagcataagcatgtgtttgtctgagcgagtatagtactgcaagaggaagaatgagtattagtaactaaaaaataggacgatgttaattctcggtaggaagtacctatgtcatccttcttcctcactcggtaatcacacattcttttatttctcgcctccctttcttcgttggtttcctcagcctttcttcttgcacgatattctcgttgttttctatccctctcctcccgatgacgctcatgttcatcggtcggacctggttgtggggccatatctgtatttaaaaaatgttcgacatcagtaataaataataaaatgaaaagactgtgttgcttggtttgattatgcatgaacctgtgataatttggttagatatattagtaagcgcagtctgtcggacgtaataatcattggtatgtagccgctccatgggatcacttggaccaattgagtccatatattgcaatccggatgcctgagaaattgttgaacatggcgtctcagcctgtgccacatgtgtgttgtcccctccgggagcttgcattaggatcaaagatccaaaaccataacgttgggactgtccgggcgagcatagcactacaatagacagatgaattattttttaaaaaacaatagaatgtagtataagatcataggggatacccgtctcagccttcttcctcgcggtaatcacgcatccttttatttcttgtctccctttcttctgtggtttcatcagcctttctccgtgcatagtattctctttgttttctgttcctctcctccctcttacgttcttcgtcatcggatcactggttgtgggggcagatttattaagatatttaaatagctcgatattatcagtattaaacgaagacatggaaacatatcagtatgaacctttgttattctcatttgatatatttgtaagtgcactccgtcccattttgtttggtgatcacaaata

SEQ ID NO: 711 - DNA, 2096 bp, Zea mays
tgcgaagtctcgtgggctcggagatgtgtataagagacaggtaatgtaattttccttggttaaattgttttgtgataaatatcatgagtcccatactggttttttgagtggcctcaaaacatgtattgttgtccataaccaagaatcattaaaaatagcgctacatatggtttaagatagcatgcctaaactattattatttatagtctagcatagagcaaattgtaactaaaattggaataaattttttttctatatttaattcttttgttataaatatcattgatataactgtaatagaataataacaagggatcttaaaatatggattgaaataaaagcaggattgcataaatatagctctcaactccgaaaaattaccgatctaaaaattatatatgttgcactttaaacatttctaaagttacctcattcttcatatctacaaactatagtgccagcattccatcatccaatatcttgggccccaaactcatgctataggttgtgttgcagttgggttgatgatgaagcatgtgaaacaacatgttgcatagctcacgcctatagtaaattgatgatctgaaaaaatctacatgttgtgcttcaagcgcttttagagtcacctcatccttcatatgaccaaatctagtgctagcatgtgacaatctagggtcgcatactcatgatatggttttcttgaacatgggtcaatgatggtgcatgcgaaacaacacattgggtccatccataaaaaatgtctgtctaaacaatacaacatttagggcttcaaaaagcattgaagttggcgcacattagaaatcgatatatcatgcagtaaacttgtacgaatataatatccattagtcccgtactcatgttttgatcggccttaaacatgggttgatgtgttcacaactaagaaacattgcaaatagcacaatatatgttttaaggtaacatgcctaaacaagtatgtcttttagaaaagacaaatgaaagtggaaatataaattttcttctattaactaattttccattaatagaggtcgtaactctgcaaaatagtttatcttgaaaaatatgcatattgaaattcaaatacttctaaagttacctcattctttaaaacactgaactttaatcagcatgcgaccatctaatttgtgggtcccatactcaagttattgattgtgttgaattttagttgatggtggagtgtgtgaaacatgttggatcattttgtaaatcgaccccataatttagggctttgaaaagcttcaaagttttcgcatggttcatgccacaatcttttcttgaaaacatgcaaaaaatcacgacgctttactcacaaatcagtgtattgcgaaaacattcataacaaaccatgttgggtccttttgtaaaaacaacagttctaaacattacatcatttagggctttgaaccgcttcaaacttacattaatgtccataaccatgaaacatttaaaagttttccacataccttatgagataacatgcccaaacaagtgatgtttacattttggcaataagcaaattgtaatgtaattttccttggttaaattgttttgtgaaaaatatcatgagtcacataattttttttagtggcctcaacacatgcattgttgtccataaccaagaatcatctaaaatagcagtacatatagtttaagatagcatgcctaaaatattattgtttatagtctagcatagagcaaattgtaattaaaattggaatgagaatttttctatatttaattcttttgttatagatatcattgatataactttaatagaataatatcaaagaatcttaaaacatggatcgaaataaaagcataattgcataaatatagctctcaactccggaaaattaccgatctaaaaaatatacatgttgcactttaaacatttctaaagttacctcattcttcatatctacaaactatagtgccagcattcgaacatccaatatcttgggccccaaactcatgctataggttgtcttgcacttgggttgatgatgaagcaattgaaacaacatgttgcatagctcatgcctatagtaaattga

SEQ ID NO: 712 - DNA, 2094 bp, Zea mays
atataataaaaccacaacgtgcctatgctacagacaagatatccgtcgcataatttttttatcaaaattctagaccttaacccctgacccgactactttataattctaaaaataattatatcaccacagaacagcacaccgacacaacaacggatctaaacataatcactaagcgcacctatgctaaataaaaaggatcgacacaacctacatatctatcaatccattaattaaaattaatatagtagcgaatcatctcacccatgattaaattcgacgcgaactctgcaagaaccacgatgatttatagttcaggcttttcgtcgagtacttggtgaatttcatgctgctagcttcgtcttcactcaactcttgagatttcttgatgacgcacggaacgacgacgagatcgagtatagagcaagctggtgaggtgtggtcgagcaggttagtgcgagctctggagaggacacgaatccagtgaggactccgacgtcggcaaggtcacgagctctagcgacacaaggtcaagcggcgaatgcgttcgacgtgcatacgtgagccgaaccaaaagcgaggaactgatgaagcgaagttcgtcgacaagcaccatggagaaattagcgacgttgttgcacacacgacgcgacgacgaacgacgacaaccggcatggagacccaacgcgattgaggaaggggttcgacgattcgacgacaccgacgaggtcaacgacgagccgaccaaaaaaactccatgacgtcgaccggcacacggaccagagaacggcggctggcgaaattcgagctagggaaaatggcgcacgaccatggcgaactggagcaggggccagggacgcggcggccatggcgagcctgaggctggaggagggtgccgacgctagcgagcagggatgcaaggtccgagcataggggcgagctcggggcgggcggcgaactgcgcgtgcaccagagaagagctcgcgccggagcggccagcggcgcagagggcggagcaccgctagaagaacataggaagctcacatcggcgtctggcaagcacacgccatggatggagcatgggggcgaggagaatgagagctgagtgaggcgagcgtccaggcgctagcagggagcaacgtcccgcgagagagaatgacgaggtgagagagagtgtccaagaagaaccgagaggcaaagaagatacgactggcacacttgtgcgttgcagaaatatcaaccaccggataggaacaaagatctggaatccacgtatgaagaaaaaatatcaatgcatatcaactgtgggagatgaggatcagagatattttcttttttttcaacaccgttatatgtatgagaacaaatatttggacacgatttgatttgatgactactccgaagtcagattaattcgtacccattatttttatttgaagatttagatcgagacaagaaacacatagactgaaccaaactgatttcagcttcaatattttagactatattgaatccagtcaaatttttacgagtctcacgtgctttcggtcatttgactacagaacgattcaattaatgagatgacgtattatttttctcgagcaacacgtaaacaaccagatccaaaataataccggcttcactacttcagatgatatttgatgcagctgaaatcggacaaatatttatctgccaattgaacctgtttgatttctttgtcgaggataatttgttggaaaccgaccatgattataattcctcagacacgatgtctcacttgacgagaagggactaaattatttggcactgaaaactttagtcgtggacttctaataaatctcgtttcggacaaagtcggaggactaaactaagtttctaaatttgtctttgcgtgagcggtgaatttcaaataatcaccaggctcgccgattttcgaaacagttatgttccgaacatcatgaaaatttaggacgagcccggatagataaaaataaaaacgatgtcgaactcgcgacagacaaaacagattaagacagagagcctgttattcaccgctatcacatgttaaagtctgcactcgtggtcgagcaggcgata

SEQ ID NO: 713 - DNA, 2093 bp, Zea mays
ctcagttattctaatgcgcgccctcagttattccatgttcaacactcagttattctttgtacgttactcaggtattgtgcgttcattactcagttattctagacgacgcactcagttattcgagtgacagaactcagttattctactccaatccctcagttatcctgtgtcatacctcagttattgtaatgtgcctactcagttattatatgttcatgactcagttattctgttccaacaactcagttcttctaatggacgcactcagttattctggtgccagaactcagtaattctgttccaatacctcagttattcttgtgggctaactcagttattatggtgtgtagactcagttattctggtgtcggcactcagttgtttggttctgatccctcagttattctatgtttgttactcagttattgtgcgttcattactcagttattctaatcgacgcactcagttattctactccaatcccttagttatcctgtatcatacctcagttattgtaatgtgcccactcagttatgttcctaactcagttattctaatgttggtactcagttattctaatgcgcgccttgagttattccatgttcatcactcagttattcgagtgacagaactcagttattctactccaatccctcagttatcccgtgtcatacctcagttattgtaatgtgcctactcagttattatatgttcatgactcagttattccgttccaacaactcagttcttctaatggacgcactcagttattctggtgccagaactcagtaattccgttccaatacctcagttattcttgtgggctaactcagtgattatggtgtgcagactcagttattctggtgttggcactcaattgttcggttctgatccctcagttattctcagttcgttactcagttattgtgcgttcattactcagttattctaatcgacgcactcagttattcgtgtgacattactcagttattctactcgaatccctcagttatcctgtatcatacctcagttattgtaatgtgcccactcagttatgcggtgtttattactcagttattctctattcacagtcagttattgcgttcaagtaactcagttatgctattgttcattactcagttattctgttgtgcacactcagttattccatgttcactactcagttattatctcttcattactcagttattccgttccaacaactcagttcttctaatggacgcactcagttattatggtgacagaactcagttattccgttccaataccttagttattcttgtgggctaactcagttattctcctccgatccctcagttatcatcatacctcagttattggaatgtgcccactcagttattattgtgtgcagactcagttattctggtgtcggcactcagttgttcggttctgatccctcagttattatgttataatacctcagttattgcgatgtgcgactcagttattccatgttcgtcactcagttattcttttgtcagaactcagttattctaatgggcgcacatagttattctggtgtgatgactcagttattctcgtgtgcctactcacttattctctgctcattactcagttattctctttgtaatcactcggtagtggggactccgttattctctattcacagtcagttattgcgttctattaactcagttattccatgttcgccactcagttatttcattccaacaactcagttattctaatggacgtactcaattattctggactaatacctcagttattcttgtgggccaactcagttattctactccgatcccttagttattccgttctaatacctcagttattctctgctcatgactcagttattctagtgggcgcactcagttattccatgttcatgtctcagttattctggagtcggtactcagtaattctagtgggcgcacttagttattccatgttcatttctcagttattctcggttcagtactcggttattctgtgttcatcacctagttattctagtgatggaactcagttattctctgctcatgcctcagttcttgtgggccaactcagtt

SEQ ID NO: 714 - DNA, 2092 bp, Zea mays
gtatgtatttcagaaccctgaatcagcatcatcgtctcaaaagatgagaccagacagtgttgttgttgatattactgctgacaagcataaggcggcaagcacctgcagtgagcaacaagaaggtggttcaaactgtgaccccaaacaacaacattcaagtgaaggccagcaaccccaaccccccccttcttattgccaggtggtggcctgcagcaagcccaataataatccctctgatgtgtcgcagtcgcagtcgcagtcgcagtcgcagtctgtcttgtttggatcatttggatcgttgaggccccttcctcctgtcgtgcagacccccgcagcagctgatgcacgctgcggccgagacatcgcttttgggccattctcttcactggtggtggagggtcgtgcttcacccatggcaacaccaccagctggctcctcctcaactccttttgtgaagacctctccaatgtgggcacacatcgaggctatggaggttttccgcggggcgctgccgcgttggcaaccaagcttcttcaacaggtggcagcagcatgccccggagctccgcgaagggatggccttaggtttgatgttatctttcgccaacctagctgagagcttgaggaggctgagcatagaggacggcgacacagtcttggaggagaagatgaaggccctcgcttcgctggaagctgaagggttcgacgtggagcacctcaagtcacggctcgacaccttgctagatataaagaggagccatgccaggctgcaatgcacagttgaagacctggagaagaggccattcagtcgccaacagatcgccgtgctgagtaccacagtccgtcatctcgagcagcaggcgcacttcctccgccacgtgatgcggtccactatctcgcaggaggtatgtgatgcatcggaggtctgcagcatgaaagcacaagtgcgcgagctggagcagcgcttcagcagcactgtgcttggtgaatgagtgagttagctagctagctagctgctgctagtccctgcacgcgcgcgcgtgccttttgtgtaataaataaaaatgaacacgtacacggtgttcagacagacactctagcttgtactcctaagacttgggaactcctctcttgccagtttataaccccctactataaaacaatgcagaataatacaaacaacacaactagatgcagggacattcagcccaaactagtataaaattgtgtcctttttgcacaccattcgttccaagatgtgcaaagcaccataatcatcacttgtcggtggtatggtacaaaacaccgatagatgtctaaatgctccatcttcatactgcacctactctatgcagttttgtaccttgacttaaaattttagttggcgcctttaaaatcctgtttggccaaaacacaaaataacaaagttgatcctcacaaaattatctctaactttggtgtagaatgtttttgtcatatatttctctatttgcaccatgtttcatatttttactgagaggtcagatttgtagttcttaagatagataatatttgagtttaggttgtagttcttaagatagatatctttatagaaaactttctgcatttgacttggcaccaatttcatgtcctacacgtttgttgtataacatttaaaatcatttcaatcagaaagctgtcacttttatgtttttggtttggttacccaattgtcatcacaacttgatatgcatatgagatgagataaattataatcctcttatatcatcatgatcctttgtttatagcttacatcacatttggtggcatatatccatgattattccaaattcctactaagttgggcgttgatcaaggaattaaggcaattttggggtgtgatttctgatatagaaccattttttgccataatttccatgatgtcttgaaggggcaatcaaggtattggtaggcgaccctcaatcggactccaatgccacccaccatagaaggcttcattttggtgggacgaagccagaggaagaaataatattggaacattggaaagattgggggattccgaggtaagcttcacacaaacaattatgactcat

SEQ ID NO: 715 - DNA, 2090 bp, Zea mays
tgtttcacacgctccaccatcaactaatattgaaaacaatcaataacgtgattgtgggacccacatagttagatggtcacatgccgattaaagttcagtgttttaaagaatgagataactttaaaagtatttgaattgctatatgcagatttttcaagataaactattttgcagagttacgacctctattaatggaaaaatagttaatggaagaaaatttatatttgcactttcattactgttttctaaatgtcgtactgtaggacatacttctttaggcatgttaccttaaaacatatatagtgctatttgcaatgttcctcagttgtgaacacatcaacccaagtttaaagccaatcaaaacatgagtatgggactaatgagtattaatttcatataagtttactgcatgatatattgatttctggtgtgcgtcaacttcgatgtattttgaagccctaaatgttgtattgtttagatagacagtttttatggatggacccaacttattatttcgcatgcaccatcattaaccaatgttcaagaaaaccataacatgagtatgcgaccctagattgctgcatgcttgcactagatttggtcatatgagggatgaggtgactgtagaagcgcttgaagcataacatgtagattttttcagatcatcactttactatagacgtgagctatccaacatgttgtttcacatgcttcatcatcaacccaagtgcaagacaacctatagcatgagtttggggcccaagatattggatgttcgaatgctgtcactagagtttgtagatatgaagaatgaggtaactttagaaatgtttaaagttcaacatgtatatttttaagatcggtaattttccagagttgagagctatatttatgcaatttttctttcattttgatccatgttttaagatactttgttatttatctattacaagtatatcaatgatatttataacaaaagaattaaatacagaaaaaaatttcattccaattttaattacaatttgctttatgcgtgactataaataacattagtttaggcatgctgttttaaaccatatgtagtgctattttgaatgattcttggttatgaacaacagtgcatgttttgaggccacccaaaaaacaagtatgggactcatgatatttatcacaatacaatttaaccaaggaaaattacattacaattttctcattgccaaactataaacatcacttgtttaagcacgttatctcataagatatgtggaaagatttaaatgtttcatggttatggacattattgtaagttagaagcggttcaaaggcctaaatgacgtaatgtttagaacgtcagtttttacaaaaatgacccaacaagatttatcatcaatgttttcgcaatacactgattgtgagtaaagtgtaatgatttcgtgcatgtttttttgaaaagattgtggcatgaaccctgctaaaactttgaagcttttcaaagccctaaattatttggtagatttacagaatgatccaacattttgtttcacacgctccaccaacaactaaaattcaacacactcaataacttaagtatgggacccacataattaaatggtcgcatgctgattaaagtttagtgttttaaagaatgaggtaactttagaagtatttgaattacaatatgccaatttttcaagataaactattttgcaaagttacgacgtctattaatggaaaaatagttaatggaagaaaatttatatttccactttcatgactcttttctaaatgtcgtactataagacacacttgtttaggcttgttaccttaaaaacatatatagtgctatttgcaatgttcctcagttgtgaacacatctacccgagtttaaggccgatcaaaacatctgtatgggactaatgggtattatattcgtacaagtttgcagtatgatatatcgatttctgatgtgcatcaacttcgaagcattttgaagccctaaatgttgtattgtttagacagacagtttttacagatggacccaacgtgttgtttcgcatgtaccatcattaactgtggacaagttgtcgcgg

SEQ ID NO: 716 - DNA, 2089 bp, Zea mays
ttctttaaaacactgaactttaatcagcatgcgaccatctaatttgtgggtcctgtacacaagttattgattgtgttgaattttagttgatggtggagcatgtgaaacaacatgttggatcattctgtatatctaccccataatttagggctttgaaaagcttcaaagttttcgcatggttcatgccacaatcttttcttgaaaacatgcaaaaaatcacgacgctttactcacaaatcagtgtattgcgaaaacattcataacaaaccatgttgggtccttttgtaaaaacaacagttctaaacattacatcatttagggctttgaaccgcttcaaacttacattaatgtccataaccatgaaacatttaaaagttttccacataccttatgagataacatgcccaaacaagtgatgtttacattttggcaataagcaaattgtaatgtaattttccttggttaaattgttttgtgaaaaatatcatgagtcacataatttttttagtggcctcaacacatgcattgttgtccataaccaagaatcatctaaaatagcactacatatagtttaagatagcatgcctaaaatattattgtttatagtctagcatagagcaaattgtaattaaaattggaatgagaatttttctatatttaattcttttgttataaatatcattgatataactttaatagaataatatcaaagaatcttaaaacatggatcgaaataaaagcataattgcataaatatagctctcaactccggaaaattaccgatctaaaaaatatacatgttgcactttaaacatttctaaagttacctcattcttcatatctacaaactctagtgccagcattggaacatccaatatcttgggccccaaactcatgctataggttgtcttgcacttgggttgatgatgaagcaattgaaacaacatgttgcatagctcacgcttatagtaaattgatgatctgaaaaaatctacatgttgtgcttcaatcacttttagagtctcctcatccttcatatgaccaaaactagtgctaacatgcgacaatctaaggtcgcatactcatgttatggttgtcttgaacatgggttaatgatggtgtatgtgaaacaacacgttgggtccatacataaaaactgtctgtctaaacaatacaacatttagggcttcaaaatgcatcgaagttgacgcacattagaaatcaatatatcatgcagcaaacttgtacaaatataatacccattagacccatactcatgatcggccttaaacttgggttgcagtgttcacaactgaggaacgtttcaaatagcacaatatatgttacaaggtaacatgcctaaacaagtatgtcttttagaaaagagtaatgaaagcggaaatataaattttcttccattaactatttttccattaatagaggtcgtaactctgcaaaatagtttatcttgaaaaatctgcaaattgcaattcaaatacttttaaagttacctctttctttaaaacactgaactttaattggcatgcgaccatctaattatgtgggtctcatactcaagttattgattgtgttgaattttagttcatggtggagcgtgtgaaacaacatgttggatcattctgtaaatctaccacataatttatggctttgaaaagcttcaaagttttcgcatggttcatgccacaatcttttcgagataacatgcacgaaatcatgaccctttactcacaaatcagtgtattgcgaaaactttcatgtcaaaccttgttgggtcctttttgcgaaaactaccgttctaaacattacatcatttagggctttgaaccgcttcaaacatacattaatgtccataaccatgaaacatttaaaaaatttccacatattttatgagataacatgcccaaacaagtgatgtttacagtttggcaatgagcaaattgtaatgtatttttccttggttaaattgttttgtgataaatatcatgagtcacataattgttttttgagtggcctcaaaacatgcattgttgttcaaaaccaagaatcatttaaaataacacttcatatg

SEQ ID NO: 717 - DNA, 2082 bp, Zea mays
gcctatgctacagacaagatatccgtcgcataatttttttatcaaaattctagaccataacccctgacctgactactttataattctaaaaataattatatcaccacggaacagcacaccgacacaacaacggatctaaacataatcactaagcgcacctatgctaaataaaaaggatcgtcgcaacctacatatctatcaatccattaattaaaacaaaataatatagtagcgaatcagctcacccatgattaaattcgacgcgaactctacaagaaccaagatgatttatagttcaggcttttcgtcgagtaattggtgaatttcacattgctagcttcgtcttcactcaactcttgggatttattgatgacgcacggaacgacgacgagatcgagtttggagcaagctggtgaggtgtggtcgagcaggtttgtgcgagctctagcgaggacacgaatccagtgaggtctccgatgttggtaaggtcacgagctctagcgacacagggtcaagcggcgaatgcgttcggcgtgcatacgtgagccgaaccaaaagcgaggaaccaatgaagcgaagttcgttgataagcaccatggaggaatcagcgacgttgttgcacacacgacgcgacgatgaacgacgacaaccggcatggagacccgacgcgattgaggaaggggttcgacgattcgacgacaccagcgaggtcaacgccgagccgaccaaacaaaactccatgacgtcgaccggcacacggaccagagaacggcggctggcgaaatccaagctggggaaaacgacgcgcgaccatggcgaactggagcagggtctagggacacggtggccatggcgagcctgaggctggaggagggtgccgacattagcgagcagggatgcaaggtccaagcaaaggggcgagctcggggcggccgacgaaccgagcgtgcacctgagaagagctcgcaccggagcggccagcggtgcagagggcggagcatggccagaagaacataggaagctcacatcggcgtctggcaagcacacgccatggatggagcatgggggcgaggagaatgagagctgagtgaggcgagagtccaggcgctagctgggagcaacgtcccgcgagagagaatgacgaggtgagagatagagtgtacaagaagaaccgagaggtaaagaagatacgactggcacacttgtgcgttgcagaaatatcaaccaccagataggaacaaagatctggtatccacgtatgaagaaaaaaatatcaatgcatatcaactatgggagatgaggataagagatattttcttttttttcaacaccgttatatgtatgagaacaaatatttggacacgatttgatttgatgactactccgaagtcagattaattcgtacccattatttctatttgaagctttagatcgagacaagaaacacacagactgaaccaaactgattttggcttcgatattttagactatatttaatccagtcaaatttttacgagtctcacgtgctttcggtcatttgactacagaacgattcgattaatgagctagcgtattatttttctcgagcaatacgtaaacaaccagatctaaaataataccggcttcactacttcatatgatatttgatggaactgaaatcggacaaatatttatctgccatttgaacctgtttgatttctctgtcgaggataatttgttggaaaccgaccatgattataattcctcagacacgatgtctcgcttgacgagaagggactaaattatttggcactgaaaactttagtcgtcgacttctaataaatctcgtttcggacaaagtcggaggactaaactaagtttctaaatttgtctttgcgcgagcgatgaattttaaataatcaccaggctcgccgattttcggaacaattatgttccaaacatcacgaaaatttaggacgagcctagattgataaaaataaaaacgatgtcgaactcacgacaaacaaaacagattaagatagagagactgttatttaccgctatcacgtgttaaagtctgcactcgtggtcgagcagacgata

SEQ ID NO: 718 - DNA, 2082 bp, Zea mays
attgtctcgtgggctcggagatgtgtataagagacagggttatgaaggtgagtaagtaatgtacgacgctctcatttggcctgacatccgcaaggctctcgtgctcatggtggacggcgaggaacacgctggttcagtcatctacgcagctcagcatatggaagttgacgctaacggaatctcacatattccgctcgcgttattcctcgattcggctggtggaaacatcggctatatcgaccgtgccgaccgtgtgctgattgaggtttacgcgccgggcgagcttgcaaagaagatcctcgaaagcatcatcacctcattgtgtggtgacggcatcgaggggcctgacgtgttcttcgattccattcagtgcatcgtcccgcctactgaatcgccttacccgcaagacactctaaatctagcaacggcggtcattgagactatcgttcgcccgctcgactagtcgcccacctttcaccccactcggggtttctccacattgacaccctcgaaaggggttatttgctatgtccacagtagaaactgagcgcaaggacttcgactcccgcgcactcgttcggaaaactacggtaggtctcgcgtgctttgcacctaagactgtcgagcttccggctaccctccttacttctgcaaccgaaatcgcagacctgtccacgctgggcttcattcccattggcatggttacccgcgacggttacacgttctccggcgagatcgaaaaggaagacattgacgcacttggctattacagcccggtccgctcggatgttacccgcgtaccgcgcaccgtttccatgacgcttcttgaatccggcaaaaaggccattcaggaactcgtgcgcggtacgaagatcaccgaaacgcagtctgctacgactggtgaagttgtcttcgatgagccagacctcccgaacttcgatgaagtccgcctgatcgtagtatccgctgacggcccactgtccaatcactggatcgaggggcgcggattcttcgccgcaaagatctcatcccttggcgaagagacgtgggcgcatgaaggtgctcaccagcgccaagtgacgttcgacatcttcaatgatgacgtcgagggcgtcccggttcgccattacttcggcggctccggcgcgattctcgctaaggacattctgggatacacccagggcgcctaacccctagttgtggcgcgcacgtccttgggcggctcgtgcgcgccgcttttcattgccgccccacgaaaggtagtcatgcctactttttccaatggtgcccaaaaggtcaccgtaagcaagccaacccgcgcagaaattcagcgactcaaggcacttggattctttgaagagaagcccgcgccaatcgttgaagccaagccagtaaacccatctaagtaaaggagccagtcatggcagccgcccgcaagatttcagataagccagcaccacgtcacaccatcggatccattatcaaagacggcgaggacgttgagccatatgtgctcgtgctcgccgatgggtcagagatcacctttgtttctccggaagaactcgaagctgagtcaggtgttcgactgctccgagctgcgacgattcgcccgcatgagttgtgggagattcttggtgaatggcttcccgaagaagagcttcgattgattcgcaagcagaaattcacgcttggtcagattggcaagattctcgccgctgtcaagactcactttgaggacttcttcggcccctcgggaaactagaacgcctcgatgcgctcttagaacggtttaggccagagatccgcgccgatctcgcacatgagtacggcgtggatctctcattgttctatcagcgccgcaggtacgtggcattgctggatctcattgatcagctcccgcgcacctcgcgttacttcgaggcgatgtccaaggatcctgagtttattcaggcgcgtctagagattgaagaatctcgcaccgacgacgaagaggataacactccagagtggcatccaagcatcacagagtttggactcactgagcagctacttcgcgagcttctgcactcaatccaagagggc

SEQ ID NO: 719 - DNA, 2081 bp, Zea mays
tcaaattttccgcaatgcactgatttgggagcaaaaggtcatgatttcgtgcatgttttctcaaaaagattgtggcatgaaccatgcgaaaactttgaagcttttcgaagccctaaattatgtggtagatttagagaatgatccaacatgttgtttcatatgctccaccatcaactaaaattcaacacaatcaataacttgagtatgggacccacattaacccatgttcaagacaaccataacatgagtatgtgaacctagattgtcgcatgctagcacaagatttggtcatatgaaggatgaggtgactctagaagcacttgaagcacaccatgtattttttaagatttggtcatatgaaggatgaggcgtttgctatccaacatgttgtttcacatgcttcatcatcaacccaagtgcaagacaacctatagcatgagttaggggcccaagatattggatgttcgaatcatggcgctagagttgtaggtatgaaggatgaggtaactttagaaatgtttaaagtgcaacatgtatattttttagatcggtaattttcaggaattgagagctatattttgatcggtaattttgattattctattacatttatatcaatttataacaaaacaactaaatatagaaaaaaattcattccaattctaattacaatttgctctatgcgagactataaacaatactagtttaggcatgctatcttaaaccatatgtagtgctattttatatatttctcggttatggacaacagtgcatgttttgaggccactcaaaaaacaagtatgggactcatgatatttattacaaaacaatttaaccaaggaaaattacattacaatttgctctttgccaaactgtaaacattacttgtttgggcatgttatcttataagatatgtggaaagatttcaaatgtttcatggttatggacattaatgtaagtttgaagccctaaatgatgtaatgtttagaatgaaagtttttacaaaaacgagccaacaaggtttgtcatcaaagttttcgcaatacaatgatttgggagtaaagggtcttgatttcgtgcatgttttctcgaaaagattgtggcatgaaccatgtgaaaactttgaagcttttcgaagccctaacttatgtggtagatttatagaatgatccaacatgttgtttcacacgctccactagcaactaaaattcaacacaatcaaaacttgagtgtgggacccacattattagatggtcgcatgccgattaaagttcagtgttttaaaaaatgaggtaactttaaaagtatttgaattgtaatatgcagatttttcaagataaacgatttctcagagttacgacctctattaaaggaaaaatagttaatcgaagaaaaattatatttccactttcattacgcttttccaaatgtcgtactgtaagacatacttgtttaggcatgttaccttaaaacatatatagtgttatttgcattgttccttagttgtgaacacatcaatccaagtttaaggccgatcaaaacatgagtatgggactaatgggtattaatttagtgcaagtttactgcatgatatatcgatttctgatgtgcgtcaactttgattcattttgatgtcctaaatattgtattgtttggacagacagtttttatggatggatccaacttgttgtttcgcatgcaccatcattaacccatgttcatgacaaccataacatgagtatgctacactagattgttgcatgctagcactagatttggtcagatgaaggatgaggtcactctagaagcgcttgaagcataacatgtacattttttcagataatcaatttactataggcgtgagctttccaacatgttgtttcacatgcttcatcatcaactcaagtgcaagacaacctatagcatgagtttggggcacaagatattagatgtacgaatactggcactagagtttgtagatatgaagaatgaggtaactttggaaatgtttaaagtgcaacatgtatattttttagatcggtaattttccggagttgagagctatatttatgcaattctgc

SEQ ID NO: 720 - DNA, 1968 bp, Zea mays
ctgtaacacccaggtgtttatattttgctcgacaacgagtatggatttaagcacgtgatatcagtaaataaaacggacactaaattttaatcatcttgcaaaagttcgagtttggtgccgttttcatttcgataatttacacaattaaaaagggttcgagaaacttttggattatcgaatcttcgtttgctggcgaattttgaactgtttggatcgcgcgcgtaagtgaatacgaaaatcagaagacttctgattttatgtaaatttggagccccgcgctatccgaaaagaacaatgcgcacagcttctcgcccacatgtgcaatgtgtgacgtcgcttccggaaaggatcgcactttcgatgacgcatcgatctcgcgtacttatttcgcgaaatgtgagtctcgtgtctatttaaaaattatggattaagagaaaatgagattggaaatttagttcagctctccaatttcataccaaacagatttgatataactcaacgactaagttttttgtgtaaaataatttagtcctcttttgtcatccgtgacatcgcgtctatggatttttaattaaattgttctctaattgagtgttcgaatagcgaacggaatttgtctaaaatcaactgaatcaaatgcagattgaaataccgaagccgaatccgtttaatttagtctgttgcttttcgcctcgatttaaatcttcaaaagtgaattaacagtacgaatttatccgagttcagagaattcgccaaatcaaatcgaatccaaggatttataattgagatctgattctctaataaattctctatggtagagaaatcccatttctctcttatcctctacgtgcttatcccttctgtttcttagccgtaagttaatttctttggaaattttatccatcgctcatctccttgctttctccttacacgagcatttcttgggagttaagcagctgatcaggatttctccacgttatcttctccttatccccaccgctccttctctctcctctcgatatttcctgcgcgcgccgctcggctctggtgaaagaaaatcccgccgcccctgttgatcttttcagccgtcgcgggataaaaattgcgcgcacccggccagagctcctgcgcgccttcttctctgctggctcggccccttccccgcgcgctcgtgctcagcctccggtggaatctcctcgccgtctcctgctgcgctcggaccgcgcccctggcttcccatgcccccccccctcccccggctctgttgccgcgcgcaaccgcgcttctcccagcctccatgcgctagcgcgcgtcgttctccctgcgctcgctcggccttgaagctccctgacgcgcgctcctgtgccatggacccatggtcgccgtggagcttccccagccgcgccctgctcgcccctgttttcctttctctctctcccctgtgcgcagctcgccgagctctccctctcccatggcgcgctctgctctctgcgcgcagtgtgcacgtcgcgatctcccaagcttgccatggctgccgcatccatggtcctgctcagatttcgccaagccccagtgcccggctgctcggctcctcaacggcgacgatggtcgcgctcgcccagctcgcagagctcccttgtcgtggtcgtcgcgtccctgcgcccagcctctagctcagtccctgtgcgcgcgagctcgccggtgtgctgctgttctaactcggatctcgcccatgaccgccggtgttcgccctcttgcgtcgcgcagcggcccatcctgctcaccgtgaccgagcggtcgccctggtgtccttcccaagccaactcgccctgcgctgacgcagggttcagctcagccctgtccttcacgctccctactcgtcctcgactctctggtgtggactccctccgtcggcgatctcctctggcaccagctcgcgcgtctgctcgtcgtcaccgcgacgcggac

SEQ ID NO: 721 - DNA, 2081 bp, Zea mays
tctggtgcgcaataccagctacagaatggggcgatcgagcacactgaggacaatgcgggctctgatgaggggtttgggacatctagggccacaacttgggcaaggggtggagttgcattagccggacgtcatggaggtgcggcggaccgacgcgcagcggcaccgccaagctctaattcgccacagaggagaagaaccgggcgggtcggggtactctagtgagcaatcccatccatggagttgggcgatcgagcgcgccgaggacagcgcgggctcctgtgaggggtttgggacatctagggccacaacatgggaaaggggtggagctacatcggtcggacgccgtggaggtgcgatggaccgacacgcagcggcactagcaagctctaatttgccacagaggagaagaaccgggtgggtcgggggtactctggcgagcaatcctagccacagagtggggcgatcgagcgcaccgaggacagcgcgggctccggtgaggggtctgggacatctagggccacaacttgggcaaggggtggagctgcatcggccgacgtcgtggaggtgcggtggacctacgcgcagcggcaccggcaagctctaattcgccgtagagttgaagaaccgggcaggtcgggggtactctagcaagcaatcctagccacggagtggggcgatcgagcgcatcgtggacatcacgggctccgttgagtggtttgggacatctagggccaccacttgggcaagaggtagagcggcatcagccgaacaatgtgaaggtgtggcagacggactagcagcggcaccggcaagctctaattcgctgcagaggagaagaaccaggcaggtcaggggtactctagcgagtaatgctaggcatggagtggggtgatcgagcgcatcgaggacagcgtgggctccggtgagaggtttgggatatctagggccacaacttgggcaaggggtgagctgcatcggccggacgccgtggaggagcggcggaccgacgcgcagaggcaccaacaagctctaattcgctgaagaggagaagaaccgggcgggtcgggggtactctaccgagcaatcctagccacggagtcgggcgatcaagcgcaccgaggacagcgcgggctccggtgtggggtttgggacatctagggccacaacttgggtaaggggtggagttgcaccggccggacgctgttgaggtgcggtgtaccgatgtgcagtggcaccggcaagctctaattcgctgcagaggagaagaaccgggtgggtcgggggtactctagcaagcaatcccagccatggagtggtgcgatcgagcgcacagaagacagtgtgggctctagtgaggggtttggtacatctagggccacaacttgggcaagggtggagctacattggtcggacgccgtggaggtgcgacggaccgacggcagcggcattggcaacctctattttgccgcagaggagaagaatcggtaaggtcgagggtactctggcgagcaatcccagccacgaagtggggcgatcgagtgcactgagggcagtgcaggctccggtgaggggtttgggacatctagggccacaacttgggcaaggtgtggagatgcatcggccggatgttgtggaggtgcgacggaccgatacgcagtggcaccggcaagctctaattcgccatagaggagaagaaccgagcggctcgggggtactctagcgagcaatcccagccacgaagtggggcgatcgtgcgcaccgaggacagtgcgggctccagtgtggggtttcagaaatctagggccacaacttgggaaaggggtggagctgcatcggccagacgccgtggaggtgcggcggaccgacacgcagtggcaccggcaagctctaattttccacagaggagaagaaccaggcgggtcaggggtactctagcgagcaatcccagccatggagtggggcgatcaagtgcactgaggacaacacgggctccagtgatgggattgggacatctagggccacaacttgagcaaggggtggagctgcatcggctggacgccgtggaggtgcggcggaccgac

SEQ ID NO: 722 - DNA, 2081 bp, Zea mays
gtaaagtgatgatctcaaaaaatctacatgttatgcttcaagcgcttctagagtcacctcatccttcatatgaccaaatctagtgctagcatgctgcaatctagggtcgcatactcatgttatggttttcttgaatatgggttaatgatggtgcatgcgaaacaataagttggatccatccgtaaaagtgtctgtctaaacaatacaacatttaggttttcaaaatgcatcgaagttgacgcacataaaaaatcgatgtatcatacaataaacttatatgaaattaatacccattagtcccatactcatgatttgattggccttaaacttgtgttgatgtgttcacaactaaggaacgttgcaaatagcacaatatgtgttttaaggtaacatgcctaaataagtttgatgtgtacaacatttataaaagaataatgaaagtggaaatataaattttcttccattaatagaggtcgtaactctacaaaatagattatcttgtaaaatctgcatattgcaattcaaatacttttaaagttacctcattcttgaaaacgctgaactttaatcggcatgcggccatctaattatgtgggtcccatactcaagttaatgattgtgttgaattttagttgatgcagcatgtgaaacaacatattgtatcattctgtaaatctaccacataatttagagcttcgaaaagcttcagagttttcgtatggttcatgccccttgtactcacaaatcagtgtattgcgaaaactttgatgacaaaccttgttgggtcctttttgtaaaaactaccattctaaacattacatcatttagggctttgaaccaattcagacttacattaatgtccataaccatgaaacatttgaaaattttccacttatcttacgagataacatgccaaagaagtgatgtttacattttggcaatgagcaaattgtaatgtaattttccttggttaaattgttttgtgataaatatcatgagtcccatactttttttagtggcctcaaaacatgcattgttaaccataaccaagaatcatgtaaaataacactacataaagtttaagatagcatgcctaaaccattattgtttatagtctggcatagagcaaattgaaattaaaattggtatgaatttttttctatatttaattattttgttacaaatatcattgatataactgtaaaagaataataacaaagaatcttaaaacatggatcaaaataaaagcagaaatgcataaatatagctctcaactctggaaattaccgatctaaaaaatatacatgttgcactttaaacatttctaaagttacctcattcttcatatcttcaaactatagtggcagcattcgaacatccaatatcttgggccccaaactcatgctataggttgtcttgcacttaggttgatgatgaagcatgtgaaacaacatgttgcatagctcacgcctatagtaaattgatgatctgaaaaaaatctacatgttgtgcttcaagcgcttttagagtcacctcatccttcatatgaccaaatctagtgctagcatgtgacaatctagggtcgcatactcatgatatggttgtcttgaacatgggtcaatgatggtgcatgcgaaacaaccacgttgggtccatccgtaaaaaatgtatgtctaaacaatacaacatttagggcttcaaaatgcatcgaagttgacgcacatcagaaatcgatatatcatgcagtaaacttgaacggatataatatccatttgtcctgtaatcatgttttgatcagccttaaacttgggttgatgtgttcacaactgagaaacattgcaaatagcacaatatatgttttaaggtaacatgcctaaacaagtatgtcttttagaaaacacaaatgaaaatggaaatataaattttcttctattaactaattttccattaatagaggtcgtaactctgcaaaatagtttatcttgaaaaatctgcatattgcaattcaaatacttttaaagttacctcattctttgaaacattgaactttaatcggcatgcgaccatctaattatgtgggt

SEQ ID NO: 723 - DNA, 2080 bp, Zea mays
gctttgtatgttcccaacattcgaacatccaatatcttgggccccaaactcatgctataggttgtcttgcacttgggttgatgatgaagcatgtgaaacaacttgttggatagctcacctctatagtaaattgatgatctaaaaaaatctacatgttgggcttcaagcgcttctagagtcacctaattcttcatatgaccaaatctagtgctagcatgcgatagtccaattctatggatcgcatactcatgttatggttgtcttgaacatgggttaatgatggcgcatgcaaaatatcaagttgggtccatccgtaaaaactgtttctctaaacaatacaacatttagggcttcaaaatgcatcgaagttgacccacattagaaatcgatatatcatgcagcaaacatgtacaaaattaatacccattagtcccatactcatgttttgattggccttacacttgggttgttgttttcacaactgagaaatattgcaaatagcactattaacatgcctaaacaactatgtcttacactacgacatttagaaaagagtaatgaaagtggaaatagaaatattcttccattaactatttttccattaatagaggtcgtaactctgcaaaatagtttatctagaaaatctacatattgcaattcaaatacttttaaagttacctcattctttaaaacattgaacttttatcggcatgcgaccatctaatgatttggtttccatactcaagttattgattgcgttgaattttagttgatggtggagcgtgtgaaacaacatgtttgatcattctgtaaatctaccacataatttagggcttcgaaaagcttcaaagttttcgcatggttcatgccacaatcttttcgagaaaacatgcacgatatcatgaccctttactcacaaatcagtgtattcgaaaactttgatgacaaaccttgttgggtcctttttgtaaaaactaccgttctaaacattacatcatttagggctttgaaccgcttcaaacatacattaatgtccataaccttgaaacattctaacattttccacatatcttatgagataacatgctctaacaagtaacgtttacggtttggcaatgagcaaattgtaatgtaattttccttggataatttattctgtgataaatatcaagagtcacatacttgttttttgagtggcctcaaatcatgcattgttgtccataaccaagaatcatttaaaatagcactacatatggtttaagatagcatgcccaaactattattgtttatagtctgacatagagcaaattgcaataaattgaaatgaatttttttatatttaattattttgttataaatatcattgatataactataatagaataataacaacgaatcttaaaacatggatcgaaataaaagcagaattgcataattatagctctcgacttgggttgatgatgaagcatgtgaaacaacatgttgcacagctcacgcctatagtaaattgatgatttgaaaaaaaaaatctacatgttgtgcttcaagcgcttttagagtcacctcatccttcatatgaccaaatctagtgatagcatgcgacaatctagggtcacatactcatattatggttgtcttgaacatgggttaatgatggtacatgtgaaacaacatgttgggtccatccataaaaactgtctgtctaaacaatacaacatttatggcttcaaaatgcattgaagttgatgcacatcagaaatcgatatatcatgcaacaaatttgtacgaatataatacccattagtcccatactcctattttgattggccttaaacttgggttgatgtgttcacaactgaggaacgttgcaaatagcacaatatatgttttaaggtaacatgcctaaacaagtatgtcttacagtacgactgtgatacccgaatttttatgaaaagaagttaaatttcttttccctcttctttcgcgctctgtgactctagagtttgtagttcggggaggcgaatacctccattgtactgtagtttttcaggctttatttgttggtaccgggagctcaatg

SEQ ID NO: 724 - DNA, 2079 bp, Zea mays
ccccgctaggttcttctcatctgtggcgaattagagcttccgagtgccactgcgcgtcggtccaccgcacctccatgacgtgcggccgatgcagctccaccccttgcccaagttgtggccctagatgtaacaaacccccttaccggagcctgcgctcgatcaccccactccgtggctcggattgctcaccagagtacccccgacccgacaggttcttgtccactacgacgaattagagcttaccagtgccgctacgcgtcggttcaccgcacctccacgacatcctaccgatgcagctccaccccttgcccaagttctggccccagatgtcccaaacccctcaccggagcccgcgttgtccaaggtgcgctcgatcgccccactccgtggctggggttgcttgccagagtacccccgacccgcccggttcttctcctctacggaaattagagcttgccggtgccactgcacgtcagtccgccgcacctccacggtgtgcggccgatgcagctccaccccttgcccaagtagtagccctagatgttccaatccccgcaccggagcccacgctagcctcggtgcgctcgatcaacccactctgtggctgaaattgctcacctgagtacccccgagccgcccagttcttctcatctgcggcgaattagagcttgccggtgccgctgcgcgtcggtccgccgcacctccacggtgtgtggccgatgcagctccaccacttgcccaagttgtggccctagatatctcaaacccctccggagcccgcgctatcctcggtgcgctcgatcttccaactctgtggctgggattgctcgccagagtacccccgacccgcccggttcttgtccactacggcgaattagagcttgccggtgccgctgcgcgtcggtccgccacacctccacggcgtccggtcgatgcagctccatccgttgcccaagttgtggccctagatgtcccaaacccctcaccagaacccgccctatccacagtgcgctcgattgccccactccgtggtagggattgctccccagagtacccctgacccgcccagttcttctcctctacgatgaattagagcttgtcggtgccgctgcgcgtcggtccactgcacctccatgacgtctggccaaggcagctccaccccttgcccatgttgtggccctagatgtcccaaacccctcaccggagcccgcgctttcctcggtgtgctcgatcgccccactctgtggctaggattgctcgcaattgtacacccgacccgcccggttcttctcctctgtggtgaattagagcttgccagtgccgctgcacatcggtccgcagcacctccacggcatccggccgatgcagctgcacaccttgccaaagttgtggccctagatgtcccaaatccctcaccggagcccgcgatatcctcggtgcgcttgatcaccccactccgtggctagattgctcgccagagtacccccgacccgcccggttcttctcctctgcggcgaattagagcttgctggtgccgctgcgcgtcggtccaccgcacctacatggcgtccgaccgatgcggctctaccccttacccaagttgtggccctagatgtcccaaacccctcaccgaagctcccactgtcctcggtgcgcttgatcgctacccccgacccacccggttcttctcctttatggcgaattagagcttaccagtgccgctgcgcgtcggtccgccgcacctccatggcgtcctgccgatgcagctccaccccttgcccatgttgtggccctagatgtcccaaacccctcaccggagccctcgttatcctcggtgcgctcaatcgccccactccgtggctgggatggctcgctagagtacccccgacccacacggttcttctcctctgcgacgaactagagcttaccggtgccgctgcgtgtcggtccgccgcacctccacagtgtccgcccgatgtagctccaccccttgcccaagttgtggccctagatgtcccaaacccctcaccggagcccgtgctatcctcctgtctcttatacacatctgacgctgccgac

SEQ ID NO: 725 - DNA, 2077 bp, Zea mays
gttaggtgcaatttagtttaactgatccaaatgaggcccaactatatgaactttctgacatatggttagcaggttactggggtcttattgggtgagaaacatcttaggctggtcaaattttttacgtgtgtaaaacctcaatcatgtcacatccactcgtaagaagactcggttgtattcctattaatagaaatggttgtttcctctctaaaaataagttgactaacttggtctctatagacaagtttagtgacctcgtgggcaatttactctagcaggccccaaagtcaaacaacaagttacctacttctccataagaatgtagcaatcaataacatgcatgtttgtcaaactgacaactaagacccaattgcagcaagagcgcgtgacagttcctaaccacgagacccaatttgcagtagaaaagcatgcataagattttgttgacacctagaggagacggttcctacattgttcgactccaatgcacctaattgggcctataaataaaccaacaatacaccttaagggagaaaattaagttgggtatatgatcgcatgtaaatgcgacattaattttcaggcctgctccgacggtgtaaacaagcgaaactatatttttcagacctactaaccacctgacacaaagttaatatagttaggcctcatttggatcagctaaactcgactacatctaactcttgcgttttagtcttttgttgatcttcatttttattagtttcaagatcttcatgcttaacaaaagaggacaaatttcccagcgcatcctcaagaaatagcatactatctttggcatttatcgccactacatgtcacctaacaatttcaacacctttatttgtgctcccacttgtagctcctcaatattatgcaaaagcttttgagctgcttcagtagcccgctttacctgtaagttctttctcttaatggtcccatcgtaacattcttccattgtcttaagctgtttccacacataattctttttcgtttgttatgctgaaattttattgtgcttctctcatcttaggatctagtaagctttctttagtttttaatctcttccctaatctcttctccaattttttgggatccgaattgtcaatactaatatatgaaataaagtttagtcccaacaatttggatcaccaaaaaagtcaggaagatattaggtaagagataagaaaactaaagtatgcttccaagatcatgagattagaggacagtgaaaatttagcacaacaggaaaaaaagaattttgtgtggaaccagcttaagacaatggaagaagattacactgggaccattaagaggaagaaaatagaggtaaagcaggctactgaagtcgctaaaaagtttttgcataatgttgatgagttgcaattgggtgctcaaaagaaggatgatgaaattgttagactacaaatagtggtgacaaatgccaaaaagaagatgttgtttcttgaggatgagctgcaaaaattgttgtctttggtcaaggataaagatcttgaaactttataaaaataaaatcaaccagagactaaaatgcaagatttagttgctgttcagattaaataatccaaccgaggcctaactatatgaataggtggttagcaggttactaggttcttattaggtgagaaacttttgatgccggtgtattttgctatgtgggtaaaccctgaatcatgtcacatccactcttctcaagactaaacacaagagttaggtgcagattagtttaattgtggcctatataaaataatgtggactaacttgttctctatagacaattttttagtgatctcgtgggccaaaagttagacaaaaagttacctacttctccacgagaaagttgcaattaataacatgcatgttggtcaaactgaccactcagacccaattgcagcaagatttggcacacggacgaactgcaaacataaatgaacagtcaggactcacaaaatcaataggcttgtgctattgctctctctctctcactcaccgagaagacatgtacacaactctctatcttgtgagtatcaggagcatcgta

SEQ ID NO: 726 - DNA, 2077 bp, Zea mays
tcgccttaccggtcctacaattatgaacttcaaaagcatggatagttcagtcactgcactaaagcaaacttggttcaacatgttgctcctaaatcagattgttcttatacttgcaccatggaacaacatagattattgtactcctatcttctggcatgaacaagcagaagaaaacaaactgctgcattatagtagttttatgagatacgctgttgcaaacaaaattatgtaaagtttacaagcatggctagaaactccacacacctagatggtccttgtggaaggggtgtggcaattctagtggccttatggccatttgaaacacctagggcctgatcatttgtatttggccgggagcttctgtggtggctggtggagatgcagcaatatcattttctgcagtgttttggttaggcaacctagaaccctatggatgtttgaggcctctccccttgttgcttataattactatttatattttaattgtatctgttaaaagagtgcatctgcaaaatcttatgtagaacttcctcaacagaaggtggtggcccaggtaggttgatatgcttgtaccagtaattaggaccattgggacaaaaccccatcttgtacctacaaagtatgaaataatagaggttcagatgtgacaaatttattccatgctaacagatagataagtgaatttagactatcagagagcaaaaacttgcatgatagacctggtaccgaaccatgtaaacgcaggcgagtatgccagcgcaacaattgtactccccgacgctatatatggggaataatgcagtagtcactctttaaaatcttcaaaaaatctactttattctctaccactacctataaatttaatctaaactcgagggggcaccgtggttcagttgaaccctagaagaaacaggaagcagagcaacgtgtaggaaacaatccacacaatctgcaccaacaagagaatccatctaatcaaacatattgggatttctattaaaaagagaatccatctaaccaagagaggagggaatcaacccgagccaagatagatctccaccctatgctagtcgaggtgcccgactgcacgaggacgatgatagaagagttgtggtccaaggatacctagatatagatgtatttggcgcatggggctgaggagcgtgagggaaagattgcccacgaagttgtcaggtgaggccagtggagcaggctgtgtcggggaggcgtgatggagggttgctttaggtcgagggatacagtgtcgcgtcgtcgtcggggaacatgacgctgcaggcgccttccatgccgccatctcagtgtcctactccaccttcctcccttttcagatcagattagcactcgccattcaaatgggaggtgcctcggtacactgccgacgcgatcgtcggagccgaggccacacaccttgtgggtgtcgatgtcggcgtggagcgacaggatgcggcgaggcagagcacacgtaggtgtgggcggaactgtcaaggagctaatccccgcaccagctcccgcgcatggtgagcgtacaccacggccttgccatcccacccatccaccagctgaagcgggacgtgaccaggttggacaggcgacgagggggagagagggatggctcggtggccaaaaggcgagacacggcgagggggtcatgacctacccgagtcaccggtgaagaagcaggcacaagcgaggagctcctacgatggaaaccggtagtggtcggggggagggggtgctgatgtgcgaacgggggcagggtcacgttgtcgccccctgtggatgcctccagcctgcgccaccacggagcggtcacaaacggaggccggggttggacggcggcagtcgcggatccgggcatcgccgatgggggtggggatgggaaggggaagggaggggaggccttgaatcccggacacatccacaggggtgttctcagatccctatcacggcagacgcgacacggggcgaggggagcagggcggcggtcgcggacgactttgggagacgggggcggggacaagcgagggcacacgcaactgacactagatcagagggg

SEQ ID NO: 727 - DNA, 2076 bp, Zea mays
tccctccccccactctacgcagcgcccaccgactaggttacgaagccacgggagaggggcaccgatcttccgaacggaaacggccaaggcacagcgtggcaagacaccgaaaaccaccgtgggttcgtgcacgaccaaaaaaaagctaagtcccagcgtgtggaaagacactagagctgctacgtatgccttgggtgaagggcacaatggaacgttggcgacgggcggtagggctgttcggcctagcgtctgggctgaaaacgaggggttcgccatggcgcgcgggccgcaaacggtggctggggcatgacctcgaaaataagctaagtccaagcatgtggaaagacacggaagctaaggtgtatgtatgtcttgagtgaagggcacggtggaacggagggaacacaacatggaggcgcgtgacgacgggtggcatggctgttcggccttgcgtctgggctgaaaacgaggggttcgccatggcgcgcgtgccaaaaatggcggctggggcacaacctcggaaataagctaagtccaagcgtgtggaaagacacccaagctaatgtgtatgtcttgggtgaagggcacggtggaacggagggaaatcgggaggaggcacgcgacgacgagcggtggggctgttcggccttgcgtttgggctgaaaacaggtggttcgccatggcgctcgagctggaaacggttgctggggcacgaacccgaaaataagctaagtccaagcgtgtggaaagacaccgaacctaaagtgtacgtctttggtgaagggcatggtggaacggaaggaaaacgggtcggaggcacgcggcgacgtggcggcatgggtgttcgtccatgtgtctgggctgaaaacgaggggttcctcgccatggcgcacagtccaaaaactgaggttcgggcacgaacccaaaaataagctaagtgcaagcgtttggaaagacaccgaagctaatgtgtatgtcttgggtgaagggcacgacagaacggagggaaaacgacaccgaggcgcgaggcgacgggcggcttgtttggccttgcgtctgggctgaaaacgaggggttcgccatggcacacgggctgaaaactgaggctcgggcacgatctcgaaaataagctaagtccaagcatgtggaaagacaccgaacctaaagtgcatgtcttgagtgaagggcaaggtggaacggagggaaaacgaaaagaggcgcgcgacgacgggcggcagggctgtttggccttgcgtctgggctaaaaactaggtgttcgccatggcgcgtggaccaaaaacagcggttccgccacgaccgcgaaaatgggctaagtccaagcgtgtggaaagacaccgaacctaaagtgcatgtcttgagcgaagggcaaggtggaacggagggaaaacgggaggaggcgcgcggcgacgggcggcagtgctgttcggccttgtgtctcgagctgaaaatgaggtgttcgccatggcgcgcaggctgaaaaaacggttgggccacggccgcaaaaacgtgctaagtccaatcgtgtggaaacacaccgaacctaaaggacatgtcttgagtgaagggcaaggtggaacagagggaaaacgggacgaggcgtgcgacgacgggcggcagtgctgttcggccttgcgtttcgggctgaaaacgaggtgttcgccatggcgcgcgggccaaaaacggcggttccgccgcgaccgcgaaaacgggctaagtccaagcatgtggaaagacactgaggttgctacgtaggactcgattgaagggcacggtggaacggagggaaaatggctcagaggcgcaaggcaatgggcggcagggctattcggccttgcgtttgggctgaaaatgaggggttcgccatggcgcgcgggccaaaaatggattttcggccacggccgcgaaaacagacacgtggaagggcacaagaccctcccgtggtcacccgaatgagacgtggaagttcgggtccacccatgagggaaaacgggtcacgctagcgaaacccctgattctgagcaaaaacctggtgtccggccatgtgaaaatgttatc

SEQ ID NO: 728 - DNA, 2073 bp, Zea mays
tatgaaataaagtttagtcccaacaattcggatcaccaaaaaagtgaggaagatattaggtaagagataagaaaactaaagtatgcttccaagatcatgagattagaggatagtgaaaattcagcacaacaagaaaaaaagaattttgtgtggaaccagcttaagacaatggaagaagattacactaggaccatttaagaggaagaaaatagaggtaaagcaggctactgaagccgctaaaaagtttttgcataatgttgatgagttgcaattgggtgcccaaaagaaggatgatgaaattgttagactacaaataatggcgacaaatgccaaaaagaggatgttgtttcttgaggatgagctgcaaaaattgttgcctttggtcaaggataaagatcttgaaactttataaaaataaaatcaaccagagactaaaatgcaagatttagttgctgttcaaattaactaatccaaacgaggcctaactatatgaataggtggttagcaggttactaggttcttattaggtgagaaacttttgatgtcggtggattttgctatgtgggtaaaccctgaatcatgtcacatccactcttctcaagactaaacacaagagttaagtgcagattagtttaactgtggcctatataaaataatgtggactaacttgttctctatagacaattttttagtgatctcgtgggccaaaagttagatgaaagttacctacttctccacgagaaagttgcaattaataacatgcatgttggtcaaactgaccactctgacccaattgcagcaagatttggcacacggacgaactgcaaacataaatgaacagtcaggactcacaaaatcaataggcttgtgctattgctctctctctctctcactcaccgagaagacatgtacacaactctctatcttgtgagtatcaggagcatcgttttgctagctttctcctaccagagcaccacactttctcatagcactagatggcacatcattgatggacccctacatataacgctagcacccattaaataaatagaagtagacgacgacatgcctagaaactacacctctcatctcgtctgggccacatgatgcacgcgtcttaccatgagaagcggtcactactgcaggccaaccgtacgtgtctctccaaacataggccgcactacagcgcattcttcaactagtggacgcaagactcgcactaaatgcaggcatggtctgcatgcataaggcgctagcccgcacgcctcctccattgctccatgcatatggggcgcatcctttggctctgcgatccacctgaaccgttccactttttcatgtactcatcgttaaactccagtaggtttcatataaaatcatgcatagtacttgtatatggcatggcactccgatcgaaatctaggacggatggtctgatgtgatgcacgcatgttaggtaggcttcacacatcagtcgtgcttacttgttcgtggagctagcttgctagcctttctctttctggtgttcttgcacctagctacatcagatcacgagagctttcaagcccgttgtacgtgctagaggccagaggctctccctagctccatctgaaaaaggctgtagcaggaaatcacttttgctcgagccgctactgctggtgcttcatctcttaggctctctattgatccatatccatgtttggtgctagtacggcgcggtcgtcagcactacacacaacgctgttcggtcctagtgcaatgatggcaccttgatcgtctttctacgtctccgtcaaaaatgaactaataataatattcaagaaaaacaaactttatataaggccggtcgtacttacttaaagctaatagttaatgtaataaataaagcaacaaattcaaaaaagggattacattattttagtatttagttcgtgaacaagttggtccccatcaagtcagccttgatcttgttatcaatgacgactgtctaaacgataatggactccaacatggtcgagtatgtcattatatttcacggaatttattaggggactgttgacacctttttcgggc

SEQ ID NO: 729 - DNA, 2071 bp, Zea mays
taataacacttaaaagaaaaaaaaactagatgtcaagatattactaagtacaacgtccacgttattttaacttaaccgaatccaattcaagcagcaagcgataataaactaagcacaagtattatatcaaccttagctatagaacacaccaaaaagtgaacgagacttaggctcattattttgggacaccaaactagaactatggacagaagcaacttaactaactatttaaaccactcttttgaattaacctttataatatccaaactaataaaacatcacactatacttaatctatcaagtagacaatcatcacaccacatatatatttaccaatatacttatcacataaacctaaaattcaactttaacctccgcatcaagtaatagacaagagaatcatcgcaatcgatacatctatttaatcgaaccatctatctagttgacgggaataacgaatcaactcaccataactaaactcgacccgaatccgcgaggtcaacgacgattctgcggatgaggacaacgaacttgaagggcggcgcggtgaaattattggaacggctgagtcatggacgtggttctgtcgaggcgagaacaagaaacaacgacgacgtccaaagcacgacttatgaagaacagaatggcgaccggcctaggcgcgatgggtgagttgagcgactccgacgacgtgcgcgagctcgttctgggcatggacgtgagttggagcagaggagaacacggccgaaggtccggagtggcgctgcgtggtggagattggcagccgggtgtcgacgagtgcgtggagtcctgcagaactgtgatgctgaagatggcgtggtgacgagtgaacacggggctgagtgacgacagcggtgtccgagtgctgtgaggcaacgacgaggtcgacagtcggtgtcacggatgaaaccgagatcggccatgacagcggagctacgacgactggatcgatgtcagttttgagcttgcagacgacggtgttgtccggcgaggccacacgcagaggtggccagcccaagtgcacgacgcgcagtgcggcgatggcggccaggatcgagtgttgctggccagtagcgtgacggcgaggtagtggtgaggcccggcgagctcggaacaggggctcgacgaacggcggtagggaggtcgagtacagctgaggataagatcagcgtgtgagggagatacccagcggcggctaggagaacgatgggaagggcacgcggccaggcacctaggcgaggggagcacgtggcttgctgggggctcctacagcctggacatgatagggagatgagcaggaaacatgcacgcggataaggaagaggatgtcgtaggaaagtttctagcgtctaggagatgtacgtgacctgtgaacttgtaccggctgaagataatatcaacagaaggtaaggctaaaagccttgggaggggatgacgtggggttgagaagaaaaggggattatcccccattttcttaaatgaatacataaagataattagatcataggaatagagggctgtgggatatttccggagaaaagcacggactcaagataaggaatgaagggagatgaacacgtaatttttttagcgatgattaaagggtcgatgatacgggctacatatctcattctaatgttttagcaaactaaatcatttaccatacttgctgtcagtactaattatagtggtttggtttgcttcggacaggatgcaaatagaccgaattagacagattttggcgtcagtatttagtcggggcttaactcgtctaacctaataatctcatccactaatcaagcactcgattactctgccgaagacaacacactagaaaaaagaggcccaattattactcttacgctcgccaaaacaacgtgctggaggaaaaattgggtcatgcataacctcgtgcaagatttcagcgcgattcgaattattttaccccgaacattttagttgtccagttcaaactaatttgctcggaataaaatcatcaaagtggggcgggcttccgaattcgtattcgcgcgagcgatgaattttaaaa

SEQ ID NO: 730 - DNA, 2070 bp, Zea mays
gcgacaacttgtccaccctccacgcgaacacaacaaagcgtggacgacgtgcagggctggcagggtctccgcgacaacgggagcaaagatgtaaagcgaaggcgatggtagagacaagatcgatagccggttcttgcattatgttggcaggtggcgagcagcgagcatagtagcgtcttcacggcttactgtggacacggtgtgacgtagtagaatacttggcaccgagcagagaaacagtgtgttggggctgcaggtccgggcgggatcgacgacgcgaccatcctggccgagcagggaactgcgtgcgaccacgacagactagtcggccagcacgaggaggcgacggcgagcgatggcaaccgggaggagcgcgcaatatccaggacggcctggctgggtgccgaaggagctgggcagcagggatcgaccaccatggctgggaacgggaacgcgacgcggcatggtcagagctagagggagctgcgcgcggcgtgctggaaaaagcaacagaacgagcgcgcgggggagcagagaaccgcgcgcgcataggagcagggagaagcacgcgcagagggcgagcagggacagaggaccgcgcgcgcaggggaacttggagaaccgcggccatgggcgagggaggagctcggccgggcgtcgagaggaaaaggaaaggcggctgggcgcgcggcaacaggaagaagaagcagcgcttgagagaggagaccggaggggaggtgtccagcgcgacgaccaccagtggaaactcgcgcacgttcatggcgatggggcacgagcagggaggaatccgaggggaaatcgccatgggagcagctcgatctggacgaaatccaagcaggaggattgggcgcgagctggggcggtcgagcgctgggaataggaagcgccgagcagggaggaagaagctttggggagatgggacgagcagaggaacttcgacgcgcgcagggaggagccatggcgagtggctgggctgggcgcgcagagaaatcggctggggagtgagggggaagcagctgcgtgcagcgaggaggttccaggggcgcgcccgcgcggcaccagggggaagacgagggcgtagggagccatggagaggacgccgggaatctgagttgaggctggacaccgcgaggaagaagacgtgggcgcttggcttcggaacttctgccggcgagtaggatttttaacagcgcggcggctgagatcttttccagagataagatcggctggaaaaatccaagctgcgggcggctggaggataggatcgcgctggatttttccacggatccagaacggcggccggatgaagatgagcagaaaaatcacggcagaaaaaatcaaagggagggaggagagcgactgtagatagagatgaacgaggatatttttcccttttttttttagaaattacagatatttcggatcacgattcttttagcgatgtatacggggtagacagtaattatgacgcggttttatttagttgaacctaaacgaatttcgcaaatgcttttaggtttccgatttttagcgctgtacactgggtcgatacactagttatctacgcatcccattccccgaatctcgaaatggaaatccgaggactaatgatttgatttggcgaattctctaaactcggacggaatcgtgctgttaattcacttttgagatttaaatcgaggcgagaaacaaatggaccgaaccactatagttttggcttcgaggatttgctctgcgtaaattgaatgaagttagacgaaaccatatctgcgaaagcacacatgatttcgtcgctaaaacaacgtgcagacggataaactgaatcatattcgcacagacgatttcacttagacgacgcgcgatacagattattttgcctcgaacactttagtcgtggaagtctgattaatttgttcgggataaaatcatctagtgggtcgagcttccgaattcgtgttcgcgcgagcgatgtattttaaataatcatcggacgcaccgattttcggaacaacgatgttccgaacatcacgaaaatttcggaagagcccg

SEQ ID NO: 731 - DNA, 2069 bp, Zea mays
acgcgctatccttcttctccacagcgccgcagctcccagcttctccctcctcgcgcaaactttttcttcctcctcgaactcggcgcctggatctctcttctccctccacctctctccagccgcgcgtctccctgctctctatgttcttcttcctccctagctcctgctcgcccaacgacgccgtcggccggatcacctctgctctctttgctcgccctggcccgccgtgctctgctcgtcacggccgcgtgagcggcgagctctctgccgcggcttccttcctcttccgctccagccttctcctttctctcttctctagccctgttcggcccctagcttggatcttccttccgctcggtcgcctgtctctctctcggctccctgacgcgcgcccctctcatggccggtgctctgctcggattctgcccgccaagctcccatccgagtctcctcccatggcttgagcctccctgttgctcgtgtcgtggcctggccccagctccggcccgtcgcggctcctatggcgctcgaccatctttgcgcccatccatggcggttccctgcgcgccttagttctgctcggttccgtttgccgtgcctctgcgctcatcgcgatgctccagctcggattcagtcctgcgcgcagccgcttttcatctccctgctcagctcgctgcgccgaactacccagcgtcgcgtgcctggctcggccgtctctagctctccttgctccctgctgctcgcccggtcgagctccctgaccgccgcgccgtgaattttcgtgcggccgtggagttctctggtgtttgcgtgccatgaagttcctctagcgccgtggcttcccaattccttgtagtcgcgcccgcgaattttcttcgctcggctttaattcccaatcgtgtcatcgacctcgtcgttcgccgtcgttcgtcatcacgtcgttcgccgtcgagcctcgctgcccatcgtgaagtcccctgcgtcccgccgggattctgccgcgtgtccctgcttaccgtctgtccacgcatcgtgcgtcgagcaacaaaacaaaatccgtgcgcatcgagcttgcgcgccgaatctttttctagctcgccgcgacgcccgatgtcctgcccgcttttctcaccgcgtcagctactcgctggtgctccaactcatcaactgtagttatcctattcgcgtccgcacgagaccgtggtcgttcgtcgagtccgccaacactctgttggcgattcgattgtcgtcgctattgtgtgcctcgctgtgtgctcgtcgagtgttgtcggttgtacctcggcactcgtgcatgccgctggctcgcgttaacgctcgcgcgcctcctcgttatcactgtgtcgcactcactctttgtcaatcgggcttcacgcgtgctcgcgtttgtcgtcaagttgttaaacccgccctcccttgctcgtgacttcgtcgtcgccagagccctcactagattcgtgtcctcgctagctcgctccatattcaatctcgtcgtcgttccgcgcgtcagcaagaaatctcaagagtcgggtgaagacggagccagcaacatgatattcaccaagtgcgagacaaaaagctcggacatcctgtgcgactcaagtacggttcgtcaaaattattcagtcgaggaaaagatatgcaacaattgattaccgaagaaaagaacacccctggatgacgtcaaccggaacccgtagtcgtgcttgcgactatcgcgtcgaattagtcagcgtaagttgatttgtattcccgttaactaggtctataaatagattaaatagaattattggtctcaataaatattattaatttagcatatgtataatgtgatgatcgatttagataaatcggtaactcaagtaattaagatacacaatttaaagagttaataaaaagttaggaataaaaataggttttctagtgtaatatatcaatttggttaatggatgtagtcgatgccctactgtaataatgcttggttttaagtgtttcatcctttttagcgtagattatctatcttgtactatttatactcgtgctcatacatg

SEQ ID NO: 732 - DNA, 2067 bp, Zea mays
cctttccgtcttcatcttttaatacataataatttgtgggaagtgtttttggtgacatccattatatttgggaaaatggggtgttacgacgacatttagaaaaagagtaatgaaagtggaaatataaattttcttccattatctatttttccattaatagaggccgtaacgctgcaaaatagtttatcttgaaaaatctacatattgcaattcaaatactttaaacttacctcattcttaaaaacaataaaattgaatcggcatgtgaccatctaaatatgtgggtcccaaactcaagttattgattgtgttgaattttagttgatggtggagcgtgtgaaacaacatgttggatcattctttaaatctaccacataatttagggtttcgaaaagcttcaaagttttcgcatggttcatgccacaatcttttcgagaaaacatgcacgaaataatgaccctttactcacaaaacttgttgagtcatttttgtaaaaactaccattctaaacattacatcatttagggctttgaaccgcttcaaacttacattaatgtccatcaccatgaaacatttgaaattttttcacatatcttatgagataacatgcccaaacaagtgatgtttatgatttggcaatgaaaaattgtaatgtaattttccttggttaaattgttttgtgataaatatcataagtcccatacttgttttttgagtggccccaaaatatgcattgttgtccataaccaagaatcattaaaaatagcgctacatatggtttaagatagcatgcctaaactattattgtttatagtctagcatagagcaaattgtaattaaaattggaatgaatttttttctatacttaattttttgtaataaatatcattgatataactttaatagaataataacaaggaatcttaaaacatggatcgaaataaaagcagaattgcataaatatagctctgaactctagaaaattaccgatctaaaaaatatacatgttgcactttaaacatttctaaagttacctcattcttcatatctacaaactacagtgccagcattcaaacatccaataacttggtccccaaactcatgctataggttgtcttgcacttgggttgatgatgaagcatgtgaaacaacatgttgcataactcacgcctatagtaaattgatgatctgaaaaaaatctacatgttgtgcttctagcgcttttagagtcacctcattcttcatatgaccaaatctagtgctagcatgcaacaatctagggtctcatactcatgttatggatgtcttgaacatgggttaatgatggtgtatgagaacaacacgttggttccatccttaaaaactgtctgtttaaacaatacaacatttagggcttcaaaatgcatcgaagttgacgcacataagaaatcgatatatcacgcaacaaactgtatgaatataataccaatcagtcccatactcatgttttgatcggccttaaacttgggttgatctgttcacaactgaggaacgttgcaaatagcacaatatatgttttaaggtaacatgcctaaacaagtatatcttacagtacgacatttagaaaagagtaatgaaagtagaaatataaattttcttccattaactatttttccattaatagaggtcgtaactctgcaaaatagtttatcttgaaaaatctgcatattgcaattcaaatacttttgaagttacctcgttcttgaaaacactcaactttaatcggcatgcgaccatctaattatgtgcgtcccatactcaagttatggattgtgtttaattttagttgatggtggagcgtgtgaaacaacgtgttggatcattctgtaaatctaccacataatttagggttttgaaaagctttagagttttcgtatggttcatgccacaatcttttcgagaaaacatgcacgaaatcatgacccttttactcacaaatcagtgtattgcgaaaactttgatgacaaaccttgttggatcctttttgtaaaaactaccattctaaacattacattatttagggctttg

SEQ ID NO: 733 - DNA, 2100 bp, Zea mays
agatcggcaagggggagggggtgagccgcgactgagaagggaagcggaggagaggatacgtcgatggccgatgcctcgtcgaccgacggtccgagttctctattcgtgcttctggtgacggtgattgtggcaccgtacgcaggtaactaactggtcacacacacgacagtttctacagccgcggcccgcgggctcacaggatgggagtagtcctatgcagggccaagccggtataattcaaggctctgtacagattttcttttctttgttagagcatctccaagagtaccataaaataaatctctccaaatatggatattaggatctctctaaaaaccattatttaattcctaaaaaatggtacgattccaacagctcccaatatattctcaaatacctaatcagtctgtcggtgagggtctacaaaagttcctgccaggccacatttcacgtgaattttatttgccaccgtacatgcccgtttctatcgctgttcacctttgtgcgccaccatttgttgttgcctagagcatgtgcctatcgccagggcagcgggctccaatcgtcgcgactaggaagcagctacctataaaagctggtccaaaacggtgtgctatccacgtcatttaaaaaaattttagccgtccgatcatcggtggacggctcaaatcgctcctctgctccctccgtctctcgatatttctgtctctggatacttccgtttgatatgcttggccggtggatgcctatcttcgctctttccgccccatctttcttccttctcactcgattcacgtcgtcactctcccagtcgctttgcgtgctttcattcatcttttctgtgtcatccttttcccagcactttttacttcaaatccctttcattgtcggctccgccgcctcctgtattgtcgccttcatcgcccgctccgattgttgctcggaaagaggtttgtttgcctattgcaccaaaatctttccttgtggggcagatctggtttctttcgcttacgagtcccttttgatatatttttttgagttatacatcgtttcctgcagtcgcgcggttccttcttgccgtgctccccctcttcctctctgatgcatatgtgttttcgtccaggggcgccgaccgagtgaacgtcggtgccgcggaagccggcgtgggcgcctccgcggccgcagacgaagatgacgcccaccatgcgcaggctcccgtctcccgctgcaccgttggcgtcagcacgctgcgccttcttccccgtcgtgcgcgacctctccaccgtgttccatgccctgttgcccaaagaagcggatccgcgcgggttgacgaccacttgggttccaagctgcctggcgtacgtgcaggacgacggcgggcttagcactcaccggcacacactcccccgcgtgctaaatgcagtagccggcgccgtctcagggctctcggtgttcgcgcagggacaggcgaccgccgcggcggcagcatcttcttcagttcatagtttggttgcaaggccatggccatagcatggtagtactggtacagactacaaacctctcgtataagtagtgtgttggtttttcattattaatatttgccctctgcttttttagtgtcgttgtctgttatctgggatgcagtaagatttgataagaaaggggaatgggctcgccattacaaaagctggtatccttcctatgtttgttcgtatttttatgtgcttcatcgttttatttttttctagtagcctgttggtgtctccttcgccagatagatgctgcgacggcgacgcctacctttgtcttctccagtttgcagtgtacccattcgctttgtttgtttacgcttccacacatttccctcttctcttctggtttcttcagcctctctggaatccctttgtggatcacggcagctctccaagcaactgatttggtgagtttgtgttgtattcggaatttcgccaaaaaaaagagtcttgctaccccatttcgtttctagctgatctggtcagaggatggtttctgttttttatttttagttttcccagattttctcccattttcccttcttactttagatctcttcatgcagac

SEQ ID NO: 734 - DNA, 2065 bp, Zea mays
gacagaggggttagttaggcacatttttgttaatggggccattaggattctgtaacaccttagaatcatagtttaggtaaattagaaaaagtttatctcaaaaatttaaataagtatgtttttgaaacaagaagttaaataaaatatccatatacgaatgaaagtacccttagttgaattatatatactctaaaagaattagataaatgatattttgagaaagattatacattagaaaatattttctaatgaaacaaatgaatatgaacatttgaatacactttcagttttactacacattcaaaattatattttctaaaaaaagaatgtgtgcatacttcatatttgaaagcatttgcatgaatgaacaatataatatatttaaatgagtaaaaaagttatatttagcattcatgctgtgatctttgattgtgcatatgaatttaatttataaattctatttgaaactgactggagatttaaaatagaaaaaatagaaaatagaaaacaaaataaaggtgccggttgggccaatttcatctaactaatcgagatgcacttgccatacgtgtttttagtctattctttattcctttggccggagcttacctcagcatgacctcagcactgatgttagcatgcaaacaaaccaggaagtccacacgatcgtgctcttagacgctgggatgtgggcccttttgtcagcttcgtcctcagccgtgagtccattttgccggtaaaatagaacaacctccgtgcatcctgcatggatcctcggccaaagctcgcgcccatgtccttttgttcctaggtctctcgatcagatgcatgcatgactttgttggccggttgggaccttctggaaccactcgttccctctcttgaactgctatttctcttctcatcgcgtccctccgaaatccaagcataacagaccagagtttgttaggatttggaggatcaaatcttaacgaagtcatccaggatacgattccatcaggtccatggctgccacctccatcccgattttccctagggatgcacttaaataatccacgtcgtgcgcactcctgcgtccatggccgcagatctcgctctccgttgaacgacgcccacctttcgcccacctgctcggacttagtctagagtataaatcggtgtcctccccaacccaatgcactgcgccgcctctgcccttgcgcgtcccagccgtactcgtccatggggtgccgtcgttgagagacttgggaaaagcttgctgccacagactcgagctatgtccactgctcggggcacgtcgtcgatccgccagggcctagaagtttatcctcccccgccgccagctgaggagtgcagctcggacggccaccgattcgggttcctggcactctggcagccgtctcccacgcctcgtccgcgatctgggcacgccggaaaccaagttggtgccatcgctcgtacagggcggacctgggcgctatgaagtctctcacctgcgcctcgttgactgtgcttgctgcccccatcacgacccggaaatctccgttcgtgctctggtggtcgcgttggagctttttcaaccaccgtggaattgcgggatgccatgggcgatggtctgcgaaccgcgacgtgcaagaactggtaagaacaccatggtttcccctcgctacctccgcttacattgtgtagaaccatccggttgataggaattgggtgccgagtaacctcaagcgccgtgcgatatttcccaccgcgggggagggtcctgcggcggaaaaaaatttgttgcagtccggctgtaaaccaggctgtttgcagcccctcacaaaaaggaggataggtcccacccgcaggtaaataatacaactaaaacgttatctggtggacctgcaggtggagcctatcctcctttttgtgaggggctgcaaacagcctgatttgcagccgggctgcaacaaatttttttcccctgcggcatcgtgctttggcgaggtggaagatgggtccctggccgaccgatcaaaattggtaggataggattgggggaaaggcgcggggaaatatg

SEQ ID NO: 735 - DNA, 2064 bp, Zea mays
gtgatgtgaagtccaaaaaggaatgtaaagtgattggtgagctacatctatccttttatcgcacctttccaaatttgctgttgtttttgcaagagatatgcagcttctggcccttgggaggactgtcaaatgcccatgcaaaggcttcatcccattcagatgttgcaccagtcgagacaatctatgatttaggccacgtaagtttaggtcagcaacactccatgcaataaaattaggaatgtcccaaaccaatagtcaaagaagcatgccaataaaagctaatgcaagctgttgcaagcaaagtctcagaacgaggataatggatagagaaggaccgatatccctagattgttggtgtacctttgtcagccttggcggattgtttccaagagtaagcttgcagaaggcactagggtttccgactgattgctttagattgttgccacgttttatcgtaacagtaagagtcacaagcaagcactgaagaagcaattctgccttttcttgaaatcgtggtgggccagactgtatcaagtactgaagtagaggaatagcctctgatgcagcgactgattgtgctttaaacacttcagctgaccaagcttgcctgagaagatatagtgaatctagtgctgccccttgagttgcctcagaaccagttttaagggatgttacaagatgaggaatgcacaatgtggcaggttcagtgaccctcagacgagggaagttactcagcaaagcattaagtgctttgagatactcttcgttagcacttccagaagcccatatatccttttaaatagaagctgcatgaaaaatgtaagcattaaatgtataaaaactgggtatgatcgtaaacatatacatattccagctggctaggagaaataactaaactaagatagatggcctcttgggctataaacattcacacgtgaatgctgatgccggattattttcttttatctaaaaaaagatggcctcctttcacatactgtacacaaaatgtttgattagaactcacaaagtacacgtgaacttcacaaacgtgactcgattcatgtatttgctagacattacatagaaattccataaatctcatatatactaaaggtggatattgacatctttagcaagacaggcattgataacaatgaatttgctatgcaaaatgaacatgacagaacaagaaagggatattgtttaccagttataactctgactgtttcactggtcgcatactcttggatagtgtggttattgaatagaagtttgacaaacattgctgtctgaacagaaatgtcaggattgcttgaactgataagatccagcaggacctgaacaccaccgaattctgcaattgctctcttatttgctcggctgtacatgactagattctgtaaggcacatattgctaccactttcatctcttcagttggttgattttcaagaagattgactagagcgcggcatgctgcaacagcatcaatagaacgagcaagaccttcgttttggaaaagatctccaagagcaagagcagcaagcaatcttccctgttgagattgtgtctgtggatccagaaggtacatgcttgattcgaagcaagagcagcaacaacatcagtagaactcagagacattcgaagcctcaaatcgttgtttgacccatcttcctgcataaggatgtgtcacatttctatacttatatatagatcagatatatgcttgattagaagtgaaaatatgatcagatatatgttgttgttaactggcagcacttccatataagtagaggaaatggcaccagacacaaactattttcttcatatattttctgcatgttatctctattttgtcttaatttttaatgtccaaattcatgtctctgttttgtcctcttcagaacttattcggtgatcttttggcccatctttgctgataccgacaaagtacgcatgctgctgttgtcaaggtatagtatgtgcccacctaaatgacttcataaaactccatctctccattcacccttaaactttcatctgcagtacaccgaactttgtgattt

SEQ ID NO: 736 - DNA, 2063 bp, Zea mays
ctaaattgattctctaggttaacttgtatagcacaataattaatacgacatcacattattcgctttatttacaactacaagaatacaagaacgtatgcaaggttaactttcagtcacaaatatcatgaccgatgggttaccactagttgagctacatgatcatatctacttaagaaggcatcaactccatacaaataaacaaaaaatcattatacgtaatactaacaacacctatcagatacgtctaccaatacattcttcacatgaattatactgcaacatatacttcaccacgcctcgcggctacttcacaattacggcggtaaccaagcagcacacaattacgacctttatcatgcatcaaatacacccacgacgcgtttaagctacaaatagaataattatcacgataaataagcctctaatccatctatcaaattaattagctagaatagcgaatcaaagtatgattaccatttcgactagcaatccacctaaacgacaacgatccttgttcagggctttcatcgagcacttggtaggcgtcgatctggaggttggtccaccacactcttgggattcgtttgcttgctgacgcgaacacaagtcggagatgtcacgtagggactagcattgagcattgaggcgaggcgacggaacaaccacaagcacctaggatggatctacaatattgttgtagacccgacacggagatgaacaacaatgaaccagcgagctaaaccatggcgagtgatgtcttgacgcggatgagcaacgacaactagcgaaatcagaacagcggggtgaggtgcatggccagcaaacaaggatgatcgcatgtggcaataaagcgaaagcaattgtcaacaacgggcttcgaggcctgacacgactgaggaggggaacagcgcgacatgtcggcgagggggaaaggagctcgacacccgatctcaggacaggctgttgggtgatcaacgtgccatggagtgagtagaggcgagcaaaggctgacgggatggcggacacggtcagcgaggagacaagcgacaacgtcgcggatgcgatgagtgcggacgagtagcacgctgatgaacccaacatagagctttggacgaggttgaggacgttggtactgcagcgaggacatcacgacaacagtgcgtggacgattgcgtggcgtcgatgaccaagacgatggcaaggttagcgcggctaggagaaaatatatgcggaggacacggtgagcgcagccaaggcgcgtggagctcgcaggaccagatcttggcgagaacgagcacacacgatgaccagctagcaccatagcgcaggagggatttgcgagcaggattccaagcgagtcatgacgagcaggctaggcacgagctcacggcagtgtccagggagaggagagagatccgatttggctgagatgaggaggggcgctgagaacggacgccatgggagggaggtacttggagcaggaatggagcagggggctggaatcgagcgcaagtgagcaagcgatggccacagagacctgggaaatcgacagcgagcagggagagagcttggacttgggatggacttggcgagctcaaccaccagggggcgcggctccacattatggcgaggaaagggagaagacgccgacgtcgaggagtgctaggggcacggccggatagggagcacgtgccggacctgagggagatgagggaggccggggagaagggacggacagccctgccatcactggcgagctccaagtcggccgcgccgcgatgatggaggagcaccggcgcggccatggatggagcgagctctagggactagggagggaggggcagccggcgccagaactcaaggccaggggatccgctggtgaggagccgaacgcgagagaggagcggtgcggccatgggagagacgccaagggagctgggagcagggacggatggaagctagcgacggataaggcctcagcccatgcgcggtgagaaaaaaatcaggaggaagggggcggcgtggccaacttttttgcattttagcccttttggggttttttt

SEQ ID NO: 737 - DNA, 2061 bp, Zea mays
ttcaccgtcttccctgagaattcctggtagctcctcgacaatctccgctagtacttcctcctgcgatcctgtatgaggtatggatgcagtatgaggatacatgatgcttcatgcgagagatgtatgatgcatatggatgcatgtgatgtatacttatgtcaaaatcgggttattagacgcgagcttctacaagatagtctatatcgtccaagaacatgtagtctgtcttttcttggtcggtcccgactagtgtttaaggattctacacaactttacgttggttacgttataaagcgtctcgaattaccttacacctataggttaagacaaactaagttatatacttcgttgagcctcctttatttttttgaggttagttatttcctagtaaaagggatttgttcaactctaatcatcttcctagaagtaaccccgtaatttattttgaagtaacttattcttgaactagaatctctcctaattacatagacttttggtataccacttaattggacttatattgagactaccatttgattactttgaaatttactacaaaaactctatcagataatagttcactagtgttctttaccgtagaaatttcaaaggttttggaggcatatttttgactgcataaaaataacaagaaatggtgtagaaatcaaattaatctacttttaaacactaaactagtcaaataataaatatcatatttttcctatactctacttggcctaacaacatgccataaaaatttacacagacaattcctttataaatctttttctatagttttctaaagaaatcagccttttcggttttaaatttattatccaaaattccgctacatgactgctggttcaaattaattccagaggtgattattaacacatgatttagccacaaaaattttcacaaccaaatttgcagttttactatttatttttatttttctaaggaatcaaccatttaatcttttaatccataaacacaaattaatccacagaaaataacccaaaaataaatatcacggttaatcaatacccataggaacctaacaaaaatttgaatcatatttttctagcctcgaatttacttatttagctacttataaggaaactcggttttcatatttaaattcaaaccgtgaacaaaatcatttaaatcttgacatgcaacatttttaaaccgtagatctgactcagaggagtcctacaaattttatttcactatttttcgagttcaaaaactcgagttacgatttttccaagcctctctgcgttttaaatcaaaaaaggaaaagaaaacggaaaaaccactttgcatgtcagcccctcgggtttcagctaactgtaaatggtcaccataaggtcctcagccactaatctctgagtctatgccatcttgactttggcttaatcacgcgcgagattcgtcttctacctcgaaacagagagagggagagacgagtgtgcggctcggtgacggcttactggcagtgaagatggctaggcgaggtggcagaaaggtgcggtcgatgaaggcgaactcgacgttggtcttggctcggcgggtcgcggatggagatgtccggtccacgcacgctggcgggaccgaggaacggtggcgtcgacggaggtgcttgataccttctccaagctcaagcaagggctcggggttctcggctggacagtgaagcgagggacgacgcttggtttggacgataggagaaaggagcgatagcgcaagcacgagctcagctcgcggtagccatggcggacggcgtcgggtgagagcgagagagtgagggcgagtgagagtggaggaaatgagcgctggcgaggtgaggcgcgctccactttggcctagcagccagacgcggcgaggaccatgtgtgcacgcaaggagaaggcaatgcgcgcgctcgggcgcaagctcgacgcgtccccgcggctaccacatggcgggcgcgatctgcagcgcttgcagatgcgaaagagacaaaatggagagctcaaagtgttgcatgtttcagtcgttttgctccctctctaccga

SEQ ID NO: 738 - DNA, 2058 bp, Zea mays
agttccaaagccaggcatgagctcatctctagagaacacacctgctgtgaattgccactcaggcctcatatccccaaccattacccctactcacacctattgtatctagataaagctgtacttgtttgactacgtcaggaattctgagttacactccgcaacatttatcatgatcagacttttttcatatttcctacttgagcttgttgccttttggaatgcttctgtatgttgatatgcgcccgagtttgagcatctgctggatgcggtcggcatgcatgctgttcgttttgttctgcgtattgctctttgttcaactcctatttcctacataactagcacactcctatttcctacatattttccccttatttatacatgttgcctccaggtatatgtttttcggttcctccagttatgtacatgttgcctcctctggtagatgtttcctcggagttccctacatgtttcctcaattcctcctgtataatgtttgccctttttttgtatatgttgcctcctggtgcatgtttcatccatgcttcctccgctttattcatgttgcctccattataatacctcagttattataatatgcccactccgttattctctgttcattactcagttattccgttccaataactcagttattctatgttcattactcagttattctggtgacggaacttagttattccggtctaatacctcagttattctaatgtgcgcactcagttattctctactcattactcagttattccgttctaataactcagttattctaatggacgcactcagttattctggtctaataccttagttattcctgtggacgcactcagttattctctggtttcttcccttcgcgtcctctcccgccgccgccgccgttgaccagatgggtcgcgtcatacgcgcccagcgtaaggaagccggctccgttttcaagtctcaggaggactggtcgtctcagcgaacaggctgcctcagccgcagcaaagtccgacaaggccacttagacaacttttgcggttgtttcaattacattagttgatagtcttctttgtgataaaacagttaaagctaaatatcaaaatcatatcaaagaagctgtagatttctgaaattttgattaattttctttttagcaacatctgcaggcactctgtttccaaatatgccgagcatgacaaggagctgcaaacccggtgcagcccacaactgaaaatccaacaagttcttggcctgctctgagaaggttctcccaagtccatcttcaaaagcttcagcagatgaacaatatgtcaaaatgtacgaagtgctgaaaatagtatctgaaaagtttcctctgagacagaaaaataaaggtggtgctagtcaacagaccaatgaaggtggtgctggtcaacagaccaatgaagtacctgctggacaacagaccaatgaaggtggtgctggtcaacggaacgatgaagtacctgctagtgttaagagaacctatttcaccgtgactaacattgtaaagttggctcaacattcggataacgaggagatctccatgcacatggacacagatatgctcgtcagacattttttcagtgtggtcttaaataacctgctactgccacaaaagtctatttttatgtaacctcacctgaacttcaagctgtatatgacctagaaaagttgaaaaaggttgactggtcatatgtgatatttcattcattaaagaaagctcttgcactgactttaagaagaatccggggcatatgaatggatgtgtccttatgtttctagtaagtaccaggataatgcagagcatatccataattccttaaagtaattgtttttctcatgttgggtaggaaagtgactaagtgaagaatcgttggttcacaggttgttttcatggactgtattcaaaggaacagcttggacacaatgttgcagaattaacctgtatacggaggcaatggtcgataaccttttgagtgcaaaaccaattaagaaaatcagtaagaggacaaaaagggtacgtggacaagttgtcgc

SEQ ID NO: 739 - DNA, 2057 bp, Zea mays
acttctcgattaagttacatagttagccttgcctctggcgaccaggtttcgctgcaacgcctatgtgacaacttaaaaaaccatggcactttttatcttagttacagcttataccacactgaatgcattgctatttcactggcatgattgcatatgctgaatggatgcttattaaagcatgtataccaaggaaaacttgctgaataaagctggcagattttccatttgttgtaatctcctcgtgtgacttcattgtgaagggtgattttatgagttgaatattttcatgttaattgacgacaagtggacatcaatgattgaaacccgataatcccaaatagggaatattagctgcagatatattggttcttaacagcagctttgtgtatgctaagaaaatatgtgagatatttttagtgcttcaggccaaaggcttggcctggcttttttgtacaaacagatctgctgggcataccagcttgacagaaacatggtctttctttagtaagttttttgaaccatacatcattgagaagattctcagtaagtctaaaccacaactctagtaaccaccaagcaagaaaaaggagcattgacaagcacaaagacgacaaagtttacaccatattgttaaggataacaccagcccacggtcataaagaatctaagtataaaagtgcactgctggtaagaagccagttgaacaacaattttagagttccagtgcattccttgtcaatttgcgcactgaagtgccattaagatggcactagtacagcaataacatagttgtgtggtaacccatctagatgtgatatggactgcaagctgagtgccaaactgtatcacataggaatactatgaatgactacagaatacactgaagacattgcagtctgatatttagatgaagcattcactagatttctgtcagaaaaacaataccaagaaaaggctaaagacatcattgtcaggtttgcatcatattgtgtttgtgaaaaagaatattagtcaaaatgcaaaatataattcgttacaaccatatatagtactccaacattagccttccttttgccagcatacaagttcctttatttattttgtgtttctttgcatttatggtagtttctttcaaaacatatttatgtgtttgtttgcatatatgtagactcaggtataggtacaaccaatcttttgaataaagcataccaagataaacactaggtaactctttgttttatcaatgaaaggagctatgttatagtacatacatggtgatgctaaaacttagtatattaagttcacatctcttatttatttgcagatattagtgttttcaaatcactcgattaatcatgtttaaccaaaggtaaatcaataaattggtcctgaagaaggattaggtgcatctattagattatattgcctagtaaatcaatcagttagcaaatgattaactatagtcacgactcacgactagtcggcctttctagttgaatgactagttggtagaaatggcaacttgggctaaagcccagtagcattcaaagtccagcacataccatcatcacctatatatactactgtcactcatgctcctccaattgtgacctagccgccacctgaaccccagccgccacttgaaacggccacaagctagagaggaccatgtctgtgtcatactgtcgtgtgtgtgcgctgctggcttgctctcaagagcgcgtccctctggcaagcatcgagcctccctcctgttttcgtctccgccgcatccctctctttgggttctgtcggccggtccgagactcctaagtggaagaacgatgaagatgatttggtcttcctcctcttttagcagtgagtattcctattgaatgctgattcattgtgcaagttcagatctgttcttctttgcttgttgattgtgatatgcaatctacactaggtcatatgctcagttcgatcttaggtcaacgagcacaaaactagcaactagttgatgggtagttacaactagtcccatggattggggttgatggtgtgttctaagacctagg

SEQ ID NO: 740 - DNA, 2056 bp, Zea mays
gatagtggtcagaaataaataatagcatggatgttttcatgcttattgtttattcccacaatccaaaacatatcacaatttataaacatcataatagtttcacatccggatacaaatcaattcacatttgaatcaacaaagcgacattcataaccacaaactgaaattcattcatatagttccatgtattacatatcttattcatatatcacatagttccacacatgtacacattgaacaacgtcgatccacattcgggtggggccacgggcagggataaggcgcccagcgtcgggcagtgccgaggcagtcggctgtgggcgaggccggggtagccgatgtcgaggcgacaggcgggtcggggtctgcagatcaagcacgagcgtatgtgtctcgggggcgtgagtgtgggcgagcaaatagaatgaaacggcatgggcacgtcgttccatatatctagtcacttccgacgactgtcaacaataaagcatgccataatcaaactattaatagaacatagactaaatgtggctttaaataaatgctacatgtgatgatgtgatttaaaagtaaatgaaagtgtagaagaaaagttaatgtttatactccaagtattttaagcattaaacctaaaaccctgactagcaataattagagatgaaccctacaagataaaaaaaatatattacagtaaacaaaaaagaaagaaatagtagctacacaataagcatctaattaagatccaaaataacaataaacaatatattagcataccatttccccaactaaagtcgaactagagctttagaggatttgaagtaacatgtcataaacgatgtatgtattacaattttctcttatactatttatttatggtaacatcaaattctcaaacattttgcacaatcatgtctagagacaatctatactacttaagaacgcaacgagggcgtgcaccgaggcatcaccatgcccccgctcgcccccttcgcgcccgcctgcctccgcccccttcgtgtcaccacaatggccgcgtccccaccctaagatttccgcgctcgtgagagccgcacagagattgctcccacactgggtacatcgtgcacccgccccggctctcctcgtcgatggaaactcacccgtatcccgccattatcgcatacctcgacccctcgcggcccctccaccatgatgctcgcccaagctcgatggaaagcatgctcgcaattgccctcgcgcccacaatccccctccacgcgcgcatggaacaaggctcaccatgtcgtgcccccgcagcctccccctcccctcccccccacacgtgatgcccttatggcaccacaccctcggcaccgtgatgaccactgtaaccctgccaccgacacagagccttctccggggctgtcggatctccgtggcggctagggaagacgtccacaatatgcgctcgccccctactcctcggcctcggcaccccgcaacaaccgtcagagcgtcggttccatggatgaggacgatgagaggagctccacccatctgtcgtggattgggatctcccttgcccgcccgacggcacccccacattttagacgtggcgcctatggatcacgaagaaggtggcgacccctgcctccgcaagaagaacgacgacgtcagccgccaggtctgggagtttgatgccaccgtcgaccccgccatcgacgtcgcaccttcgccctcatcctcctcgataataccatggagaatgatgtagtagaaactccaatgctcgagaatattcgaattcttgtggtgtaacatgggaactattatacccaattagagcaggtcgttctgctataatttgtttcttcagggacttattaaatcctaggtttccatttgttctaacaactatttttttgcatgtaccagagatcaaacttcttgacttaactggcaatctattctcatagtggcaagtaagatctcccatagaatgattcttgttacttcagttgctatacttacaattgttgtggctttatataacattgttgggtcgaaggcaaagacg

SEQ ID NO: 741 - DNA, 2056 bp, Zea mays
ttccaatagcaagcactaaatatgctatgggaaggacaacacaaaggaattttaggaagaacaaagtaaccaaatagcgaacatataatctatgcagataatgcaatatgaacatcatatattacatgttaagtactattgtcaccctaaatgcctagaccactatgtaagacaggcatcatctatcctagtgtgaaattaatctaaccaaaccaccatcacaacatgataaatgaacatagcactttgaaggtatgagagaattacacaaacagaaacaataacattctggcttgcatctagaggacccaatactaccatggaccacatatgaacacgtatatgaactatattctacaaacatacgactttttcattcatacttaggatatgaatggaagtagttcaacttgtatttctaaaaaacattttttagagtactcgaatcatccaaaaactaaacataataccacacttttgacctaataggtagaacatcaaatccgctactcaagcaaaattagcatatcactatcggtaagctacttaacccctctatcacagtcctaatacaatcacatatacattcatcaacacaattgaatcgtcctcgcaatcctgccaacatctcttccatggaagctcgacgaactaaatttatcccactatacacaattcacctttccacttaagtttcacccaacaaagatgatgcatcggctacacttatgagcataaccacatactacatatgaggggacattttaacaaatatttaatgtaaccacaacacatatgtgccactagaaaggaattcatcgtaaccaatatactaactcaatctacttcacgagtcggctagcgggagtagcgaaatagatcactacaccaaactcgacttagatccatgaaacgatgatgaatcctagcacaagcatttaatcaaacaacatacaagcaaccttaactctattttcagattgggaatgcaactaagacatctattcaatccaccacatagctaggatatatcattatgcaaacacctcatgaacaaaaatcacagttctagagtgctcctagacagcacaccacgcccgaacctgactcgacgtacgctaaaacgacgatgactctagttcacacaattcatcgattacctagcatgtgacgctttggggcttgcttctccatacacttagggaattcttttgctccgatctcacacacataaggcacaaccaagctttctcacatgcacatcacaatcaataactgggaaaaagggctcaccactttagacccaatgtcatggggcgagggcacaacgtccagcgtcacacggcgtggagcaggaaggggctgggagatgccaagtcgtggagctggggcaagctcgccggcatccatggccgagagctgagcatgcggccaggggaatggcgaggtgggggtgcgttccacggccaaaggcaaggacagaagctggttgatcgaggagctcggctggtctggcggtctacatggcacagagttggcgattgggagaggctcggcgcctagctaatggaggtgaggagcgatgggagcctgagcacaaggagcactcggctgctgctgcaccagcattggggagctcgaccgtcggcaaggtgagtggctagtgagggatattaaatataggtaaagcctccaaagtagctcatgtaataagatacaaatgaggttacgtgaaggactttccttgaatacgtgcatttgataagtacaccagggaacattggagagaattgaagaaccaatcacgtatataggataagagcacgactacaagaggtggcggtggaatagggactcggcatggtggagtgacacgatgaaaataacatggcaatgaagatgtttctaggagctgagaaatcaatggataagagtgacgtgaggaatttttttccaaggttgctcgttcataaaataagagtggagaaaagatcaacttggatagagaaacatggttagtgagatagatcgatgggaaacaaacaaacaaatttgt

SEQ ID NO: 742 - DNA, 2055 bp, Zea mays
tttgggactaaaagactccaacatggcaaccaaaaacctattctagattctagaagatgaaactgaaaacgatgcagaagcgcgagaccactgattagctcaaccttttaaaaccttttcaactaataagtaaataagaaagtcactgtagcaaacagaagaaactggttcagtccaatttcaggcactaataaaagttccagaacgacaaatggtcaccagcaacttcttaacatccttccagatagaacatcagttcagctcatcacatcggcagctcgccgctatctgctatgacaaccttgctctttggttgcccgctctgccggccctcagcttccaccttgtacacaacatccattccagacaacaccttgccaaacacaacatgcttcccgtccaacctaacgcacaaaataaagcaggaggcaatcagtagcatagcaccttcagtcaagatcggagaaaatagtcactgttaccaagaccagtgaatattaacttaccagcttgttgtcacggtggtgatgaaaaactgagatccgtttgtatctctcccagcattggccatggacagaaggcctgactcaacaatcatattagtaaaaggatcctaacaaaccgctcgaataaaccattgttatgtaacagataggatcccattttagggccacataaaaaaatctaaggcgtaactggtcacctggtccagtgtgcttgatcttgaagttctcatcagcaaacttcatgccatagatagattcaccacccctcccatccccaagagtgaagtcacctccttggagcatgaagctgggaatgattctgtggaatgtacttcccttgtagtggagagctttgccactcttgccaattcctttctctcctgtataaacaagaaagttgagagccacatgaaaccaaaaccaaacaagtgacttgtagctatctagtaagacatcacttagatatttcacagatgtaaaactattcaatatttggaatgggacctcttccattacatggcaggctaactataagatgttttgcttttttctagatacattgttttagttatatctaatctaagtgtatagcaaaacctacgtacctaaaaaaaagtcaaaatggcttatgatttggaatggaaggagtgttgtacttgtatatatgatgaatgcaatatcactaattgtaattgatgatgtccattttcacttctcctacaaaataagattaagaatgtgcacatctattagtttgtttgttaggagaagcttcccatttcttattggatacactaacagtctgattggatagctgcgcgtacatgtgcaggctggcgccgccctggctagccagatacgataattttgagcgtatgggtggatgcagattaataacatcaaaatggttaactttgcatccactcatacaggctgtgattcccagatacaaacaaccaaacataatctcaaataaagtcaacgcatgttgtgatccaaaatgagatggtgcaggtaaccaatcagacggtaactgaagatgcaatatactatgctgcatgaaaaaacaatctcaatttaagactgccaaaccttaaacctaccatgagtttaatcattggaaaactataacaagggtaataatagcataaaacatacctgtgcaaagagctcggaagttctctgtaggaaaacaagttgtagggggcattagttttctcttatctcatgagaagatatttttgaatagttaacaataagttcataatacctgctgtcttaggaacagtcttcccaaaaagccccatgacaatccgacctatgaaagttcagaagcaagtaagcaccgataaggccatgactcaaacagttaagaagtggactctaacaccatgttaacaattggcattcaaataagtaataagaccaagaaaacaaaatataggcataaacctgatataaaatccgataaacctagcagtagcagcagcagcagtcactccacgtggcatgcaacagaagcaaatgactttgtactgtaaggctataa

SEQ ID NO: 743 - DNA, 2055 bp, Zea mays
taaatatgctatgggaaggacaaaacaaaggaattttaggaagaacaaagtaaccaaacagcaaatgtataatctgtgcagataatgcaatatgaacatcatatattacatgttaagatactattgtcaccctaaatgcctagaccgctatgtaagacaggcatcatctatcctagtgtgaaattaatctaaccaaaccaccgtcacaacaagataaatgaacatagcactttgaaggtatgagagaattaacaaatataaataatcacattctggcttgcatctagaggatccaatatctaccacggaccacatatgaacacgtatatgaactatattctacaaacatacgacttattcattcatacttaggatatggatggaagtagttcaacatgtatttccaaacaacatttttagagtactcgaatcatccaaatactaaacagaataccacaattttgagctaataggtagaacatcaattccgctaatcaagcaaaattagtgtatcactgtcggtaccgaggcaacctacttaaccactctatcacaatcctaatacaatcacatatacattcatcaacacaattgaatcgtcctcgcaaccctgccaacatctcttccatggaagctcgacgaactaaatttatcacactatacacaattcacctttccacttaagttttacccaacaaagatgatgcaccggctacacttatgagcataaccacatactacatatgaggcgacattttaacaaatatttaatataaccacaacacatgtgccactagaaaggaattcatcgtaaccaatatactaactcaatctacttcacgagtcggctagcgggagtagcgaaatagctcactacaccaaactcaactcggatccgtgaaacgacgacgaatcctagctcaggcatttaatcaaacaacatacaagcaaccttaagtctattttcagattgggaatgcaactaagacatctattcaataaaccacatagctaggatatatcattatgcaaacacctcataagcaaaaaccacagttctagagagctcccagacaacacagcacgtccgaacctgactcgacgtacgctaaaacgacgatgactagtccacgcaattcatcgaatacctagcatgtgacgctttgaggcttgcttctccatacacttagggaattcttttgctccgatatcacatacatacggcacaaccaagatttctcacatgcacagcacaatcaataaccgggaaaaagggctcaccactgtagacccgatgtcacggggcgagggcacaccgttgagcggcacaaggcgtggagcaggcatgggctgggagatgctatgtcgtggagctggggcaagctcgccggcatccatgggcaagagctgagcatgcggccagtggaatggcgaggtgggggtgcgtcccatggccaaaggcaaggacagaagctggttgatagaggagctcggctggtctggcggtctgcatggcacagagttggcgactgggagaggctcggcgcctagctaatggaggtgaggagcgatgggagcctgagcacagggagcactcggctgctgctgcaccagcattggggagctcggccgtcggcatggtgagtggctagtgagggatattacatacaggtaaagcctccaaagcagctcatgtaataagatacgaatgaggttacgtgaaggactttccttgaatacgtgcatttgataagaacaccagggaacattggagagaattcaagaaccaatcacgtatataggataagagcacgactgcaagaggtggcggtggaatagggactcggcatggtggagtgacacgatgaaaataacgtggcaatgaagatgtttccaggagctgagaaatcaatagataagagtgacgtgacgaatttttttccaaggttgctcgttcataaaataagagttggagaaaagaatcaacttggatagagaaacatggatagagagataggtcgatgggaaacaaataaacaaatttatcttcttctc

SEQ ID NO: 744 - DNA, 2055 bp, Zea mays
gacgtcgtcggcagcgtcagatgtgtataagagacaggttggaacggaataactaagtcatgaacatataataactgagtaggcacattacaataactgaggtatgacacaggataactgagggattggagtagaataactgagttctgtcactcgaataactgagtgcgtcgtctagaataactgagtaatgaacgcacaatacctgagtaacgtacaaagaataactgagtgttgaacatggaataactgagggcgcgcattagaataactgagtaccgacattagaataactgagttaggaacatggaataactgcggtattataacataataactgagggtttagaataactgaggtattataacggaataactgagggattggagtagaataactgagttggcccacaagaactgaggcacgagcagagaatagctgagtttcgtcaccagaataactgagtgatgaacacagaataaccgagtactgaaccgagaataactgagaaatgaacatggaataactaagtgcgcccactagaattactgagtaccgactccagaataactgagacatgaacatggaataactgagtgcgcccactagaataactgagtcatgagcagagaataactgaggtattagaacggaataactaagggatcggagtagaataactgagttggcccacaagaataactgaggtattagtccagaataattgagtacgtccattagaataactgagttgttggaatgaaataactgagtggcgaacatggaataactgagttaatagaacgcaataactgactgtgaatagagaataacggagtccccactaccgagtgattacaaagagaataactgagtaatgagcagagaataagtgagtaggcacacgagaataactgagtcatcacaccagaataactatgtgcgcccattagaataactgagttctgacaaaagaataactgagtgacgaacatggaataactgagtcggcacatctcaataactgaggtattataacataataactgagggatcagaaccgaacaactgagtgccgacaccagaataactgagtctgcacacaataataactgagtgggcacattccaataactgaggtatgatgataactgagggatcggaggagaataactgagttagcccacaagaataactaaggtattggaacggaataactgagttctgtcaccataataactgagtgcgtccattagaagaactgagttgttggaacggaataactgagtaatgaagagataataactgagtagtgaacatggaataactgagtgtgcacaacagaataactgagtaatgaacaatagcataactgagttacttgaacgcaataactgactgtgaatagagaataactgagtaataaacaccgcataactgagtgggcacattacaataactgaggtatgatacaggataactgagggattcgagtagaataactgagtaatgtcacacgaataactgagtgcgtcgattagaataactgagtaatgaacgcacaataactgagtaacgaactgagaataactgagggatcagaaccgaacaattgagtgccaacaccagaataactgagtctgcacaccataatcactgagttagcccacaagaataactgaggtattggaacggaattactgagttctggcaccagaataactgagtgcgtccattagaagaactgagttgttggaacggaataactgagtcatgaacatataataactgagtaggcacattacaataactgaggtatgacacgggataactgagggattggagtagaataactgagttctgtcactcgaataactgagtgatgaacatggaataactcaaggcgcgcattagaataactgagtaccaacattagaataactgagttaggaacataactgagtgggcacattacaataactgaggtatgatacaggataactaagggattggagtagaataactgctgtctcttatacacatctgacgctgcc

SEQ ID NO: 745 - DNA, 2054 bp, Zea mays
gcatcgacgttcttaaacaatacactagcacaatcaaccacaaccgtatttaccagctatatgagcgggacactagacctattatttacttaaccactcctcacacaataattattttaaacttaagttccacgtgacacgaccactctctacttatgtacacaatctattaaaccaattaattaaactaacagaaatatgaatcggcttaccatactaaatctgacgcgctatccgcgaacacgataaggattctggttcatcccttgtgtcgagtaattggtgaacgtcacgctgctaactccgtcttcacccgactcttgggatttcttgatgacgcgcagaacgacgacgatattgtgtctggagcgagctggcgaggtatggtcgagcaggttagcgcgagctctagcgacacaggctcaaacggcaaacgcgttcggcgtgcatacgtgagccgaaccgaaggagaggaatcgatgaagtgaagttcatcgaaaggcatcatggaggaatcatcgacgttgctacacacacgccaacgaacgacgcaacgacgggcagggagagatcgcgggctggggaagactcggcgagcaacgacgcgagagtaaagcgaggacacggtcgggcgggctcgaacacaagcacccacagcgtttcatcgtgtccagcgcgcgcacggactcagggagatgggcggatcgacacagtggagcaggccgcgcagcgagctgaggaacgcgacacaggcgaggacccacggttcgagctggggacagagagagacgccgaccacggcgagcaggaaacaaagcgcgcggcaggactgagcgccgacaaggaagacgcgatggccagggagctcagcaaacttgaagcagcgtgccgaccagggagcggcagccggccagcagagtagcggcgcagggagatggagctcgaagccgagctcgaggacgcggctgcgctcagacagcgggggagcgcagccatggaggaaccttgggcgcggcgaggaagctccagggagcagggagggcgcacggcttgagagagatggagggaggaagcgagggcgcgtgcagggaactgggaccgagccgagggaactccgagctgagccgcgggggagctccatggcggggtcgcggcagggaaaactgtagcgcgcggagggaatatagtcgagggagcaagggcgctcgccagggatggagctccgagcgccgagctgcggccggaaccagaggcacgcgagcaggcagtcatgggagcttgacgagatccaaaccggggaaatgtcgagcagagggcagggagtaacgccagtgagccaggggcgcgacgcagagaaccggagggcgcgcagccacggaaaaaaacagaggctgggcacggcaggaggaaggagaagtagagcgcgcaggctgggagctcagctgtggctagggaaacaccgagcagaggacgacagcacgcgtagaagaaacctccacagcggagaagataaagaagcaaagaaacggcggtgaaaaaaaatctggatggaggcggcggtggataggaacgcagagacaatttttttctcccccggcggctagagatcttttcacttttttttaatttccttttgttaaatggaaatcgcatatattttgagaattaagatttttaatgacaaacaacgggacgacacgcaatacggatacacaattcattctctaaattcagcgaatcaaattatttacattcgaagttttgaatccgggcgagacgtcctcggaacaaatcagaacggtgttaacaacagtatttgagactgtgttctatttgatttgaattcaaataattgcatccacagtcaacacccgactccacgtcaacagataatttacgtggagaatcgaatctcaattataaattctcggacacgatttctcggttgacaagtggggacagaattatttgcaccgaaaaccttagtcgacgagttcaaattaatttgcccaggataaaagtcgtaagagtaggtcgagcttccgaattcgtat

SEQ ID NO: 746 - DNA, 2054 bp, Zea mays
gctcatgggtctccctatgtcggatttttatctcagtcaccatactgttcccagccgccgctcagttcctggaacaaaaaatatcccgctgcccccttctctggtttcttccaaccgagtttctcccttatctctagccgagtccccgccgtcttcatcttcctggtgccacgcgtgtccctgcctccctgcttccccctccgtggagcatctcccagcacaccgcgcccctcagctcgctctccagcaccgcggcttccagcgctccctctgccggctgccccatcttcctagccgcgctgaagtcctgcttcgtgggagtctggagcagccgtggacgcgcccgcgccgtccctgctcgtgtcttctcccatggcgccctaccgagctccccagctctagtccagtgctcagggctccgctctctctctcctcccacatctctcccccaaccgcgcgtccctccatggctggccgcgcccgctgcttgctccccctgcttctccttggtcagagcttattcctctccctgccatggcacccgactgcctcttctttcccctgcgcgcgtctccctacgcccaagtcaccgccgtcactctgctcggcgccttccctgctcccatcgtcgcgtgccccaacgctgatggccgccgcgcgccctgtttcttgctcgccatagcgtggttctgcttctactggagcatgaacgtctcgacaccgaacctgcctcctcgcccatgtgcgcgacctcttcctgccgcgccttctccctagcaacgtaggcgtcttcctctactccaaccacggtctgctgctcattggatgccggcatgccgcacagcgatggtgtccctccctgctcctctcggccagctgtttgcgcgtgctgcgcgacatcgagtccgtgacgcgcgcgatggacgcgatgaaacactgcgtgtgcttgtgtccgagaccgcccggccacaacctcgctttgctcctcgtgtcgctgctcgccgagtccttccctagtccgcgctctctccttgcccgtcgtcacgtcattcttcatcaagcctcgctgcccatcgtggagttccctgctgttagcctctgcacccgtcctaggccatcgttgccacttcgcctccgtcttgtgggggtgttgcgctgtcgtcgagtcccgatgtcgatctggtggccgttgatttgaagctctgaacggattcggccacgtccagcactatctgtgtcgttgtcgttcgccttcgtgctgtgtgcgagaacatcgttgtttcccttcatgtgctcatcctccatctctgcctcgctatggtgcgtgtcatcatctttaatctcagtagctcttccgatacgcgcctcaccgtgcttcgcctcctcgtggtcagccccatctagatcatggggccggaagatctcaacactgcttcatatggttgttttagatgctgtttgcggggtagagagttgttatgatggatggttttcgccctctcgtcgtgttcgcaatcattgtcgatcgtcgctggtttgagagaaatcaccggaaggtgtagagaagtgaagccgcacaacacccgtcagatgttcgacgacaagctcgagccaggatttatcaacgttcgtacgagtattgagtcacgtttgatactgatgagctgatttataatttttgtaagtttatctcatgattggattaactagacttattagtcgtaataatcctcgtatttagcgcaggcgcgttgtggtagtgttaattatatgtgtagtacgatggatttaataatgcgaaaggtagattaatttaggtgatatctgggcgagatgacgacgtaaaagatagatttagtattttatagaattatccgatgaattttgtctttgtcgattatgctaaatatatttgtttagtgaagtcaaaatataagaaccccgtacagaagaaacgttttaggtctttagatttaaaaattatggtatggtgattgtaacaccccaggtgtttatcgtctactcgaccacgagtgcggactttaacacgtaat

SEQ ID NO: 747 - DNA, 2051 bp, Zea mays
ccagcatcgacaatatgatctcggaccgatggctgcgatcgaatgcgcaaacggtatcatcagcgtttgatcacagtcatccgcgtggggaacaatgaaccagacccgcctcgcccaaatcttctgccattcatccaccctgacaaggccacgagcaccatcccagaagatcctagcctcccctaggccagaccacgtgactcaaatggcaacgcaggcaagatcccgcggtggcggcaacttcctcactctctctactaattctcccagactagtggaagaacgaacgccgacgtacgcccagggggatagttgagatggcctccaatttataccgccgagcaacaacttagcgtggatatagctcaacatccccgagcattgtggcagcccggtaggattcacagccgtggatagggatgatactgacaaggctggcccgcacgtcagtgtcgcatgtgatcgagggctgacagcagggtccaccagtccatgtatggggggggaaacaccgagtgccagtgggccgtgcgctaggacggcccacacgggtgaggggctggttcctgggtccataatatcagtgtctaattaattgggcgagcgcacaaactgggcagatgcgggtgaagtcaaggaaataggtagtgggcagcgcgtggaattcggcccaaagggcacacgctgaggtcctctctttttttcttttgattttccaatttccattttaaattcaaatcaatttcgagtttgaattccaaacttttacctttagatgcacaataaaacaccagcatgaatgcaaaactatatatatatctttatatattaattttttagttcttttatacatgattctaattatgaaatagagaatagttcacatctcatgaatttttttggaattataatttatattgtagattatatatagtttaataataattcttataatttcactccaagaacaatttagtttatctaggtatctttttattttagtcaaaacaatttatattaattttgtgagtagtaacattgaaattatgaatattctcaaggaaaggtgttttgatttaaaaacccctagagaatttttctcattttcacaggattgaactttagggtgttacatatagttgaacatagcatgcctaaactattattgtttatagtctgatatagagcaaattgtaattaaaattggaatgaaattttttctatatttaattcttttgttttaaatatcattgatataactctaatagaataataacaaagaattttaaaacatggatcaaaataaaagaagaattgcataaatatagctctcaaatctagaaaattaccgatctaaaaaatatatatgttgtactttaaacatttctaaagttacctcattcttcatatctacaatctatagtgccagcattcgaacatctagtaatttgggccccaaactcatgctataggttgtcttgcacttgggttgatgatgaagcatgtgaaacaacatgttgcatagctcacacctatagtaaattgatgatatgaaaaaaatctacatgttgtgcttcaagcgcttttagagtcacctcatctttcatatgaccaaatcttctgctagcatgcgacaatctagggtctcatactcatgttatggttgtcttgaacatgggttaatgatggtgcatgcgaaacaacacgttggatccatctgtaaaaattgtctgtctaaacaatacaacatttagggcttcaaaatgcatcgaagttgacgcacatcagaaatcgatatatcatgcaacaaacttgtacgaatataatacccattagacccatactcatgttttgatcggtcttaaacttgggttgaagtgttcacaactaaggaacgttgcaaatagcacaatatatgttacaaggtaacatgcctaaacaagtatgtcttttagaaaagagtaatgaaagtggaaatataaattttcttctattaactatttttccattaatagaggtcgtaactctgcaaaatagtttatcttgaaaaa

SEQ ID NO: 748 - DNA, 2051 bp, Zea mays
tgcaggcggctgtatcgaagacagagtgaccgattttccctatgatttcccttacaccacctcaaacatataatatcatttcttctcaactactaatccaagtaaacactcacgcacatttcatcgaacaccattatgtgtagccaatggcgcgctttgcagcccaaagatgggcaccacgagtacggcggtcacggtagcggcaacggcaatggtttgcaagaagctgtatcgaaggcagaatgaccagttttccctatgatttcccttacaccacctcaaacatataatatcatttcttctcaaccactaatccaagtaaactctcatgcacatttcatcgaacgccattatgcgtagccaatggcgcgctttgcagccaaaagatgggctccacgagtgcggcggtcacagtagcggcaacgacgaaggtttgcaggcggctgtatcgaaggcggagtgaccggttttccctatgacttcccttgcaccacctcaaacatataatatcatttcttctcaactactaatccaagtaaactctcactcacatttcatcgaacaccattatgcgtagccaattgcgcgctttgcagccaaaagatgggctccacgagtacggcggtcacggtagcggcaacgacaatggtttgcaggaagctgtatcgaaggcggaatgaccggttttccctatgatttcccttacaccacctcaaacatataatatcatttcttctcaactactaatcaaagtaaactcccacgcacatttcatcgaacaccattatgagtagccaatggcgcgctttgcagccaaaagatgggctccatgagtgcggcggtcacggtagtggcaacgaccacgaattgtaggtggctatatcgaaggcggagtgaccggttttccccatgatttcccttacaccacctcaaacatataatatcatttcttctcaactactaatccaagtaaactctcacgcacattttatcgaacaccattatgcatagccaatggcgcgctttgcagccaaaagatgggctccatgagtgcggcggtcacggtagcggcaacgacaatggtttgcaggaagctgtatcgatggtggagtgaccggttttccctatgatttcccttacaccacctcaaaaatataatatcatttcttctcaactactaatccaagtaaactctcacgcacatttcatcgaacaccattatgcgtagccaatggcgcgctttgcagccaaaagatgggctccactagtgcggcggtaacggtagcggcaacggccatggtttgcaggcggctgtatcgaaggcggagtgaccgattttccctatgatttcccttataccacgtcaaacatataatatcatttcttctcaactactaatccaagtaagcaatcacgcacatttcatcgaacaccattatgcgtaactaatggcgcgctttgtagccaaaagatgggctccacgagtgcggcggtcacggtagcgacaacggccatggtttgcaggcggctgtatcgaagacagagtgaccggttttccctatgatttcccttacaccacctcaaacatataatatcgtttcttctcaactactaatccaagtaaacactcacgcacatttcattaaacaccattatgcgtagccaatggcgcgctttgcagcccaaagatgggctccacgagtacggcggtcacgatagcggcaacggcaatggtttgcaggaagctgtatcgaaggcggaatgaccggttctccctatgatttcccttacgccacctcaaacatataatatcatttcttctcaactactaatccaagtaaactctcacgcacatttcatcgaacaccattatgtgtagccaatggcgcgctttgcagccgaaagatgggctccacgagtgcggcagtcacggtagcggcaatggccatggtttgcaagcggctatatcaaaggcggagtgatggttttcccaatgatttcccttacaccacctccaatatatctcttatacacatctgacgctgccgacg

SEQ ID NO: 749 - DNA, 2050 bp, Zea mays
ttcaacgccagccaaggcctcggatgccacagagccgtcatccaagaagaagctcgtgctattcgggcgcgcgtgccgccccgacgacgaggctcgcgtcccagagaccctcgccgcgccctgctgcgccggcggcggcgagcaatctagcaagggcgccgcccaagtgaagaacgccgggcatcaatccatcaatgacgcgctggggcacaaggccaagactttagatgagatgcgcgaattgtatcctcacctcgtcgatgagtcgatggcccttcttgacccggcggtgctggagagggtgctaccccgcattgatgacaacgaggcccaggcgttggacaagaagatcaagagggcgaggaggcagctcaccaaggccatcagggaatcggtgagcaaacccttcttatccttaatcaaacttacttgggagtacgatttccctttaattactctcaactcaaggttccggccttccgtgtctttgttttaattttcttgtgattgtggttgtgcttctaatgaataaattattggactaggttgtttcaaagtatttaaccattggtgaaaagagtttggatattatgcccacatcatttagctattagacatggttccactttatgctgaaaatatagtgacaagggcatagggatggggtccaaatgaataaactacacgaaagttaaagtggtcctgccgctacttaataattactatacatgcttatgctgatttcaagatccatggtatttgtttaacaattgcattcatagataggcatcttttgttgtctggttcccagatgtaggctacctcaaagtattttactgcgattgatgccatttgatagtgaagagggcatagccaatctttgcgtacatttgtgaccattacctaaaagcattttgcgtggacattgcaaatatggagtgcatcactacagtcaaatggtgccccttatctgatgtcctcaattttcaaggcactgattgccccactttagtacagccagtgtaccgtacaacgctttgcctataaataggaaatatggttgcaagcaactcaaggtttcactttcagcatactgttccagaatccaaaacaatgatgtctatttgggaatgaaactaacagaactgcgacttaagtatactaatataaacttcattgtttgaagcaccatactctggaaaaaatggaatttgtgacatcaaactctgcaaataaaatgatttttttcaataggtagtcatcatccctttgccttggaaactgctatgtgtaccagacttttttttctgcccttctagtttgcacttgctctgaaatattttttataagctgaaagatgcattttacatttgtgtcaaattaccccaccaatcacaagaggatgatgttcaggctgcatcctgtctgacttctaaacttcgggtgctaatatatcttttatcatcactagtgaaaccacatgttgccaaaataacactagtctataaactcgacctgcagggggaggggtaaggcagcccccgagtattgtatagaagaccttctcccacaggtcgagaaacacctgaacccgtgccccgcccatatatagcggcatcaaagcccatgtgagaacaaccgcgaccggggcggagccttagacctgtgctttagcgtggacagatgaagggattcttttaaccacaacctgaaatttgctcccactgggagtcgaacccaggacctgaggagtgctactcagaccacaaaaccaattcagctagaggcccttttgcaaaacactactctatgtcaatgacaaatgaggttgggcctcacatgtcattcacaggcacaacaatactatttttcgggtcatatactgggctgaacacatgaaagctattcacagtttttgtaaaaaaatggtttgaaatctattgaaagtttgaaacagaataactggtcggttagtgtcaatgtctaaagcagcattcttctactggatggatttccacctgttgcatttcatgcttggtgcagtgtgctt

SEQ ID NO: 750 - DNA, 2048 bp, Zea mays
tgggagccctgacgagcgtcgctttcagacttcatttttatcttcaaccatagctctattctcactcccacacacacaggcgaggcaaccacaaaaagaacttgacgacgatggcagacacaaatatagacatgatgccagggcgtcgagcaatgcccagcaatcacgacaaagctgaatgtgagtaggataacgacgcggtactgagtggcacgcgagcgcagagaggcataagagctagtgagttcggactgctggagcagagtaaatttgagggccaggcgggacggacagcgtgacgattccgaccaccagagccgaccacaacaagcacgacaccctgggcacgaccgagtgccaaatagcatgctagagcagagacattgagtcggacgagcgtcagggataagcgacggtgatgagctcggcacaacacaagggccgagcgacgacatccgcgactgcgcacgggaaagctggtgaactccacgaatcaggggcaacccggcgcgacgatggttcagcggataacagtgaccagaactggacgcggcaaaaggagcccagggaggcgcgagagcgtggcaaccagagccatggcgcacgcgagtcctggcagcatgccagtgagatgaaggtaggaaccacgaccaacacggccggaggtcacaggcagagaacgacggcggtcagcactatagggaagcagggacgcacgccaaaatcccggcgcgacggcggcctaggccagcgccgcccacggccaggaggtctgcgcgtccaccacagccggctgaggcgagcgcgcccactgcctgggcgagccagggagatgagcaggagtgccgtaagagaagggggataagcggtcggcgccttgggcgagcgcaggggcacgcggaccgagcagggcgccatggaagatggggaggagagggcaagcagggcgcacgacataggcagctcgaggcggtgccgaatagggggagccgccatgagcgagatccgatttggccgagctcggatggggaagctcagactgacgatccatggtaggaggaataggaacggcaagcaggaagcagggcgcccgggcgcgacgcaggaaggaagaagcagggagggagcgtcgcggcacagggagagaggagtggctgggaatgcgtagggagaaaggagcaccgcccgtagaaaaactggagacgaagacggtgcgcgcggtggcttagcaattatccagggagatagcgccaccgccacataggaaaaaaatcaacgccgcatgcgcagggaaagaaagatcagagcagaggggcagcgggaaagaaaaatctggggagagggcggcgggagatatttctcttttctttttttgttagaaattcatagatattttgaattgggatttttagcgatgataaaagggtcgacgcgctatacaactacgcgtattatttccttggattttgaaataggaaaccgaattgtctaataatggtttcggtttcggtttatttgaacagcctgccccaaatagcgcatttaccgaatttatagagattgctcgaaccgaacgaaatacttaagcgacaattttagttcgtcttaatcgattaattttaaattggcaataggctccacactttagaaagaaataaattttaaaccgtgcgagccgaatgcggtatcacaatcggaatcccccagagacgatgtcagcatcgtcacgggagcgagctgtagacgggttcaaaccggacgagatcagattcgatattttagcggacgtttgatttagttgaacctaaacgaatattgtcgttatccgattaatttgaatagcacgagactcgatattttggaaggtcgataaaatctaaactccatggaatattttggacagtctagatagttggagaaaggtgctatatagaaatcatgataggcgaggacatctaggatttagatatagagattattatcctcattgatagttcgtgcttaagtccatactcgttgtcgagcagaatataaacaccaggggtgtt

SEQ ID NO: 751 - DNA, 2045 bp, Zea mays
aacatgcaccacataattctgcaatctgcccagaccgtcaaatccgatatcgatgacgtcgggcggccacaccccgatctgatctaaaccacccatcatcgagacgacgcccaatctcgcgaagaggtatcctacgatctaatctcgacagctccctaatacttcaacggccccgattatctcttccacccggtgccgaacgatggcgatggccgcgcctacacgacgacgccatcaccggcgtgagttggtttgccccgaatggtgcactaccgagatcctaatccgactcaaaacaaagcaggagatcatatgaacacgctggtcagggtattatcgagtataaggtagaaaaggtgctcacccacgcgctgggatggatccgcggcggcgccaatcttcgatgagcaattggtggacgataagccgtcgatttcgcccgtaggtgtcgcggacgacttcactcaggttctgagcaggctttcgctccgaacccagacactgagcgctggtagagatgaggatccgcggcggcgcaacgctttgctccctacgcaccggcgaattcgtacccccctcgcggctttggcgctggcctttggtgtgcgtgtggagaaaggggaaggcagggcccgacgccacaatttattatcgcccgagggccggcatggggtcaaccagctaggattccgcgcggcgacagacttcttggcagcggccattgcaggagggagaacccagccgacaagtggggcccatatggcagcggcgtcaatcaacacagcgcggggcgacttaatctggtagtggtcactgacgggtggggcaggtgcttgcaatcgtgggcgactgaccggttgaccccacacgtcggtgcctatcagtccacgcgggcggctgagatgggctgcgcagtgtagttcttttgtgggccgaaatcatgggtttttcttgcaactgccattcccttttgtttttctttttatattttttgttttattgcaaaatttaagattcaaactaaatttgaattgtggctttgaattttcagtttgcaaatatataatggaattctaatatgaatatgaacccctactgtttgcatcaattatttatttttttcttcctattatttaattctagaggggatatttaacttcattggaattttattttctctatttcttccttttgaatgttttttgaattcaagtagggtttaagtcttcagattcccattaagatgcacctcatacaagaacaccagcatgctatgcaagatttatttctatttactttacgtgtgatcaccaatgcaagcacattcatataggaattttagagcaagtccaatagactcggtaaatagtctctgctcggtaaaaaaatgaaaatcgccgtgaaaacaaattccaacagactcgccttcgtcctcacttctccatcgtgctcggcatcacctctccgtcgctagccatatttcccgagctgttgtgactcgccatctcccacgagcacgccctcccgctcccgcgcactgatgctctcgctcccgcgcacttgcccttgagttttgagaactcgcctccgtgacctagcaattccgccgcattcttcgctagccctcggtcatccatgtataggccgccgcatccccgtacaacggaggctggggatattgggtcgctgaccggatctgcagagaggcttcttccttcccagtttgtgccaggacgcctggaacaagagccaggtagaggtagaacagaggtcgactggatgccagacggtgtgtccaattctactccattcgacggtgagaaggcctacactgctgagatggtggtgcaattaattaatttttatccttgttgtttattttgcacgaacagaggaattgtttgtgaattggatgatgttgagatccctaaacttctgagatgcctgttgtattgcattgttaattaagatactcttgaattagataatcgcatattcatttctatgccaacatcaaaacaaagactgttgggaccatgcttcat

SEQ ID NO: 752 - DNA, 2044 bp, Zea mays
tactgtctcccggacaacaaagatgtaacacccctggtgtttatattctgctcgacaacgagtatggatctaagcacgcaatatcagtggataaaatggatgtcaaattttaatcatcttcgtctatcgcaattttaatatcgcatctgtttcatcggtcgtgagttcggcatcgtctttatctatctgggctcttcctaaatttttgtgatgttcggaacgtcgttgttccgaaaatcggtgtgtccggtgattatttaaaattcatcgctcgtgcgaatactaattcggaagctcgacacactcggataatgtttatccccaaataaattaagtagaactcgatgacaaaaaatattcagggcaaaataatctgaatcgcgcattgtccgagaaaaatcgtgcgcgaggttatgatcccgtttattcttcggcacacctgtaaaataataaaatcaactgtgtttagatatcggataaatttttatccgagttcgactaaacgagtgttgcctcaaataatatatccgttgctttttgccttgatttaaatcttcggatataaatacctggtaaagtttatctgactacaaaatattcactacatcaaatattcgggatgcagcagatcagtttatccgacctcgaaatatccgcaattgtagttaaaaaatagatgaaaagaaatttcaattttttctagctgatttttccaccgatttcccttccatatccgaagtcgctagcacctggatattttctccacgtcgtcctcatcctctcttcgatctccagcgcacagccttatccccgcagccgccctcgcctgacttttcccagcggtgctcgtcttctacgcgcctagaccttctcctcctcaagccgcccagccactcctctctccctgtgccgcgacgctccctccctgcttcttccttcctgcgtcgcgcccgggcgccctgcttcctgcttgccgttcctattcctcctaccatggatcgtcagtctgagcttccccatccgagctcggccaaatcggatctcgctcatggcggctccccctattcggcaccgcctcgagctgcctatgtcgtgcgccctgcttgccctctcctccccatcttccatggcgccctgctcggtccgcgtgcccctgcgctcgcccaaggcgccgaccgcttatcccccttctcttacggcactcctgctcatctccctggctcgcccaggcagtgggcgcgctcgcctcagccggctgtggtggacgcgcagacctcctggccgtgggcggcgctggcctaggccgccgtcgcgccgggattttggcgtgcgtccctgcttccctatagtgctgaccgccgtcgttctctgcctgtgacctccggccgtgttggtcgtggttcctaccttcatctcactggcatgctgccaggactcgcgtgcgccatggctctggttgccacgctctcgcgcctccctgggctccttttgccgcgtccagttctggtcactgttatccgctgaaccatcgtcgcgccgggttgcccctgattcgtggagttcaccagctttcccgtgcgcagtcgcggatgtcgtcgctcggcccttgtgttgtgccgagctcatcaccgtcgcttatccctgacgctcgtccgactcaatgtctctgctctagcatgctatttggcactcggtcgtgcccagggtgtcgtgcttgttgtggtcggctctggtggtcggaatcgtcacgctgtccgtcccgcctggccctcaaatttactctgctccagcagtccgaactcactagctcttatgcctctctgcgctcgcgtgccactcagtaccgcgtcgttatcctactcacattcagctttgtcgtgattgctgggcattgctcgacgccctggcatcatgtctatatttgtgtctgccatcgtcgtcaagttctttttgtggttgcctcgcctgtgtgtgtgggagtgagaatagagctatggttgaagataaaaatgaagtctgaaagcgacgctcgtcagggctccca

SEQ ID NO: 753 - DNA, 2043 bp, Zea mays
gccgcgacaacttgtccagatcgcagctgctgcttcgacatgaattacttgctgccgagcacaatggaggttggggagcaggaacgctgcgcagagaaacccacggttgcgcgcaggggtgaactcggctgggcacgacgattggagcaggcggccactggggcagcgcccaggtacgcacgacgagaattcgagcagggccagtgcgcaccgaccatggaaaagattcgagctgggctgaatccgagctggagctcacgacaacagggagcagggtgagccagagactggaagacaccatggcgagcagtagggagcttcgatggagagaggcgcgaccggaaggtggagtagggagatgaacgggcaggggaggcgcgcgccatgggagatggctgtgcgagcgcgttagggagaaacgccggctacacgcagggcaaactcgacacgactgccatggacgaggtgggcgagtggaggaacgacgcgatggaggagcgcgacttgcgttggagagcagggcagacagactaccatggaagatcgacttggcgagcactggcggctggagaaagtcgaggggaggtcgaggagctgaggggctgcgcagtggatcaagcagccatggaagagcagagagtcgactgggagggaggagatgggacggcgctgggatgtccgggaccagggctcggctgcaggaggaagatgtgagaacgagcgcctgctgctgtgtggagaggagagataatgttgaggaaaaaatctgcagaagaagataaggctgggagaggatgcacacgtagaagaagatattctaccggttacccacttaagcggcgacgaagacaaggaaaaaatgcatcgaatatgattgctggcaaagaaaatatcgatgacgaccaatgatattctaggaagtttacgtacatgagaagaaaacaacgatagagaggtattttctatagtgaaaaatccaaatacgttgaaaatcataccaaggaatgatggaaatatttagagaaggattttccctatttttccttcttttttttaaaacaacaaaatacgcatattttagggtatgaaattagagtctaaaaaatatacaaaaggatcaaacaaaaatgagaccgacaacaatatttagataggatttgatttggtgaatactctcagaattagatgaattttcacatgctatttatatgcgaagttttggatctggccgagaaacacgaggaccaaaacactatccggatagggtacttgagactctattaatttagttgaactcagataaaaatttatctattttccgaatcgatttgatttctctacctagaataccacactaatgaataatcccaattgttaatcttgtgcacggtttcttggtaacgcaagcgatccggagtattcttttgcacctagtattatctgatataaaatcaaacgttaatctctttgtctcggataatatcgggttcggataggatgcaaatagaatgaacccaaacgagattgagactgatattttaaactatatttgatacgacttggaatcagataactttgtctgccactcgaacatctgatcactctgccatagatgatttattggagaatcaaatatcaattataattccttggttagcattctcgcgcatgatttttctcagacaatgcgcgattcagattattttgccctgaacattttagtcgtcgagttcaaattaatttgatcgggataaaatcatctgagtgggtcgagattctaattcatattcgcacgagcgatgagttttaaataatcaccggacgcaccaattttcggaacaactatgttccaaacatcatgaaaatttaggaagagcccggtagataaaaacgatgtcgaactcgcgacagatgaaacagacgcgatattaaaatcgtgataggcgaagatgattaaaatttagcaactgttttatccactgatattacgtgcttaattccatactcattgtcgagcggattataaacaccaggggtgttaca

SEQ ID NO: 754 - DNA, 2043 bp, Zea mays
aaacctgggatataacaccccaggtgtttatattccgctccacaatgagtacggatttaagcacgtaatatcagtggataaaatggatgctaaattttaaacatcttcgcctatcgcgattttaatatcgcatctgtttcattttgtcatgagtgcgacatcgtttttatttttatctatccgggctcctcctaaatttttgtattgttcggaacttagtcattccgaaaattggtgcgttcggtggttatttaaaattcatcgctcgctccaaattcgtatttggagcctcgatcgactcttgagatttttatcccgggcagattaatttggactcaacgacagaaatgttcggagcgaaataatatgtatcgcgcgttgtccgagaaaaatcgtgcgcaaagttattatccaatttattcttcggcacactctgtaaaataataaaatcaactgtgtgtaggcatcggataattttttatccaggttcgactaaaccagtattgtctcagaataatgtatccgatatccagtccgttttcgtgttgcccgaaacagtcacgaaaactatccgaacgagatttagtcagaatcgtatacctcggattttccgtttcttaattcggaaaataaagtgtgtagccagttgtcgtctagtgcgttgatccttttgttgtcgctaaaaatctcgatccacaaatatctgagatttttcggtaaagaaattaaaaatctgaaaaaggaaaaatatctacgttcctatcctgaagccgctcaagctgcggaataaatcctgcgcgtcgttcttatctccctcacgcgcgcgtcttcttctttccctctgcgcgctgcttcttctccaccgcgccccagccccagtgcccaggccaaccgcgccaggccttcctctcccctagctcgcggtttcctttctcctccttccatttctctccagccaaagcccctccctgctcggagctcctcggggccgcgccccctctgctcgccggcagaagctcccaggcgcgcgtatctcccaggcgagcttccctgcttcccagccgtcgctccctgtcgaatctctgctctgcgcgcgccgtgattttccccatctccacggccgcgccgcagccgcccagctgcttctctctcgctctgctcgcttcagctcggcgattcctccctgcccagtccgtctccaagctctcggcgccgggattttctgcggactcgcctcactgaccgcgcacagccgagcggttccccacgcgcgctgctgttctctgctcggagcttccctacgcgcgcgcctgcgcccagccgagctactgtttcccctgctccatcttcctgtcgcgcgttcctcaagctctctgtgccggtcgctccttccatggccacaccttgccaagatccgtgctgagctcccctgccgctcgctctcctccatggcgcccggacctccctgttccctgcgcccaagttccattttccccagccgactctgctgcttgctcccctgcgcgtcgtgctcctttgctctctgtctgcgcgcacgctgtgctcaacgtcctcccatggcgctcgatgctcctctgttggccgcgtcgtgaagtctctgcgtgccgtgctttttcctcctctactcagtgctcctgcttcagctcgcccctgcgctcgccggcgcttgcttctggagtctccttgccacgcgtcgagctcgcctgtctgcgcgccgcgttcccttgtcgtggttttctgcttccttgccgcgcgcgtgctgccgcgaagccccctgtttagttctcctctgtcgcgttgtcatgcgcgcgaaactgctcgcagtcgacatccaatctgtgacacgcgcgttggacacagtgaaaagctacgtgtgcttgtgtccgagcccaaccgtgacctcgctttgctcctcgcgtcactgctcgccgagtctttcctcggtccgtgatttctccctgcccgtcgttgcatcgttcgtcgtcgtgtgtgcaacaacgtcgctgattcctccatggtgcc

SEQ ID NO: 755 - DNA, 2042 bp, Zea mays
ttgagagatctcttcctctcaggtccctttgtcgtttgtgtgtggaggctagcaagtttcgctgactggattaagagatagagaggggagaaatcctgtttgtctcactgccacacacagggagaagatctctggtttgatgtgtccgaggcacgcgtcccaatgccatctcctggcacatgacagaggggttagttaggcacatttttgttaatggggccattaggattctgtaacaccttagaatcatagtttaggtaaattagaaaaagtttatctcaaaaatttaaataagtatgtttttgaaacaagaagttaaataaaatatccatatacgaatgaaagtacccttagttgaattatatatactctaaaagaattagataaatgatattttgagaaagattatacattagaaaatattttctaatgaaacaaatgaatatgaacatttgaatacactttcagttttactacacattcaaaattatattttctaaaaaaagaatgtgtgcatacttcatatttgaaagcatttgcatgaatgaacaatataatatatttaaatgagtaaaaaagttatatttagcattcatgctgtgatctttgattgtgcatatgaatttaatttataaattctatttgaaactgactggagatttaaaatagaaaaaatagaaaatagaaaacaaaataaaggtgccggttgggccaatttcatctaactaatcgagatgcacttgccatacgtgtttttagtctattctttattcctttggccggagcttacctcagcatgacctcagcactgatgttagcatgcaaacaaaccaggaagtccacacgatcgtgctcttagacgctgggatgtgggcccttttgtcagcttcgtcctcagccgtgagtccattttgccggtaaaatagaacaacctccgtgcatcctgcatggatcctcggccaaagctcgcgcccatgtccttttgttcctaggtctctcgatcagatgcatgcatgactttgttggccggttgggaccttctggaaccactcgttccctctcttgaactgctatttctcttctcatcgcgtccctccgaaatccaagcataacagaccagagtttgttaggatttggaggatcaaatcttaacgaagtcatccaggatacgattccatcaggtccatggctgccacctccatcccgattttccctagggatgcacttaaataatccacgtcgtgcgcactcctgcgtccatggccgcagatctcgctctccgttgaacgacgcccacctttcgcccacctgctcggacttagtctagagtataaatcggtgtcctccccaacccaatgcactgcgccgcctctgcccttgcgcgtcccagccgtactcgtccatggggtgccgtcgttgagagacttgggaaaagcttgctgccacagactcgagctatgtccactgctcggggcacgtcgtcgatccgccagggcctagaagtttatcctcccccgccgccagctgaggagtgcagctcggacggccaccgattcgggttcctggcactctggcagccgtctcccacgcctcgtccgcgatctgggcacgccggaaaccaagttggtgccatcgctcgtacagggcggacctgggcgctatgaagtctctcacctgcgcctcgttgactgtgcttgctgcccccatcacgacccggaaatctccgttcgtgctctggtggtcgcgttggagctttttcaaccaccgtggaattgcgggatgccatgggcgatggtctgcgaaccgcgacgtgcaagaactggtaagaacaccatggtttcccctcgctacctccgcttacattgtgtagaaccatccggttgataggaattgggtgccgagtaacctcaagcgccgtgcgatatttcccaccgcgggggagggtcctgcggcatcgtgctttggcgaggtggaagatgggtccctggccgaccgatcaaaattggtaggataggattgggggaaaggcgcggggaaatatg

SEQ ID NO: 756 - DNA, 2040 bp, Zea mays
aatccctcagttatcctgtatcatacctcagttattgtaatgtgcccactcagttatgcggtgtttattactcagttattctctattcacagtcagttattgcgttcaagtaactcagttatgctattgttcattactcagttattttgttgtgcacactccgttattccatgttcactactcagttattatctgttcattacttagttattccgttccaacaactcagttcttctaatggacgcactcagttattatggtgacagaactcagttattccatgttcgtcactcagttattcttttgtcggaactcagttattctaatgggcgcacatagttattctggtgtgatgactcagttattctcgtgtgcctactcacttattctctgctcattactcagttattctctttgtaatcactcggtagtggggactccgttattctctattcacagtcagttattgcgttctattaactcagttattccatgttcgccactcagttatttcattccaacaactcagttattctaatggacgtactcaattattctggactaatacctcagttattcttgtgggccaactcagttattctactccgatcccttagttattccgttctaatacctcagttattctctgctcatgactcagttattctagtgggcgcactcagttattccatgttcatgtctcagttattctggagtcggtactcagtaattctagtgggcgcacttagttattccatgttcatttctcagttattctcggttcagtactcggttattctgtgttcatcacctagttattctagtgatggaactcagttattctctgctcatgcctcagttcttgtgggccaactcagttctactccaatccctcagttatttcgttataataccttagttattccatgttcttaactcagttattctaaaccctcagttattatgttataataccgcagttattccatgttcctaactcagttattctaatgtcggtactcagttattctaatgcgcgccctcagttattccatgttcaacactcagttattctttgtacgttactcaggtattgtgcgttcattactcagttattctagacgacgcactcagttattcgagtgacagaactcagttattctactccaatccctcagttatcctgtgtcatacctcagttattgtaatgtgcctactcagttattatatgttcatgactcagttattctgttccaacaactcagttcttctaatggacgcactcagttattctggtgccagaactcagtaattctgttccaatacctcagttattcttgtgggctaactcagttattatggtgtgtagactcagttattctggtgtcggcactcagttgtttggttctgatccctcagttattctatgtttgttactcagttattgtgcgttcattactcagttattctaatcgacgcactcagttattctactccaatcccttagttatcctgtatcatacctcagttattgtaatgtgcccactcagttatgttcctaactcagttattctaatgttggtactcagttattctaatgcgcgccttgagttattccatgttcatcactcagttattcgagtgacagaactcagttattctactccaatccctcagttatcccgtgtcatacctcagttattgtaatgtgcctactcagttattatatgttcatgactcagttattccgttccaacaactcagttcttctaatggacgcactcagttattctggtgccagaactcagtaattccgttccaatacctcagttattcttgtgggctaactcagtgattatggtgtgcagactcagttattctggtgttggcactcaattgttcggttctgatccctcagttattctcagttcgttactcagttattgtgcgttcattactcagttattctaatcgacgcactcagttattcgtgtgacattactcagttattctactcgaatccctcagttatcctgtatc

SEQ ID NO: 757 - DNA, 2039 bp, Zea mays
ttccaatagcaagcactaaatatgctatgggaaggacaaaacaaaggaattttaggaagaacaaagtaaccaaatagcgaacatataatctatgcagataatgcaatatgaacatcatatattacatgttaagtactattgtcaccctaaatgcctagaccgctatgtaagacaggcatcatctatcctagtgtgaaattaatctaaccaaaccaccatcacaacaagataaatgaacatagcactttgaaggtatgagagaattaacaaacagaaataatcacattctggcttgcatctagaggacccaatatctaccatggaccacatatgaactatattctacaaacatacgacttattcattcatacataggatatggatggaagtagttcaacttgtatttctaaaaaacattttttagagtactcgaatcatccaaaaactaaacataataccacacttttgacctaataggtagaacatcaaatccgctactcaagcaaaattagcatatcactatcggtaagctacttaacccctctatcacagtcctaatacaatcacatatacattcatcaacacaattgaatcgtccttgcaaccctgctaacatctcttccatggaagctcgacgaactaaatttatcacactatacacaattcacctttccacttaagtttcacccaacaaagatgatgcatcggctacacttatgagcataaccacatactacatatgaggggacattttaacaaatatttaatgtaaccacaacacatatgtgccactagaaaggaattcatcgtaaccaatatactaactcaatctacttcacgagtcggctagcgggagtagcgaaatagttcactacaccaaactcgactcggatccgtgaaacgacgacgaatcctagctcaggcatttaatcaaacagcatacaagccccttaagtctattttcagattgggaatgcaactaagacatctattcaatccaccacatagctaggatatatcattatgcaaacacctcatgagcaaaaatcacagttctagagagctcccagacagcacagcacgtccgaacctgactcgacgtatgctaaaactacgatgactctagtctacgcaattcatcgaatacctagcatgtgacgctttgaggcttgcttctccatacaattagggaattcttttgctccgatctcacacacattcgacacaaccaagatttctcacatgctcaacacaatcaataaccgggaaaagggctaaccactgtagacccgatgtcacggggcgagggcacaccgtttagcggcacaaggtgtggagtaggcaggggctgggagatgccatgtcgtggagctggggcaagctcgccggcatccatggccaagagctgagcatgcggccagtggaatggcgaggtgggggtgcgtcccatggccaaaggcaaggacagaagctggttgatagaggagctcggctggtctggcggtctgcatgccacagagttggcgattgggagagggctcggcgcctagctaatggaggtgaggagcgatgggagcctgagcacaaggagcactcggctgctgctgcaccagcattggggagctcgaccgtcggcaaggtgagtggctagtgagggatattacatacaggtaaagcctccaaagcagctcatgtaataagatacaaatgaggttatgtgaaggactttacttgaatacgtgcatttgataagaacacgagggaacattggagagaattcaagagccaatcacgtatataggataagagcacgactgtaagaggtggcggtggaatagggactcagcatggtggagtgacacgatgaaaataacgtggcaatgaagatgtttccaggagctgagaaatcaatagataagagtgacgtgaggaatttttttccaaggttgctcgttcataaaataagagtggagaaaagaatcaacttggatagagagatagatcgatgggaaacaaacaaacaaatttaccttcttctc

SEQ ID NO: 758 - DNA, 2039 bp, Zea mays
aaatcggctcaccgttccaatagctgactcgaatccgcgagatcggtaatgattctctgatttaggcaatttctcgagcgcttggcagatactatccgaacttcacgcaccgcaccatccaacctttggacatcttctcttggggctttttttgtcagcacgactccaactcggaggcatcacgtagggaccgacatcgagacgggtgaccgaatgacgacggcaagacaaaggttggagacgacggctgttgtaatgggacgtcgatacacgatccaaggcaattaggagatcgacgtaggcggaactgatagccgaacaggaactgcgcagatcgacaacgcgaggttcgatctggcgagcacgacgctagggatcgcagctgctgcttcgacatgaattacttgctgccgagcacgacggaggtcggggagcaggaacgctgcgcagcgaaacccactattgcgcgcaggggtgaacacggctgggcgcggcgattggagcaggcgaccacttgggtagcgcccaggtacgcacgacgagaattcgagcagggccagtgcgcagcgaccatggaaaagatccgagctgggctgaatccaagctggagctcgtggcaacagggagcagggcgagccagagactggaagacgccatggtgagcagcagggagcttcgatggagagaggcacgacaggaaggtggaccagggagacggacgcgcaggggaggtgcgcgccatgggagatggttgtgcgagcgcatcagggagaaacgccggctacgtgcagggcgaactcggcacgacagccatggacgaggtgggcgagtggaggaacgacgcgatggaggagcgtggcttgcgatggacagctgggctgaccggctgccatgggagatcgacttggcgagcaccggcggcttgagaaagtcaaggggaggtcgaggagctgagcggctgcgcagtggagcaagcagccatggaagagcagagagtcgactaggagggaggagatgggacgacgctgggatgtccgggaccaaggcgcgactgcaggaggaagatgtgagaacgagcgcctgctgccgtgtggagaggagagataatgctgaggaaaaaaatctgcagaagaagataaggctgggagaggatgcgcacgtagaagaagatattctaccggttacccacttaagcggcgacggagacaaggaaaaaaatgcattgaatacgattgctggcaaaaaaatatcgatgacggccaatgatattctaggaagtttacgtacatgagaagaaaacaacgatagagagatattttctatagtgaaaaatccaaatacgttgaaaatcataccaaggaacgatggaaatatttagagaaggattttccctattttccttctttttttaaaacaacaaaatacgcatattttagggtatgaaattagagtctaaaaatatacaaaaggatcaaacaaaaatgagaccgacaacaatatttagataggatttgatttggtgaatactctcggaattagatgaattttcacccgttatttatattcgaagttttggatctggccgagaaacaaaaggacccaaacactatccggatacggtacttgagactctattaatttagttgaactcagataaaaaattatctatttttcgaatcaatttgatttctctacctagaatagcacactaatgaataatcccaattgttaatcttgtgcacggtttcttggtaacgcaagcgatccggagtattctttcggacccagtattatctgctataaaatcaaacattaatctctttgtctcggataatatcggattcggataggatgcaaatagaatgaacccaaacgagatcgagactgatattttaaactatatttggtacgactgaaatcagataacttcgtctgtcactcgaacacctgatcactctgccatatattatttattggagaatcaaatctcaattataattccttggttagcaatctcgcgcatatttttctcagacaat

SEQ ID NO: 759 - DNA, 2038 bp, Zea mays
tagcgaaaactttgaagcttttcgaagccctaaattatgtggtagatttacataatgatccaacatgttgtttcacgggctccaccatcaactaaaattcaacaaaatgaataacttgagtatgggaccaacataattagatggtcgcaagccgattaaagttcagtgttttaaagagtgagataactttaaaagtatttgaattgctatatgcagatttttcaagataaactattttgcagagttatgacctctttcaaaggaaaaatagttaatggaagaaaaattatatttccactttcattactcttttctaaatgtcgtactgcaagacatacttgtttaggcatgttaccttaaaacatatataatgatatttgcaatgttccttagttgtgaacacatcaagccaagtttaaggccaatcaaaacatgagtatgagactaatgagtattaatttcatataagtttactgcatgatatatcgatttctagtgtgcgtcaacttcgatgcatttggaagccctaaatgttgtattgtttagacatacagtttttacggatggacccaacttattgtttcgcatgcaccatcattaaccaatgttcaagacaaccataacatgagtatgcgacctagattgcagcatgtttgcactagatttggtcatatgaaggatgaggtgactctagaagcgcttaaagcataacatgtagattgtttccagatcatgactttactatagacgtgagctatccaacatgttatttcacatacctcatcatcaacccaagtgcaagacaacctatagcatgagtttgggcccaagatattagatgttcgaatgctagcactagagtttacagatgtgaagaatgagttaactttagaaatgtttaaagtgcattatgtatattttttagatcggtaattttccggagttgagatctatatttttgcaatcctgcttttattttgatccatgttttaagatacattgttattattctattatagttatatcaatgatatttataacaaaagaattaaatatagaaaaaatttcattccaattttaattacaatttgctctatgcgagactataaataatactagtttaggcatgctatcttaaaccatatgtagtgctattttatatatttcttggttatggacaacaatgcatgttttgaggccactcaaaaaacaagtatgggactcatgatatttactacaaaacaatttaaccaatgaaaattacattacaatttgctctttgccaaattgtaaacattacttgtttgggcatgttatctcataagatatgtggagaaatttcaaatgtttcatggttatggacattaatgtaagtttgaagacgttcaaggccctaaatgatgtaatgtttagaatgaaagtttttacaaaaacgacccaacaaggtttgtcatcaaagtttttgcaatacaatgatttgggagtaaatggtcatgatttcgtgcatgttttcttgaaaagattgtggcatgaaccatgcaaaaactttgaagctttttgaagccctaaattatgtggtagatttatagaatgatccaaaatgttgtttcacacgctccaccagcaactaaaattcaacacaatcaaaacttgagtgtgggacccacataattagatggtcacatgccgattaaagttcagtattttgaagaatggggtaactttaaaagtatttgaattgtaatatgcagttttttcaagataaatgattttgcagagttacgacctatattaaaggaaaaatagttaatggaagaaaaattatatttccacttttattactcttttccaaatgtcgtactgtaagacatacttgtttaggcatgttaccttaaaacatagacaacctatcgcatgagtttgaggcccaagatattggatgttcgaatgctggcactagagtttgtaattttctggaattgagagcaatatttatgcaattctgcttttattttgatccatgttttaagattctttg

SEQ ID NO: 760 - DNA, 2038 bp, Zea mays
atagtttgtagatatgaagaatgaggtaactttagaaatgtttaaagtgcaacatgtatattttttagatcggtaatttccagagttgagagctatatttatgcaattcttcttttatttcgatccatgttttaagattctttgttattattatattacagttatatcaatgatattaataacaaaagaattaaatatagaaaaaaaatcattccaatttgaatttcaatttgctatttgccagactataaacaataatgctttaggcatgctatctttaacttcatctagtgctattttaaatgattcttggttataattaacaatgcatgttttcaggccactcataaaaagtatgggactcatgatatttgtcacaaaacaatttaaccaaggaaaattacattacaatttgctcattgccaaaatgtaaacatcacttgttttggcatgttatctcgtaagataagtggaaaattttcaaatgtttcatggttatggacattaatgtaagtcggaatcggttcaaagccctaaatgatgtaatctttagaatggtagtttttacaaaaaggacccaacatggtttgtcatcaaacttttcgcaatacactgatttgtgagtaaaagagtcatgattttgtgcatgttttctcgaaaagattgtggcatgaaccatatgaaaactctaaatcttttcgaagccttaaattatgtggtagatttacagaatgatccaacatgttgtttcacacgctccaccatgaactaaaattcaacacaatcaataacttgagtatgagacccacataattagatggtcgcatgccaattaaagttcagtgttttaaagaaagaggtaactttaaaagtatttgaattgcaatttgcagatttttcaagataaactattttgcagagttacgacctctattaatggaaaaatagttaatggaagaaaatttatatttccactttcattactcttttctaaatgtcatagtgtaagacatatttgtttaggcatgttaccttaaaacatacattgtgctatttgcaacgttcctccgttgtgaacacatcaacccaattttaaggccgatcaaaacatgagtatgggactaatgggtattatattcatacaagtttgttgcatgatatatcgatctgatgtgcgtcaacttcgatgcattttgaagccctaaatgttgtattgtttagacagacagtttttatggatggacccaacgtgttgtttcgcatgcaccatcattaacccatgttcaagacaaccataacataagtatgagaccctagattgtcgcatgctagcaccagatttggtcatatgaaggatgaggtgactctaaaagcgcttgaagcacaacttgtagattttttcagatcatcaatttactataggcgtgagctatgcaacatgttgtttaacatgcttcatcatcaacccaagtgcaagacaacctacagcatgagtttggggcccaaattattagatgttcgaatgctggcactatagtttgtagatatgaagaatgagataaatttagaaatgtttaaagtgcaacatgtatatttttagatcagtaattttccagagttgtgagctatatttatgcaattcttcttttatttcgatccatgttttaagattctttgttattattatatttcaattatatcaatgatatttataacaaaagaattgaatatagaaaaattttcattccaattttaattacaatttgctctatatcagactataaacaataatagtttaggcatgctatcttcaactatatgtaacaccctaaagttcaatcccgtgaaaatgagaaaaattctccaaaggtttttaaatcaaaacacctttccttgagaatattcataatttcaaagttactactcccaaaattaatataaatttttttgactaaaataaaaagatacctagataaaataaattgttcttggagtgaaattataagaattattattaaactatatataatctacaata

SEQ ID NO: 761 - DNA, 2036 bp, Zea mays
gagttcaaatgtttcatggttataaacattaatgtaagtttgaagcagttcaaagccctaaatgatgtaatgtttagaatggtagtgtttacaaaaagcacccaacaaggtttgtcatcaaagtttttgcaatacactgatttgggagtaaagggtcatgatttcatgcatgttttctcgaaaagcttgtggcatgaatcatgcgaaagctttgaagcttttcgaagccctaaattatgtggtagatttacagaatgatccaacatattgtttcacactctccactatcaactaatattgaaaacaaccaataacgtgtttgtgggacccacatagttagatggttgcatgccgattaaagttcagtgttttaaataatgagataactttaaaagtatttgaattgcaatatgaagatttttcaagataaactattttccagagttacgacctctattaatggaaaatagttaatgaaagaaaaattatatttgcactttcattactcttttctaattgtcgtactgtaagacatacttctttagacatgttaccttaaaacatatatagtgcaatgtgcaatgttcctcagttgtgaacacaacaacccaagtttaaggccgatcaaaacatgagtatgggactaatgggtattaatttcatacaagtttgttgcatgatatattgatttctgatgtgtgtcaacttcgatgcattttgaagccctaaatattgtattgtttagacagacagtttttacggatggacccaacttgtttcacatgcactgatttgggagtaaaggctcatgatttcgtgcatattttctcgaaaagattgtggcatgaaccatgcgaaaactttgaagcttttcgaagccctaaattatgtggtagatttatagaatgatccaacatgttgtttcacacggttcaccatcaactaaaattcaacacaataagtaactttagtatgggacccacataattagatggtcgcatgatgattaaacttcagtgttttaaagaatgaggtaagtttaaaagtatttgaattgcaatatgcagatttttcaagataaactattttgcagaattacgacctctattaacggaaaaatagttaatggaagaaaaattatattttcactttcattactcttttctaaatgtcgtactgtaagacatacttgttaatgcatgttaccttaaaaacatatatagtgctatttgcaatgttcctcagtgttcaacacatcaacccaagtttaaggccgatcaaaacttgagtatgggactaatgggtattaatttcttgcaagtttactgcatgatatatcgatttctgatgtgcgtcaactccgatgcattttgaagccctaaatattgtattatttagacagatactttttacggatggacccaacttgttgtttcacgtgcaccataattaacccattttcaagacaaccataacatgagtatgcgaccctagattgtcgcatgctagcactagatttggtcatatgaaggacaaggggactctagaagcgcttgatgcataacatgtagatttttttcggatcatcaatttactataggcgtgagttacccaacatgttgtttcacaggcttcatcatcaacccaagtgcaagacaacctatagcatgaatttggggcccaagatattggttgttcgaatgcaggcactagagtttgtagatatgaagaatgaggtaactttataaatgtttaaagtccaacatgtatattttttagatctgtaattttccggagttgagagctacatttatgcaattctgcttttatttcgatccatgttttaagatactttgttattattatgttatagttataccaatgatatttttaatagaagaattaaatatagaaaattttcattccaattgtaagtacaatttggtttatgccagactataaacattactactttaggcatgttatgttaaaatatatgtagtgctatttaaatgattgttggttatggacaatat

SEQ ID NO: 762 - DNA, 2035 bp, Zea mays
tatgtcacgaaatttacatttttcacctagtttaacctacagcaacgatgaacacataaatataattatcctagaatgactcactagccgagtgcggaagtcaccaagcatgctttaggatttaccaaatttttgccgcactaacacattaatgtacgatgaagcatgttagcaaaccattaacacattcacgaccaatccctacgacgcaccaaggaactatcgcagccacatatctatccaatccaacaacaaaataacacctcggctcacccacgcacctaagtgtccccataatacgcacaaggcatcaaccgtacaagtgactccaacaggattactcatactcctcattcgcctcgactatcccaatcaccgatcactcgcaaaaaacaattacacttttcacataaacacctatcgatgcatctcccaaaacataatccgcattttgtaacttagtttttcgcatcaaacaatgtatcgcatattcttcctaccaagatataaaaacatccgagttcttgttctacttcattttcttctatatacgtgtgcattcatacaattataatttcacgcacatattcacacatgcacatcatcgactaaatacgtaaataaaacaaatagcgaatcattcaaggcgaacaacctggctgaaatccgatcggagttgcacatgcatgccatcagattgggctctttgccgacgagcgacgcgcgaggcgtgacgacgacacgggctgcgagcatggcacagtttattacacgatttgttggtgcggccattcaatcgaacacgaaaagcgtaggacagcggggtctcaccatgggttccaacgacgacacgtcggcactgtgcagacctggcgaagcgagacgaggagacggtcgaaccgcgtagatcaacgacgcagcatggggctgtccaaacacccacgcgacgctttgggtcaggactgcgcagctccatgttggcgtacagaaatccggagcatgctgctgcggagagggagtcgagcagaggcactgcgcggagcaccagccgtggagaggctcaccattagagctgaggggaggggggcctcctgctggttttccatggaagaaaatggggttcagggaacaacagggggaggggcattgagcgttgtggagaagaagggcgcagctccctgcacttcagctcaagggaaacagagaggagggagggcactgggcagaggatatgagctgggcgcagggaggtggaggtgccatgggagggagaaactgggctccctgctgaccgccatggaaaccagggaggaagaaggggcgcactggccatggagcagaggcgtcgctaggggaaaacaccggcctgctcaagccagggcagaggcatggagcgcccaagaaaaaccaggaaggagggagctcgtggggaggtaccctgttaccgagcgccatggatccacgggggaaatgaaggggttgctgccctacgcgcgcgctgcagcttgatcgaggaaggggaggagacgccatggacagggagggagctccctgcgtgctgccgtgtgggagaaggagcgcgtgctgctgtcatgaggaagaagagatagggaagcaaggttgtggcggctgaaagaaatggaggggtgggagtgcaaagttgccaagtgcaaggggagagggctcctatttataggcatgtgctagggttagggttccttagttggcctattgggctggaatgggcttggcccaaaatactgaatcgggttgcgctaaattattttccggaataaaaatgctcctgcggaattcgtttttgcggagaacagagcgaattagagttccgacgaacggacgattgagcgattaattcggccgagagtctgatttgaattcgctcggaaataatttcctacgcgtgattcgaaaataaatcgtcttgagatatgaccgactttcggatttatgatcgaaagaaacaatttgcgacacctaaaaatcatcgccgatgttgatttttgaaatcggattg

SEQ ID NO: 763 - DNA, 2035 bp, Zea mays
ccttacaccacctcaaacatataatatcatttcttctcaactactaatccaagtaaactctcaagcacatttcatcgaacaccattatgcgtagccaatggcgcgctttgcagccaaaagatgggctccactagtgcggcggtaacggtagcggcaacggccatggtttgcaggcggctgtatcgaaggcggagtgaccgattttccctatgatttcccttataccacgtcaaacatataatatcatttcttctcaactactaatccaagtaagcaatcacgcacatttcatcgaacaccattatgcgtaactaatggcgcgctttgtagccaaaagatgggctccacgagtgcggcggtcacggtagcgacaacggccatggtttgcaggcggctgtatcgaagacagagtgaccgattttccctatgatttcccttacaccacctcaaacatataatatcatttcttctcaactactaatccaagtaaacactcacgcacatttcatcgaacaccattatgtgtagccaatggcgcgctttgcagcccaaagatgggcaccacgagtacggcggtcacggtagcggcaacggcaatggtttgcaagaagctgtatcgaaggcagaatgaccagttttccctatgatttcccttacaccacctcaaacatataatatcatttcttctcaaccactaatccaagtaaactctcatgcacatttcatcgaacgccattatgcgtagccaatggcgcgctttgcagccaaaagatgggctccacgagtgcggcggtcacagtagcggcaacgacgaaggtttgcaggcggctgtatcgaaggcggagtgaccggttttccctatgacttcccttgcaccacctcaaacatataatatcatttcttctcaactactaatccaagtaaactctcactcacatttcatcgaacaccattatgcgtagccaattgcgcgctttgcagccaaaagatgggctccacgagtacggcggtcacggtagcggcaacgacaatggtttgcaggaagctgtatcgaaggcggaatgaccggttttccctatgatttcccttacaccacctcaaacatataatatcatttcttctcaactactaatcaaagtaaactcccacgcacatttcatcgaacaccattatgagtagccaatggcgcgctttgcagccaaaagatgggctccatgagtgcggcggtcacggtagtggcaacgaccacgaattgtaggtggctatatcgaaggcggagtgaccggttttccccatgatttcccttacaccacctcaaacatataatatcatttcttctcaactactaatccaagtaaactctcacgcacatttcatcgaacaccattatgcatagccaatggcgcgctttgcagccaaaagatgcgctccacgagtgcggcggtcacggtagcggcaacgaccatggtttgcaggaagctatatcgaaggcggagtgaccggttttccctatgatttcccttaccccacctcaaacatataatatcatttcttctcaactactaatccaagtaaactctcacgcacatttcatcgaacaccattatgcgtagccaatggcgcgctttgcagccaaaagatgggctccacgagtgcggcggtcacggtagcggcaacggcaatggtttgtaggaagctatatcgaaggcggagtgaccggttttccctatgatttcccttacaccacctcaaaaatataatatcatttcttctcaactactaatccaagtaaactctcacgcacatttcatcgaacaccattatgcgtagccaatggcaagctttgcagccaaaagatgggctccacgagtgcggcggtcacggtagcggcaacgtccatggtttgtaggcagctatatcgaaggcggagtgaccagttttccccatgatttcccttacacctgtctcttatacacatctgacgctgccgacgagaatgcctgtgtagatctcggtggtcgccgtatcattaaaa

SEQ ID NO: 764 - DNA, 2034 bp, Zea mays
caatccgattttaaaaatcaacatcggcaatgaattttagatgtcacgatttatctctttcaatcataaattcgaaagccgatcatatctcaagacgatttattttcgaatcatgcgtagggaattattgccgagtgaagtcagatcagactctcggccgagttaatcgctcaatcgtccgttcgtcggaactctaattcactctgttctccgtagagacaaattccgcgggagcatttttattctaggaaatatttagcgcagcccgattacgtgttttgggctaggccaacctagcccatttggaaccctaaccctaggactcctctataaatagaagtgcctccccttgcaaattggaaaatttgcatctaccccctagccaccacagccttcttcctcctctcccacacacacgcagctctcttcttctatgttcatggcacaggaaatttcctccccgcccatggcgtccttccctcctcccccttcttcttcctcaagcaagtaggccaacctctcctcctatgctatttcccagcgccaccttctttttttcccctgtctctttcttactcatggctgcagcagggagctcagctccatctcccatggcgctcggtgcccctgcagcagggcgccattcttccccagggacgcctttgctctagctggccttcttcctttcccccatccgagcgcccaagccagcgcccttccctgctccatgggcgcgagctccaccccctgtaatggacgctgcgcgagctcaccccatgggcgtgttccctgctccatgaccagcaggaagctagcgcccctctcctactcggccacatcagcgcacagagagttcttccccacgccaccctctttctttcccacgaagcaagcagggaacacggccaacgttatcttcctccagtggcttcctccctgccacgtctcacctctggtagacgccctgcacaacgccctctctcccatggcgagcaactttcctccctatggtcatggtctgcgacaggaagtcgtgcgctacatgtttgatgttttgcgcagcagccccgacgtctccgcgtgctgcctgctcgctgttttgtgaagcccagtggacagcacaccgtcgacgctcaccggttgtttgctgtttttatgcagccccaacatcgacgtcgttcacccccggtgagtcaccccgctgcccttgctgctatcatatttttgtgctcggtaaaatgttgaactgttgtgtgtgtctaatcgcagctatccgtcaatgccattcgtcgcgcacgcgtgttcgatacaaggccagtcggttgaaccacatgcgagcacaacacaaatccgatctagtctaggttgattgatttatagtttactatacgcatgatttggttaatgtcatgcagtgcatgtatatgtttagatgtgtgttaaatgtttaggttatacacattagtagggtcgcatttgcggttggagaacaagaggttgtttgatgtgtgcgatttgtagtttgtctaattatgttttggtcgatgtggtgtatattggtgtttgaatatatgtggctgcgatggttcatttgtgtgtcacgaggatggttcgtggaggtattaattgtttgttaaaatacttcgtcgtaaagcagtgtgttaattgtggtaaatctaataaagcgtaaagcaggcttggtggtttccacagtcggctaatgagttagtctatgttaaatatattttatgtattcatcttggtgtgggttagagtgggttgaaaatataaattatgtgatatgtgattagtgttttaaagaagagatgtgcgaataatcagttggtgtttcactcgtctagttgataagtgttgtcataattaattgtgctaaaatttggtcacaagaatgcagtgggcacgtggtgttggttggatgtgataagtagattggaagtgtgggtttgtctgagcactgtgttgtcgaacgtgtatgtcgaagtgcattgtagtaattgttggggacttgttctc

SEQ ID NO: 765 - DNA, 2033 bp, Zea mays
ctacgcgtgtgtgcatctacattttttatttttttgcatagcaagtctagtttcatttctctccctctatatgtcactacagtttaatttttagccatagtttaggagttgatccaacgatcatccaaaacatgtggaacttacatgatgaggtatctacaagatatagttaattaaccgaaaagtctatgattacaaattgaaggtgtcttggttacatttcttttgatatgcttggttcccttgaaaattctatcgtcgcaaacgtaggtatttttagttttgcttaaaaaaaggtgttttagttgataagattccttttttgatgtttgggaacggtcgaacggatcacgtgcaaactaagcacttggtgtaaaaccatgcaaaccaacatgtagttggaggtggagggggtatttagaaatataacaggggaggtggaagggttgttttgacagctgatgcacggtgggagggttattttgtaatttttccatgactccttgcacgatttgcacgaagtgcttggtttgcacctgatatattgccttgatgtttatctattttccactagtctagggcaaacatctcattatattgtttcacttctaactttcttatgttccatgataatcgaactaattttatgttctagatatgaaagtagtttttataaacttagtcaaacttttagtattttacttaaaaagaaagtaagttactaataaataagtaatagaaagtttttaacttctacatgcaaacccttgttggatcgtaataccccatttgaatcacaattatcgtctagtttcttctttctaataatgaagggttctacaaaacttgtttcaccgtggtcttagctaggtttcctttgtacaaagcaaagcaaatgagaatatggtataagagtttaggtctcatgttaactttcctaacaagcatgtggctagacttgtggaaaatttccattgcgtcatctatgcctccacttaattcatgtgttgtgcacataaaaaagcgacaactataatcctatgtatttttttcataagaatcatgtattacaatggaaccaacttttaagttgacataggaactagggttagaactccttcaacaaggacaacaatgcctatattgaagcaatagcaaatcaatcatatgtcctagagtcatgaatgataacaacttatggtcaggttttgtgaacttatggtcttttggtatctattttgtttgaccttttataaatggaaggaatatatgaaggaaagtatcattcatgaggtgtagcaatatgatatgttgctatatgtttttagctatctcaacaaatttcaacatcttaagaaagtttgtagaagttaaacaaatatacttcaccatatgaaaaagtaaataaaaaattgtagcttgcttaatcaacatttgtcatgtacttgtgcacatgtttgctcacacaaaaaagaaacccacacatactcacacaaacctttaatagttcgttgacatatgttaatagttatgtacatttttcaggtacataaaccttaataattatgtagtcttgaatagttccactagacaaattaaacattaatatacagtttttagctaccctgagtccacatgttaataattatgtagctagatcttttgatgatcacgatatatcagctagaatttattttggtaattgctctaggcatgaaaatcatattcaaaaggctgatgaaaaataatatttgtgctcatagttttaatgatactagcaatatgtagcatacgtctaggaactttcatgcatctacatcctagcaaatatgtatgccgatgatctaataacatgcatgttaagtttaaatagccattttaatagtatgcaacaagatatttcattctttaattcatcacctgagaatgtacaattatgtggttctacagtaaaataggtcgtgaatgatttgacttcagatgttaataataaccctagctaaatcggttttttttttaaaaagtatgcaaat

SEQ ID NO: 766 - DNA, 2032 bp, Zea mays
gtgcggcggaccaacgcgcagtggcaccggcaagctctaattcatcgtagaggagaagaaccgggtgggtcgagggtactctacagagcaatcctagccacgaagtgggtcgataaagcgtaccgaggacagcgcgggctccggtgaggagtttgggacatctagggccacaacatgtgcaatgggtggagctgcatcggccggacgccgtggaggtgcagcggaccgacgcgtagaggcaccggcaagctctaattcgccacagaggagaagaaccgggcgggtcaggagtactctagcgagcaatcccatacgtggagtggggcgatcgagcgcagcgaggccagctcgggctctggtgacgggtttgggacatctagggcctcaacttaggcaaggggtggagctgcattggccggacgtcgaggaggttctacggaccgacgtgcagcggcactggctagttctaattcaccgcagaggagaagaactgggcgggtcaggggtactctagcaagcaaatccaaccacagagtggggcgatcgagcgcactgaggacagtgcgggctccggtgaggggtttgggacatctagggcctcaacttgggcaaggggtggagttgcatcggccggacgccgtggaggtgcggcggaccgatgcgtagtggcaccggcaagatataattcgcctaagaggagaagaaccgggcgggtcgggggtactctggcgagcaatcccatccacatagtggcacgatcgagcgcaccgaggatagcgcgggctctggtgagggatttgggacatctagggccacaacttgggcaaggggtggagctgcatcagtccgacgctgtggaggtgcggcggaccgacgcgcagcggcaccagcaagctctaatttgtcacagaggagaagaaccatgtgggtcgggggtactctggcgagcaatcccagtcactgagtggggcgatggagcgcaccgaggacaacgcaggctccggtgagggggttgggacaactagggccacaacttgggcaaggggtggagctacatgggccggacgatgtggaggtgcgtccgaccgatgcgcagcggcactggtaagctctcattcgctgcagaggagaagaacggggtggatcgggggtgctctggcgataaatccaagccatggagtggggcgatcaagcgcaccgaggacagtgggagcttcggtgaggggtttgggacatctagggccacaacttgggcaaggggtggagctacatcagtcggacaccgtgtaggtgcggcagaccgatgcgcagcggcaccaacaagctctaattcgccgaagaggagaagaaccgggcgggtcgagggtactctggcgagcaatctagccacggagtggggtgatcgagcgcatcgaggatatcgcgggctcccgtgacgggtttgggacatctagggccacaacttgggcaaggggtggagctgcatcgaccggaggtcgtggaggtgctgcggaccgatgtgcagcggcactggcaagctctaattcaccaaagaggagaagaaccaggcgggttgggtgtacaattgcgagcaatcctagccacggagtggggcgatcgagcacaccaaggaaagcgtgggctccagtgcggggtttgggacatctagggccacaacttgggcaaggggtgaagctgcatcggccattcgtcgtgaaggtgcggcggaccaatgcgtagaggcaccggcaagctctaattcaccgtagagaagaaccgggtggatcgggggtactctgacgagcaatcccagccacggaatggggagatcgagcgcactatggacagggcgggttccgatgaggggtttgggacatctagggccacaacttgggcaaggggtggagctgcatcggccggacaccatggaggtgtggcggaccgacgcgcagcgccaccggcaagctctaattcgccgcagaggagaagaaccgggcgggttgggggtactctggcgagcaatcccagccac

SEQ ID NO: 767 - DNA, 2032 bp, Zea mays
caaaccgaattcaaaatcaacatcgacgatgattttaaatgtcgcgatttgtctctttcaatcataaatccgaaagccggtcatatctcaagacgatttattttcaaatcatgtgtagggaattattttcgagcgatgtcaaattagactctcggccgagttaatcgctcaatcgcccattcgtcgaaactctaattcgctctgttctccgtagagacaaattccgcgggagcatttttattctgggaaatatttagtgcagcccgattacgtgttttgggccagcccaacctagcccatttggaaccctaaccctaggactcctctataaatagaagtgcctccccttgcaaattggaaaatttgatctacccccctagccgccacaaccttcttcctcctctcccccacacgcacaactctcttcttccctgttcatggcgcagaaaatctcccagccgatgctctccccctgctgcccatggcgtcttatccacctctctgcttgggtgctggccgagcccccttggagcaggcgcctccagcagccatggcgtccatccctcctccccttcttcttcctcaagcaagcagcgcccttccctgtgctccagccgacctcctctgcccgcgctcctcatcccacacaacaacacgcagggagcttcctccatccatggcgccctcctttcttccttctctgttccagaccggcatcagggtagtgcgcgcaaggctctcctagccgtggatagcacccttccctccctcggattccctgctcgccccagccatggaccatcgcgtagagcgccatcggcctcttgagcacgctctccacggccccggcgtttccccctgctatctcctccccatggccgcccgcatttccttgctgcggctccttcccaaggccagcgcccctctcctggttggctccctctccacatcagcagctctggatttctgtacgccgacatggaactgcgcagtgccccgtggtgcttgcagggtgctcgacaaaatgcgcagcagccccgacgtctccgtgcactgccggctcgctgttccgtgaagcacagtggacagcacgccgtcgacgctcaccgatggtttgctgtttttgcgcagcctcaaatatcgacgccgttcaccccggtgagaccgcgatgctccttgttcgattccgcatcggcgttattttcatatgattaattgtgtatgtgtgttgttttttttgtttgtggaggaggggaccccgtgttttgcgtgcaggagaaggcaagccgctcgacgctcgtcgatgttcggagtgatgcacaaatcggaatcgccatcattcttacaaacgtcgattgggtttgtttatggtgagtcgatgcatgtcgctctcaactgactcgattaataaattatatagatgtggtttaaatgtttcggcggtaggtcgtagtatggttgtgttcatgatttcgagttagagattggtggttgatgattcgtataaattggtcgatgtggtgcatgtgtaaaaattgtattggtatggattgaagtttgtggcgaaaaaaaagaagtagcaaagaactcgaatgtttttatattttgataggaatatatgcgatgtgttgttgatgtgtgcgatttgtagtttgtacaattatattttagttgatgtggtgtacattggtgttggagtgtgtgtgggtataaaatgttttggttatatgtcgtagcaaggttgccttcacgttttggtaagcaaacatgttgtgttgtttaatgtgatgaataaattggaaatacatgggatgcgaggatttaattagtgcacgtaggtgtgtgtgtgtgccgtggtgtgatatagtagtggtggcgtgagatatttgtttgaggtgtgcgggtatatgtcgtgatatggttatactcgcaacgagaaaagatgtacacattgggtaacacgacacttaggtcgctgttgtataatcgaataaaggatgtattattgagcttaagtcaaaatgtggggtac

SEQ ID NO: 768 - DNA, 2031 bp, Zea mays
gggttgaaaacgaacgggtaaaatctcaccctggcccatacggttttccacatttgacccgtctattttcgtatttgcggaaaattggaaacgagacacaaatgggagagggtctattctgtttgtttttacgggatctcattgttatccggattgaacccatatttatcatgttttaagaaatctaggatgagcccaatatacattagtgcataaactaaagcctcatatccttaagtaaaaaaattataacacaagcgatcattctagccactagctctccttaatgacaagtggcctaaattctcaaacaacattgaccgtagctattattacaccactagcaagcaaacaataacggaatgttgtctctatgtatctgtttattttatgttattgcactgcttatcagtcaccaatcaggtatcaatatcatgtgtgcttgtattaaattacgagtttccacttaatattttcgttttcgtacactcgtttacctcgctctcgtttacgttccctactcttttggacccagtcccgtttttggtgataaaatacagaaacagaaacatgaaagatgtttttccatctgtttttatcattacatggcatcatgtggtaaggtggggaagatcaaaagatatagcttggctatgatggaccgagttgctagtgtgaaggacaagtaagaggcacaagtacaatgaaccgtgtggtgacaaaggtagagcaagaacatggcatcgatggaccaagtggcaagtgcaatggtgaagagcaatagaagttgtgctcaatgaacgaataaggccacacgatagcataaagtagatcagtagtcgtaagcattgcttatacaatctcaacctattttaaactttacttttataaatagtgtaacctacaatataaatccactattttatatgattgacagtgaacaacctatgacgacatgcaatgcaaagatagggtcgactggcttgagttgacctatgcgctacaagtcacgagtgtggagctgtactacaagcgacaaacggagtgctcgccttgggcgtgcaagtcaagcgcgaaggctgatggcatgggtggcagcatatgcgctgcaagcattggcagcgtgccgagacaaagcccgcgtgtagcaatgatcgtagcgagaggcaagtgctgctagtcctcgtttgttcggtgtgcttactctctccaataaagaactataaattgttctgtccgctagatataacgtgtggttggctactttattcattcaacaaccttcgctaaaagctcatctatcttaccagatgctacagacgtctgccaaatatagagtcttcacgtgtccttctcggattcgctccgagttctctgtagctcgagactcgagactgtgctccgaagccgtgcttgcatggggcttctgcgtcagcgtgcacgcgctaccgggagtcagctttgacggcacctgcaacctcagcggtgctcgggccaaactcagctgccggactgccggagcttgccaagagcttgcagtcgactgaagcttgctgcgtaagaagcaggtggcaacgtctttattagttactttacctaatatgtactccctccggtttcctattagttgtcgtttaggacaatgacacggtctccaaaatataactttgaccaatatttttattaaaatacaaattaactcttaatatatttatacttttataaaagtactttttatgacaaattggtgcatataaatattatgttccaaaactaaataacgaaatagttatttgtagtcaaaattttataagtttgattcgaaccttatccaaaacgacaactaataggaaactagagggagtatacgttattcttttttaataatatttatacgttcaaaatttgtagtagtgaaaaaatattaatttcatcatttttaatgccgaacgctagaactattttgaaatatataaaaataatgaataaatatagtagtttatgtattctgttaacaatgtagatatagag

SEQ ID NO: 769 - DNA, 2031 bp, Zea mays
aatctctactacttcttaagaggctattgtaggcgtccacaacgctggtggttctgccgcggacgcgtccgcgcgccctccgtcccgccccgccccgaaatctcgcatcgcatcaatggaagtcgtgcccgtgcgttgcgccgcctcccccgccccttccatgctcctctcgcgccccttccatccccaccgtgctccatgccccagcctccaccatccccgccccatgagtcgtccccgtcctcagaaatctcgcgcccccggaaatctcgccccgctcccgccccaaaacctcccctacctcccacccatatcggagcacgtggacctcccgcagtgctgtgatggctggggacaccgcagaggagggatcctctccaagtcctgtgacgcggcgttcctcgatggaggggacgacacggaggaggggtccatggggcggtcgtggtcgttaacgcggctccacgcgtagagggacttcctgcacgcaacaatgttggtcgccgagcgtgcgttccagtcaccgaacgcgctcctggtcctggagaaggtgctcgccaagttcctcgtcatgtaccctaactacgcgtccgcctcagacgtgggccgcctccacgacgatcagtacccgcacctggacaaggtatgcctccactgcgacacgagagccccctccccccatccccgcaatgctcgtcgtgacagtccaccaccccgtgcagacatcgtggagcgtgtcgcccagcaaaccgtgcacaccatggctccacccaatcccactcttccccatggcttcaacgccgcgacctccgccgccacatcgtcattcccctaggaacctgctcccccactgtcattgtacgtcgtaaccaccttgcctcaaaaccaatgcgaagaagtatacctgcttaatttgagcatattatcttagtatgccttcaagatcatcataaattgccctgatctacattgccgcaatgcagaatgtacatttgttttaatcatttgtgaagtataattgccctgatcatcataaattttggatttcaatggttcaaggtaccctgattatttctggtgtgcattatgcatctttagttattttgcattggttcagcacataatgtgtgttttctcattgttgtacatgtcactatactgctgatagaaacaaaaaattagcaacaatattggatttaaggcttctatgctacatattcagtgttgttcgctcatgctgtatctgtcggcgcgtgagcagttattggcttagtttctaatgtccacattcccatctctgtttttcttctttcagaacttcttcgatgatcttttggaccacccctgctgatataaacacaatcattttgtggcaggaaatcaccatattagagttgacaaccttcacatcatctgtccttttgtaattgtttgtgcaacaatgagtttatcttaagttctgtttttttggtaatatcggtttactgcacttaagtttttgataaagcatctttgatgtcacttctaggaagaatttgacactcatgatccaaaggagaacactttgccacccccttacttgaggaaaaggtcaaaaataattgagatagttgcagcacgtggtatagtctttgctctatcacagtcaggagtatgggctacttttagtagaggtatggtattcttgccttcttacaaccccttttctgcttgctctggttgtcctaagattatctttacatagtagcattttcaacaggtaaatttggtacgattgtaagaaggcaagaataactttttactccatttcaggttcttcgaatcagttgaggacattgaagcttctcagtaggttgagctagactgctacagagttggagcatttgattcttgaaagtggttcctagatacaaatactcactagcatattcctttatgtgatgtaccataaatatgtatttgaacatatatagatgctatcattcaccgtccatacacagttgattatgattttgcagagacatttaaaga

SEQ ID NO: 770 - DNA, 2030 bp, Zea mays
tatcgtctgctcgaccacgagtgcagactttaacacgtgatagcggtaaataacagtctctctatcttaatctgttttgtttgtcgtgagttcgacatcgtttttatttttatcaatctaggctcgtcctaaattttcgtgatgtttggaacataattgttccgaaaatcggcgagcctggtgattatttaaaattcatcgctcgcgcaaagacaaatttagaaacttagtttagtcctccgactttgtccgaaacgagatttattagaagtcgacgactaaagttttcagtgccaaataatttagtcccctctcgtcaagcgagacatcgtgtctgaggaattataatcatgatcggtttccaacaaattatccttgacaaagaaataaaacaggttcaaatggcagataaatatttgtccgatttcagctgcatcaaatatcatctgatgtagtgaagccggtattattttggatctggttgtttacgtgttgctcgagaaaaacaatacgccagctcattaatcgaatcgttctgcagtcaaatgatcgaaagcacgtgagactcgtaaaaatttgactgtgttaaatatagtctaaaatatcgaagccgaaattagtttggttcagtctgtgtgtttcttgtctcgatctaaatcttcaaatagaaataatgggtacgaattaatctgacttcggagtagtcatcaaatcaaatcgtgtccaaatatttgttctcatacatataacagtaaaaaaaagagaaaatatctcttatcctcatctcccaccgttgataagcattgatatttttttcttcatacgtggataccatatctttgttcctatccggtggttgattattctgcaacgcacaagtgtgccagccgtatcttctttgcctctcggttcttcttggacactctctctctcacctcgtcattctctctcgcgggacgttgctccctgctagtgcctggacgctcgcctcactcagctctcgttctcctcgtccccatgctccatccatggcgtgtgcttgccagacaccgatgtgagcttcctatgttcttctggccctgctctagttcgccacggtcacgcgctgttttccccagctcggatttcaccagccactgttctctggtccgtgtgccggtcggcgtcgtggagttttgtttggtcggctcgtcgttgacctcgccggtgtcgtcgaaccccttcctcaattgcgtcgggtctccatgccggttgtcgtcgttcgtcgtcgcgtcgtgtgtgcaataacatcgctgattcctccatggtgtatgtcgacggacttcgcttcatcggctcctcgcttttggttcggctcacgtatgcaggtcgaacgcattcgccgcttgaccctttgtcactagagctcatggcctcgccaacgacggagtcctcactggattcgtgtcctcgctagagctcgcaataacctgctcgaccacacctcaccagctcgctccagactcgacctcgttgttgttcggtgcgtcatcaagaaatccaaagagttgagtgaagacgaagctagcatcttgaaattcaccaagtactcgacgaaaagcctgaactataaatcatcgtggttcttgaagagttcgcgtcgaatttaatcatgggtgagctgattcgctactactattattttgttttaattaatggattgatagatatgtaggttgcgacgatcctttttatttagcataggtgcgcttagtgattatgtttagatccgttgttgtgttggtgtgttgttccgtggtgatataattatttttagaattataaagtagtcgggtcaggggttaaggtctagaattttgataaaaaaagttatgtgatagatattttgtctgtagcacaggcacgttgtggttttattatatgtttcataaaatgccttgttacatgtattgttgcaactgtgttcgtgattgacaaataattgtgtcgcgtagagcttaggtttaaaatgcatattatgctaggagtgt

SEQ ID NO: 771 - DNA, 2030 bp, Zea mays
catatgaagtgttattttaaatgattcttggttttgaacaacaatgcatgttttgaggccactcaaaaaacaattatgtgactcatgatatttatcacaaaacaatttaaccaaggaaaaatacattacaatttgctcattgccaaactgtaaacatcacttgtttgggcatgttatctcataaaatatgtggaaattttttaaatgtttcatggttatggacattaatgtatgtttgaagcggttcaaagccctaaatgatgtaatgtttagaacggtagttttcgtaaaaaggacccaacaagctttgtgatgaaagttttcgcaatacactgatttgtgagtaaagggtcatgatttcctgcatgttttctcgaaaggattgtggcatgaaccttgcgaaaactttgaagcttttcaaagccctaaattatgtggtagatttactgaatgatcgaacatgttgtttcaaatgctccaccatcaactaaaattcaacacaatcaatatcttgagtatgggacccacataattagatggtcgcatgccgattaaagttcagtgttttaaagaatgaggtaactttaaaagtatttgaattgcaatatgcagatttttcaagataaactattttgcagagttacgacctatattaatggaaaatagttaatggaagaaaatttatattttcactttcattactcttttctaaatgtcgtactgtaaaacatacttctttaggcatgttacattaacacatatatatagtgctatgtgcaatgttcctcagttgtgaagacatcaacccaagtttaatgccgatcaaaacatgagtatgggactaatgggtattaatttcgtacaagtttgcttcatgatatatcgattttttatgtgtgtcaacttcgttgcattttgaagcccgaaatgttgtattgtttaaatagacagtttttgcggatagacccaacttgtttcgcatgcaccatcattaacccatgttcaagacaaccataatgtgagtatgcgaccctagattgtcgcatgctagcactagatttggtcatacgaaggatgaggtgactctataagcgcttgaaatataacatgtatatttttttcgtatcctaaatttactataggcatgagctatccaacatgttgtttcacatgcttcatcatcatcccaagtgcaagataacctatagcatgagtttggggcctaagatattggatgttccaatgctgggactagagtttgtagatatgatgaatgaggtaactttagaaatgtttaaagtgcaacatatatattttttagatcggtaatttctcggagttgagagctatatttatgcaattcttcttttatttcgatccatgttttaagattctttgttattattctattgcagttatatcaatgatatttacaacaaaagaattaaatatagaaaaaaattcattcccatttttattacatttttctctatgcaagactataaacaatactagtttaggcatgctatcttaaaccatatgtagtgctattttaaatgattcttggttatggacaacaatgcatgttttgaggccactcaaaaaacaagtatgggactatttgctcattgtcaaaatgtaaacatcacttgtttaacctaggaaaaattacattactatttgctcattgtcaaaatgtaaacatcacttgtttaagcatgttatctcataagatatgtgggaaattttcaaatgtttcatggttatggacattaatgtaagtttgaagcggttcaaatccctaaatgatgtaatgtttagaatggtagtttttacaaaaaggacccaacaaggtttgccatcaaagttttcacagtacactaatttaggagtaaagggtcatgattccgtgcatgttttctcgaaaatattgtggcatgaaccatgcgaaaactttgaagcttgtcaaagccctaaattatgtggtagatttacagaacgatccaacatgttgtttcacacgctccacc

SEQ ID NO: 772 - DNA, 2029 bp, Zea mays
ggcttcaccgggcgcaggccgggtcgcccatttggccatctctggcgcatgccttgagtcctgatcccgtcgctaactgttcagctgctagggattttttcacgcatgcagattttttgacgcttgcatgcgctcgcccaggcccgcgccgtctctactcctgttgtctcccatggacgagcgcccagccgagctcctccctcgtctccatggcgcgcgctcctccctgcttccctgctccgctcgacaacaagctcatcctgcgcgcggccctgctcctcctctggtcgccgtctcccagcccgaccccgccatggagctcacgaacgcctcctgctgctcagccttggacgctggatcccgcgcgatcctacgccatggcacctaggcctctgcgttcctgcagtagcgccgttctctggtgtcggcaagccgtccgatcgtcgaccttgttgccatcttcctattccagaagctttgctgcagtcctatgttgatctcgtcgactacctgtggtgtggtcccttgcttgcttgtttttgggagagaagttccaggtgtgggcggtgaagacagcgaaatccaactgggacgcctgccaagtgctagacgtaaagcctaaaataggatattatccagctcatcattgtcttcttgtttggacagcaagttccaccgttcatcggcgacccagccatggcgcacacgctggtcgctctccatatcgtgctctggccgtgtgttcggcctccggacttcatcgttgccatggctgcgccttctccctacgagctcctccacgtcgtgctgcgccatcatcaccttctatcgcgagctcgatccccgttgtcgtcgcttcgccgtgctcgctggtcgtgcactcgtgcgtccctacagctccttgctccgtaaaataagtgaaccagtaagtgccattgtttttgtgaattttgagttgaattactagttgtcgatattatgtgatggtcgcaagcactcgatgtgaaagaatggaattaaatgaagaagaatgcgaggtttagcgtgatgctcactaggtgctcgataaattacgtgaatcacggaaccctcaccgacttcgctgttcttgcgattatcgagccagattcagttatggtgagttatttcgctatttcagtcaattagcttaattggtggactaagtagaatattagtaggcctgtgtcatgaggaaatgtcttgatcgcttgccattatatgttggcatgtgcgattgaaaagaagatagattgtttgataaagtactctggtcgaaatatcggtctattagatttgttgtgatcctatttatgtagtacgattgtgttcacatgtctgtagtagactcactgtatatatgtgacgacatcgatagattgttttagtagtcgtcatattttctaccagtggccgatcaagtgtcatggttggttatttcttgttgtttttccaagtatttagaatcgagtagcatctatagatctactctaattaaaacccgagatctacgaattaaaagatgtgtttaagtatttcagatattctaattttaaggttttcaaggtatgggagttcacatttgtgacatatttgcgtcgtatgaaatataggtttaagattccatttatgcgaagagtgctttggtgggtatatatgtcgagtatatttaactagattttatgtgcgtgataggtggtgatattaagtgcttgcaaaattttttgttcatgtagtttagcattttcttgatgttttattcggttagtgtgttatgcaggttaacccaaaaaaggagctggttaggttgcttctattcgtatcttgaatttaggtgtccggaagggctaagcctatgtttcgttagtctgttgatgattacctagcttaggcgtttataggtcatgtctatggttattgttttcttgagatttgagctagcccggttaaaccgggcgaacgtgattattatgctagcgagtcataggtatataggatttacttacaagag

SEQ ID NO: 773 - DNA, 2029 bp, Zea mays
tgtaacaccccatgtgttactgtacgtttaaccgcgaatatggacttaacaacgggatatcgatgaggataatgacttttatgtcctaatcatcttcgcgtatcacgatttcattatcgtatctgttgtcatccatctagactcttcctaaaaatatttgtgatgttcgaaacaaattagcgagtctggtgattatttaaaattcatcgatttgctcaaatatgaatttggaaacttagtttagtcttccaatttcatcccaaacaaaatttattagaagtcgacgactaaagtttttagtgccaaataatttagtcccctcttgtcaagcgagacatcgtgtctgaggaattataatcatggtcggtttccaacaaattatcctcgacagagaaataaaacaggttcaaatggcagataaatatttgtctgatttcagctgcatcaaatatcatctgaattagtgaagccggtattattttggatctggctgtttacatgttgctcgagaaaaacaatacgccagctcattaatcgaatcgttctgtagtcaaatgaccgaaagcacgtgagactcgtaaaaaattgactggattaaatatagtctaaaatatcgaagccgaaatcagtttggttcagtctgtgtgtttctcgtctcgatctaaatcttcaaatagaaaaaatgggtacgaattaatctgactttggagtagtcatcaaatcaaatcttgtccaaatatttgttctcatacatataacgatgttgaaaaaaagaaaatatctcgtatcctcatctcccaccgttgatatgcattgatatttttttcttcatatgtggataccagatctttgttcctatccggaggttgatatttctgcaacgcacaagtgtgccagtcatatcttctttgcctctcggttcttcttggacactctctctctcacctcgtcattctctctcgcgggacgttgctccctgctagcgcttggacgcttgcctcactcagctctcgttctccttgcccccatgctccatccatggcatgtgcttgccagacgctgatgtgagcttcctatgttcttctcgccctgctccagtttgccatggtcgcgcgccgtttttcccaactcggatttcaccagccgcagttctctggtctgtgtgtcggtcgacgtggtggagttttgtttggttggctcgtcgttgtcctcgccggtgtcatcgaaccgtcgaaccccttcctcaatcgtgtcgggtctccatgccggttgtcgtcattcgtcgtcgcgtcgtgtgtgcaacaacgtcactgattcctccatggtgcatgtcgacgaacttcgcttcatcggttcctcgcttttggttcggatcacgtatgcaggcagaacgcatttgccgcttgaccctatgtctctagagctcatggcctcacgaacaacgtagtcctcactggattcgtgtcctcgccagagctcccactaacctgctcgaccacacctcaccaactcgctccagactcgatctcgtcgtcattccgtgcgtcatccagaaatcccaagagttgagtgaagatgaagctagcatcttgaaattcacaagtactcgacgaaaagcctgaactataaatcactgtggttcttgcagagttcgcgtcgaatttaatcatgggtgagctgattcgctactactattattttgttttaattaatggattgatagatatgtaggttgcgaagatcctttttatttagcataggtgcacttagtgactatgttagatccattgttgtgtcggtgtgctgttccgtggtgacataattatttttagaattataaagtagtcgggtcaggggttaaggtctagaattttgataaaaaaagttatgcgacggatatcttgtctgtagcacaggcacgttgtggttttattatatgtttgataaaatgccttgttacatgtattgttgcaactgtgttcgtgattgacaaataattgtttcgcgtagagcttaggtttaaaatgca

SEQ ID NO: 774 - DNA, 2027 bp, Zea mays
ttaaaagacactagggtttgaggcgctctccgcgtttcgcggcagttccgccccacggtgtgccgacgtgtggccgcattattcgattcgacggagctgtcgatgcgttcgcccctcccaccgtgtaaaaaaagaaaaaacatggactctcctccccttctctcgagtctcgatagcaaaatgtcctaccgtcgccgcgacaaggagaaggcctgcgaccgcgacaaggagatgccccgaccgtccgccgcgagcccgagtgaaagcgctcctggtcccggtctccgttggcagatcgggaccgctctcacagtcacaccaccgccactctcagtgttgccgaggctttcggcggtgggtgacgacgacgtgaatgcggaggaaccgaagatgaatatgatgagcattcccgttgggttcgactccacagaggtaatgcccctctctctccctcgcatctctgtctcctaacccgagattagctaatccgtcgcttattcctattctcgttcgaggtaccgaacgagccgacggtgtcgacgaagtcagggctcctgttcgagcgatagctcatccaaggctacatcgaggtccgtagctaggtcccggatcttgtgctgcaaatcttttgttgggatcgggaaagatgtttgtgctaaattgatgtcgtgatggcgtgcgatcgtgctctactgggtatacacagttaccttctcggccatcgtgctctactgggtgtacgccgacggctaccagctgttccttcactgctggctgcttgaacggtacatgctccacacagtcacacactggacgatggggaggagaacctcgtcagcctctccacggttgtccgtggcgtactcctacagcagctcgtgcatgccatgcatcgacgtgatggtcttgttcatggtaaggagatagtctgtcttggaggttcaattcgatcggtggtacttccattgagatgaacaaaaccgagataagaatggtaaccattttgcagatgatgtatgtaagaacttcaccaggagatcaatccttgggtgggtgaatcggctagcaaagtagcaagcatgggtcagtatcaccagtttaacctgtgtttgccctgtcatgcttcagagtttaggtatctgattatttttccccaatgtctaccagaaagcatccagctttccagggtaagacacgttcttactcatcgtgcatttttctggtgaatttgtgcctgaaaattcttcttattaggatttatgcaattgacctgggtttttttaataaactgttacgtacgtagacagtagacagcaaccgatgagcagtatatgtttttttaacatcctgcaatgcaatttgtgttcatgtgatgctgccctatttctttataccttattatttgtccgagaagggatctgcatctgctacacacagcagcaacaacagacttattcctgggccatcttttcttagttgtgcatgaatactagcactttatctgctccttctcttcgacttctgtgcttgcaagcatgccaagactatccttatggacagtacaaagtgggatcagtagcagcatcacaactgggactggcagaatcctcccatgggacaatattattttctaaacaattcgtaatgtaatttaatatgtttctattctttcaacagacaacaccctacaacttctccgtgtagttttatatggttcatgtatatagctatgtggattgcattagccccaatatcatgtatataccaggtacacatcctaacataggcttcgatcctgtcatcttattttggattagtttcctacatcttatttttgattagtttttgttgtatcaggtctgatgttaaacctctatgtatgataacttgtgctaaaacagaaaacaactgctaccactgctttgttgctcagtttgtctcacactgatcagtttcatggaagattacatcaacaattatttattattgatttctccttgtgctagatagggcgcacgaagtgggat

SEQ ID NO: 775 - DNA, 2026 bp, Zea mays
ccgaatttcgaaataaattcaaatagtgttcaactaatttaagtgaacagacaaaacttcacatgaatgcaagagtataatttatgctttcaacacacaaaccataaataagaaaggagtaatttctaatgtgtaacattcattaaaaggtaattttatccatacttccttaagaacgtccctcagatatattattcaaagaagtaatttagttcatatgaagatcttttcgctttcatttagtttcttcaatttctttattataacacatatgaaactttaaatcctgaaaatacattctctagattactcaaaatattattttgaggtgttacacgagctattataagacttacgcccatgtctaactgtcgtagtcgattgtgaggatggagctaaaggagagcatggaaggtcctcatcgtcactagctctagtggatgaagaataccttgtcagtatcaacatatcctctaccagtcgaggttctatattgtcgtcaaccaaacaaagagaaggattatgcacaaccaaggtagcttcctcatcatttgttgcgtcctccaccaccacaggttctgtattgttctcaaccatagaatgtgaaggaccgtctttgatggttgtaagatagatggggtcctcaaatgtactttgtgcaaccaaagtagcttcctcatcatctgatgcgtcctccaccaaagcaagatcctaaatagaggtgacatcctgaagcaatgttgaggtctctgaaggcacctcaatggtcttctcgagaatcagctttagaagcccctgcaaccacctcattaggggcaaggtacgtctatctatgaaagtatgtaccagtaatccttctaggcatctcgccaaggacaaatactgtggtgtttgcactggtgtcctaacacaccaaggagtcgacagccatctaagccgatgtgagagaatcaaggatcaacgacggtgaatcgtgcttcactggagaataggtgccaaagagctcgggcaagtcgaagacaaaagcatgctccccatgtgcctccacatgctccaattggttggctacatgtgctagtcacaacttgatgatagaagcctcctcattgagaggttgcaacacttccttcaaacaagtcaaaggggtgatcaaggactgaaggttcaaaggtgtcaaggcaagaaaggcacaataacagctatagtagacaggatcgtcatccttaccacacaaaatgatgggttgagaagctcacagaggattgtgatatccttgcgatggagacttagtgaagacgtcaactaacaacgtacatggcaaaggcttggccactaccttagcccaagtcctcgattgttgatgatgatcacattgaacggaggagttaactcgaccgacaggagaggaagaccaaaagcgacaatgcccatctcgatgactggggcgacgccaacggatgcaatggaaggggttctcgcatgagctaacttggtgatcatgtgtgatgcagtcctgagccgacctcttgaaggcaaaactcttgtctaacttgctccttgcaacagcatctggcgacattggcaacatggtctaaaaagaggaaggatcgttgacgatgatatggccggtgatagagggtaactcagatggcgacggttggagacgagacctatgttagctttaagattggccaccttcattattggccgccttcattggcgacgacagctaatctacggaagagagtggccctacataaagcaggacagggataaacactcgagaacgagcacccgacgagctcgaacagtgggtctgagagggtgggaaggccaaagtcgtcctaggtggtgatagccataggctccccagcgatggcagcgggatctgcgggcggactcctcgagagcaggaggctacccggtgggggcggcgggacccacaaacaggctccacaagggcagcaggcaacctggcggcggcaacaccgagctaccgagcaacactaccggaatccagctcttt

SEQ ID NO: 776 - DNA, 2025 bp, Zea mays
aggggtgcgggatagcgagggctcaccaaggttcgacgacatcgtgaccggggctgtccaaatagtaagacgacgacgtgtgtcatggctgcacagatcgacgatgttgccgtgtgaggtcgacgtcgagacagggaaaactttctcgacgaaaatttttcgagaaaaccgaaaatcgcgtttctcgctagggcccagttatctatggagtttcaagaatgtattttgttttcatatctatgtatcttttgtaggtcaagatgaacaaccagccgctctccgtccaagatcaaaaaatgcagaagaagctctctatcaaaggcttgtacatgcttgagaaggttaagtacatctaaaattatagatgtgttgtctcagtgtttcaaatatttccttttactaattaatttgttgtcttactgttggaaaatatagtgatctaatcttcaagcacaagcacaagaatacggcgtatgcatggactcattcaatggcaagattttgaacatatggctctattgtatcagctctgtttcagtttcaccacaatattgctgatatatttggtttacgtggcctaccaatttttagaattgtgattgatttctatgcattatttgaactatgctaccaaagtactttatttatgtaatatttagtttatttggactgtctcattattctatgttctctatcgatatatattcgcagtcaatttgttattcattttgccatttatagaatcgttacatgtacatagtgacattaggtggtttctaaatgatctatatgttgttctgattaaactgagctgttcattctaaattttgtccgatttttttgagaaaaaacgaaaaatcggtgaggtccggttttttctgctaccggtaaggtaaaccctgacgtcgaccacagcgagtgcgatgaggcggagcacacgttgcaagggagctgtcgtggccgtgacggcgctggtcgccggcgtgtgttgggctgtgcagatccggggcggagcttgctacgatattccgtcgaacacgtcgagggcgcgacacgatggggttttcatgtttactgctgctgcacggccagggcgagcaccacaactggaaggtgtgggagagggcgacgtccacaccatgggaagtgagcagatgagatgcagcgatggggagagaccaatggacgagcagaaaggcatggcaagcttaccatgggtcggccatggcccatgggaggaagagcagggagcagaggaaatcgtccttgctgcaggaagggggccagggaggggcggtcatggcgaactggaggccgacagtggggttgaagccggatagagaaccgatggcgctggggcaatggaggacaagctcggacgtggaggtagcagacagggcacggccggctggtgttccacggaaacaactaggttggggtaacgtggagataagagagagaagcatgagcggtgggtaaaagaaaaaaaatcagatttttcttctcgaaacctttaacaaaagaaaaatatagatattttgggttctgaaatctaggtctaaaagaggtataaacaggtcgaatcaaacaaaactagcgacaaaatttgaaccagatttgattcgatttaatttgaaacctattcatccgcagtctaaacagggaaacatattaattacgaatactcaatatcggctctaattatctcggtccgatttaattctgcatcaatattgttgtcatcgagttctaataatatttacttgggtcaataatcacaagagtgggtcgaggttccaaattcttattcacttaatcaataaactttaatcagacacaagactcgacatttcgcgaaatacatacgcgagatcgatgtggcatcgaaattgtgatcctttcggaagcgacgtcacgcatcgttcacggggcgagaggctgggcgctgtccagacgtcggttagcacccgccacacgcgtcacgatgtcaggccacagagagacacgtgcaacgcaagcgtgaaa

SEQ ID NO: 777 - DNA, 2025 bp, Zea mays
gcaccggggcttgcctggaataaacactaggttagtgttgttagacgacgtccacatggcgaccatcttcaggtttgtccatcaacatcatcctgcggattagcctgtgctcggggtcgacttgggtcgtctttcgtatcgcgcgactaataagcgtacctaaatgatttgcataatgcacatgaatgcatagcactgacttcactgcacaactaaaatttttcgcatgaaatgccgatagcgtctaccggcaaagcactaaaattactaagcaaataaatccagcttacccacatccaacgtgacttaatacttgcgagaatgttgataaatcctggctcggcttgtcgttgaacatctgacgggtgtcgtgtggcttcactttcttctccataccttctagaaatttctctcaaacaacgaggatcgacgaggatcgcgaacatgacgagagggcgaaaaccatctatcacaacaactctctctatcccgcaaacaacatctaaaacagccatatgaagcagtgttgagatcttccacccccatgacccagatggggctgaccatggggaggcaaaacatgacgagacgcatatcggaagagttactgggattaaagttgacgacacgcatcatggcgaggcggcatatggcgaggaaaataggaacgaacgacgacgagggagcagcacactgcgtgggacttggcgaggtggaggtgtgtcgctgagtaacgctggtggagcttgctggttcgacatgggaggaccaacaaggtcgactgtcagtgagactagataatggagtgtagtccagcaccaaattgacgacagccacaagaagggcaaagatgaggtcgagcaaggtaaaacgggttcaatggctcgacggcagatgcgagcatgcgtgaaacccgatggatgagagcgggtgcgtcgcagtgacaacgagcagacgcacaagcgttaacgcgagccagcggcaagcacgagtgctgaggtataaccgacaacacctggcgagcacgaagcgaagcacacaaccgcgacgacagtcgaatcggcaacagagtgttggcgaactcgacgaacacgaccatggtcgcgtactgacgcggataggacaacgacagttgacgagttggagcaccagcgagtagccgacgcgagaagcaaagcgaggtcactgtcgggcagacttggacacaagcacacacagtgtttcaccgtgtccagcgtgcgcgttacggactcgatgtcgactgcgagcagtttcgcgtgcacgacaacgcgacgaaggagaactgaacagggagcttcgcggcagcacgcgcgcacgaacaacgtaaggctacgcgcgcgacgaggaagcagaaagccacgacaagggagtgcggcaaaatcctgggcacgacacagggaaccggccacggcgagcatagggacaaggcaaggcggagcgcgcgtcagggagaaacaccggcgacctgcgctacaacaaagctggagcgagctgggcaggaagtcgagatccgagcagagcaaacgcaggggcgcgacaagaccaaatccgagctgaagcagggaagaccgcggcatgggaggaacggctggagatcgagctggagttaggcgcgcagggagctgcagccagccatggagatggggtagggaaccgagcagacgccagggcgctggggctgggcagaacgcaaagaaactccaggaaagagaagctgctgggcagagggagctacggaaggaccgcggcgagcagagggcttcacgcgctggaggagtaggagccaggggcacggctggcgtccatggggaggaactggagggagagggaagcagggagaacgccacggctgggagctgctcgcggcagcaggcgcggtaccaagcacggccatgggagcaggccggacacgcgtcgcgagcagagaaaaagaaagtggagggaggagagaggagcgcgcgtgggatgggagcttgaagccaagctcgacgttgggggcgagct

SEQ ID NO: 778 - DNA, 2025 bp, Zea mays
cagctgttgccatcgtggtgccgattacccttgccaaccttgtcgttgtccatgattgcgccctcgccgaacgctttcgccgcttgccccgtgtcgttaggctcatcaaccttgttcgctgctgcgtgcgcttgttcctaatgcgcatcgcgcaatagttggatctcgtcgactgaatcccgctatctgtcgtgctgtgtgccggcgttctctcgcggcagaccacgccgtcgtctaaccttgttcgctttgctgcagcaccatcatcacctgccagctccgttcctattatttttccccaacaccgagcctctctgaccttgctgctcgtcggtggttagtggtgtccgaagctaccaagtttaatcctatgtgtgatggtgatgttcgtgcgatgctcattaaatgtttgacaaaaatcccgaaccaggagtggctgctccatcttcttcgtcgaatggaaatcatcgtgctgacacgtcgatgtcatcgatcaccatcctcgtctacgctaagtccgtgtctgtgtagctcattgccacaccctattgccgcttccacgacgttgtcgtggggacttctttgcgtcacgtgtgcttcctctcgtcacgctaaatcaacctgcttccatttgtgtcgacaacaagccgtgaagacactcttgtgctgaccacgcgccaccagctcgacaaaatgaatcccatgagttgcatcgctcgcaaggtgtgtgcggtcaaagacgtcaagcaaaaaccatcgtcgttcttccgactattgtgtcggattggtcatggtaagccaatttgttatttgtgttagttggattgatgaatgatctgactaggtatattaatcatgatgattctgtggtgagtcgaatttctatttctgttattagttcgatgaagggatttgttagatgtactaattatatcggtcctcttgcctttagcatatgtgtgtcgtggttgtaggtataatatttactggaatatccgagtcgtttgcagtggtttggtcgatgtcgtgtggtgaatcgctagtttgagatataggttttgggaagagtgcttgggggtatacttgtcaagcatctttaaaccggttgtaagtttgaagtgcgtggtatattggtggtgcgtaggttaaatttagtgttttaagcaattatcgataagtctatcgatgttaattatatttagtgtgtttgtacgatggagtcgatgccatgtgctagtagtcattatattctatgattggtggtcgatcaaatgtcgtgattaaatgttaccggctaccataagaatttggaagcgagtagcgttagcgagccaatttcagtcgaaatacaagaaacctcatagtagaagaggtataagtgctttaaaatctagattattgaggatgtagtttcacgagactataatccttttgataatgtcttatctattagacataagattaacgtgctgatttgcttagttggcatactattcaggttagattatattattaggttagaaagttaattaagggtttttatccttagactgagttaggtgtccctaaataataagcctaagtctggtccgccattttggtgtgttctctagcttaggaatatatatagaacttatgtttcgtttattatcgcttctagttcaaatcgggttcggttaagttaaaatagagtagaggttgtacttagtaatatatcggcatttggtaattgcttttaagtgttactatatgcctcgccgttaaatatttaatcctcttcggtgtagcaataattagtcgtgtgctattcttgtttatattcattcatgcacattatgcatttcatttaggtacgttaattaatcacgtggtgtggaggacaagaattgagtcgaccccaagatgatgtaatgagttggctactccgcaaggtgatgatggtggacgaacctgaagatggacagattgagtgagtgccagaacaaaagctgattgccaagagatcgtcgtctaaccaacactaac

SEQ ID NO: 779 - DNA, 2023 bp, Zea mays
gaataacactaggttagtgttgttagatggcgtccacttgacgaccatcctttgtcttcgcattgttctgattatccatctttaggttaatccatcagcatcatcatacgaattagcccgcgcttggggtcgacttggcttttcttccacatcacgcgattaattatcgtacctcatgagatgcacgatgcacatgtatgagcacgagtataacgagtataagatagatactctatactaaaaaggatgaaactcttaaaatcaagcattaagcaccatggatattacagcagggcatcgattacatctattaaccaaattgacataataacactagaacatctatttttattcctagctttttattaactctttaaactgtgtaccttatatattaataaaacttttcatttttaacacctatagtcccgcaaccactaagacctattgagatctttttcatcttacgacatcgaccaaattactaaaacgactcaggaaaacaataaatattaaacctagtcaaaccatccaccaatccactaacacgagtaacaaatttacttaccctaaataattcgacgcgatagtcgcaaacacgactacgggttttggttgacgttatccagaggccttcatttctttgataatcaattgctgaagatcttttcctcgactaaataattatgacgaaccgaacttgagtcgtgcaggatgtctgagctttttgtcgcgcacttggtgaacaccacgctgggggtcttcgtcttcacccgacgcttaggatttcttggagatgcacgaatgacaacgagatcatgtttggagcgagctggtggggtggggtcgagcaggggatgacaggttcgatgacttgatggcaaacgcgagcacgcacgaaacccgatagaggagagtgagtgccgcagtgacaatgagcagacacgcgggcgtttacgtgagccagcggcaagcacgagtgctgaggtacaaccaacaacactcggcgagcacgcagcgaggcacacaaccgcgacgacagtcgaattggcaacaacgtgttggcgaacctgacgaacacgaccacggtcacatgctgatgcggtcaagataattgtggctaacgagcttgcgacagaagcgatgatggtgcgggagctcgacacactgtggcaagcagataaaattcgtgcgcgcggcaaacaaagaaaatggagagcagaggggctgggcaactccatgggcgagcagagcgcgccaccatggcgagcagagaagcacgacgcgcgacatggaagcttcgagcagcggacggcagcacgcatggggaatttggtgcggccgtggaagctcgaagccggcacggggaagaagccaagctgggagggaggctgcgcaccgaggaagctgccgcaggggaaatcgccatggatgcgcaggggcagagaagacgctggcgagcagcaaggcgacgacatcgctggagattcgacgagcaggagccaggcgcagaggtgagttccacagagaagaagctgagggggggtcatgaccagggagatgggcaggggttgagctcggccggacggctgccatggcaacggcaaagggattccggtgagcagagaagtacacaggggcggcggctgggcgcagggcgagccatggagatgggcgccgagctggaggagcaaggggtgcacggcgatgggtgtacagcgcgccagggagaggcgaacgcgaccaccatggggaacgagccggactgggcgcgctggaaaatcaccaaacagaggacggctggagaagataaaggcaggggatggagagaagacgagctcacgttgggataaccggataaggtcattagctgtacacggtggggaatatcaaagaaggcagtggtagccagcagataagaacggccagggatgaggccgacggccaacacagtgaaagaaaatctgagaacgtgagcggtggagaagatagagtagaagacggctgggagatatttttattt

SEQ ID NO: 780 - DNA, 2019 bp, Zea mays
gaataactgagtcatgaacatataataactgagtaggcacattacaataactgaggtatgacacgggataactgagggattggagtagaataactgagttctgtcactcgaataactgagtgatgaacatggaataactcaagacgcgcattagaataactgagtaccaacattagaataactgagttaggaacataactgagtgggcacattacaataactgaggtatgatacaggataactgagggattggagtagaataactgagtgcgtcgattagaataactgagtaatgaacgcacaataactgagtaacaaacatagaataactgtgggatcagaaccaaacaactgagtgccgacaccagaataactgagtctacacaccataataactgagttagcccacaagaataactgaggtattggaacagaattactgagttctggcaccagaataactgagtgcgtccattagaagaactgagttgttggaacggaataactgagtcatgaacatataataactgagtaggcacattacaataactgaggtatgacacaggataactgagggattggagtagaataactgagttctgtcactcgaataactgagtgcgtcgtctagaataactgagtaatgaacgcacaatacctgagtaacgtacagagaataactgagtgttgaacatggaataactgagggcgtgcattagaataactgagtaccgacattagaataactgagttaggaacatggaataactgcggtattataacataataactgagggtttagaataactgagttaaaaacatggaataactaaggtattataacgaaataactaagggattggagtagaactgagttggcccacaagaactgaggcatgagcagagaataactgagttccatcactagaataactgagtgatgaacacagaataaccgagtactgaaccgagaataactgagaaatgaacatggaataactaagtgcgcccactagaataactaagtaccgactccagaataactgagacatgaacatggaataactgagtgcgcccactagaataactgagtcatgagcagagaataactgaggtattagaacggaataactaagggatcggagtagaataactgagttggcccataagaataactgaggtattagtccagaataattgagtacgtccattagaataactaagttgttggaatgaaataactgagtggcgaacatggaataactgagttaatagaacgcaataactgactgtgaatagagaataacggagtccccactaccgactgattacaaagagaataactgagtaatgagcagagaataagtgagtaggcacacgagaataactgagtcatcacaccagaataactatgtgcgcccattagaataactgagttctgacaaaagaataactgattgacgaacatggaataactgagtcggcacatctcaataactgaggtattataacataataactgagggatcagaaccgaacaactgagtgccgacaccagaataactgagtctgtacacaataataactgagtgggcacattccaataactgaggtatgatgataactgagggatcggaggagaataactgagttagcccacaagaataactaaggtattggaacggaataactgagttctgtcaccataataactgagtgcgtccattagaagaactgagttgttggaacggaataactgagtaatgaacagataataactgagtagtgaacatggaataactgagtgtgcacaacagaataactgagtaatgaacaatagcataactgagttacttgaacgcaataactgactgtgaatagagaataactgagtaataaacaccgcataactgagtgggcacattacaataactgaggtatgatacaggataactgagggattggagtagaataactgagggatcagaacctgtctcttatacacatctgacgctgccg

SEQ ID NO: 781 - DNA, 1902 bp, Zea mays
agcactggctaaacagagcataggtatggtcagatcatagacggtgtttagtgattcatctcctaacagtgcagatatttatgtcagttttatttggaacatagtgtgaatatttatatggcagttgagcgttgtctgtaaacagaccaccttcaagcacaaatgataaacacaaaaaacatatgactatcgaccgtacccctgcaacaattgttggataatggtttgccaaaataactgactggcactattatgatttctattggcagtattccaagtagctagactagaaacaactaagagccactattgttcaacatcacaattttagtcaataccatcatgggtgaagcatataacaccactaacaaggacatctagatgtgaagcaatcggcattctagatcatgtgtaaaccaaatgtcattttttgttgtcaaaagttgataccgaaagggcttttcccacaatgggagacaccatcagtactactcatagcgttaagtttaaatccaccgttacaaaatcaaccaacagtgagatgtgtgttaagtctaacttgtaggtttacaaatcaaacaacaccaagggattgccttagaactacatttccaaataaatcctgaatagaatcctgctcgcagctaccatcatgaggcttttaccgaaatatggtcaaacataaaaaccatatgtctattttctatgtatcaagtgttatcatgaaaaaacagtgtaaacccttggccaattagtttgtacccatgcccattgtgcttaaaccttttagaaaacactccaaagatcaactcataccagcaatcagttcatgcccaatgcaataaggaaagcctagagatgtgggatgcgtgttaagtctaacttgtaggtttacaaatcaaccaacaccaagggattgcctcagaactacatttccaaataaatactgaatagaatcctcctcgcagctaccatcatgttgaatacaactactatatatgaaatatatgtgtaccttgccttgcacccgagttagcagtagaagaagttgccgaggagactgcgctctaaaccagaaagcagattaaagtgcgtacgtggtaagaagaggtgtacgtaatcggctttagagctctgaaatgaagaaccggaaagcttgtgaatgagacatgatttatatagaatcatgtatactatgagttcaaattaaaattggattcaactgtttagtaaaatagtttgtaaacaagcccagtgccagtaaggagcttcaaccacatgatactatacaatgaattgtaatgccgaacagttcggatgttaaatgggtttcaactgaagcccaatgccagtaaggagcaccctaaaccctaaacagtgataccatgttgattacaacagaaacaacattagttaaatccgagacgttcaagcaaaaatatattacacataatctaaaagaaaaaaattacataacctgattcactactgtttttgtcttcactactaaacaaggctagatggaaagcatcactgcctggtgattccaaactgctagtacaatgttgaatccaaatccttgagaacaacagaaacagaagtatcaagaatagagttgacgcaccttagtgatgtttgatatttctgcacatccgaggaggatgggggtggggtggcatcatcgctttggattttttaaatagcagtacgggtcggcgtcgatggaagggccgcaccatcgaagggagtccgatggtcacggaggggagcgcggggagggatcacgggcgggggcgggatgaacggggaagaatctgggaggcgctgctggcgtgaccggggattgagggaggtcgcggatggggctccccatcgtgggaggcagggcaggcgagatggatg

SEQ ID NO: 782 - DNA, 2013 bp, Zea mays
ccaaacaagtgatgtttacagtttggcaatgagcaaattgtaatgtaattttccaaggttaaattgttttatgataattgttttttgagtggcatcaaaacatgcaatattgtccataaccaagagtcatttaaaatagcactacatatggtttaacataacatgcctaaactagttttgtttatagtctggcatagagcaaattgtacttaaaattggaatgaaatttttttctatatttaattcttttgttactaatatcattggtataactgtaatagaataataacaaagtattttaaaacatggatcaaaataaaatcacaattgcataaatatacctctcaactccggaaaattatagatctaaaaaatatatatgttgcactttaaacatttctaaagttacctcgttctccatatctaccaactctagtgcctgcattcgaacatctatatcttgggccccaatctcatgctataagttgtcttgcacttcggttgatgatgaagcatgtgaaacaacatgttggatagctcacacctatagtaaattgatgatctgaaaaaaatctatatgttatgcttcaagcgcttctagagtccactcgtcctttatacgattaaatctagtgctagcatgcgacaatctagggtcgcatactcatgttatggttgtcttgaaaatgggttaatgatggtgcacgcaaaacaacaagctgggtccatccataaaaactatctgtctaaacaatacaatattagggctttaaaatgcatggaagttgatgcacatcagaaatcgatatatcatgtagtaaacttgcacgaaattaatacacattagtcccatactcaagttttgatcagccttaaacttgggttgatgtgttcacaactgaggaacattgcaaataacactatatatgttttaaggtaacatgcctaaataagtatgtcttacaatacgtcctttagaaaagagtaatgaaagtgaaaatataatttttcttccattaactatttttccgttaaaagaggtcgtaattctgcaaaatagtttatcttgaaaaatctgcatattgcaattcgaatacttttaaagttacctcattctttaaaacattgaactttaatcgtcatgcgaccatctaattatgtgggtcccatactcaagttattgattgtgttaaattttagtttatggtggagcgtgtgaaacaacatgttggttcattctataaatctaccacataatttagtgcttcgaaaagcttcaaagtttttgcatggttcatcccacaatcttttcgagaaaacatgcacgaaatcatgaccctttactcccaaatcagtgtattgcgaaaactttgatgacaaacctttttgggtcctttttgtaaaaattactgttctaaacattacatcatttagggctttaaaccgcttcaaactgacattaatgtccacaaccatgaaacaattgaaatctttccgcatattttatgaggtaacatgtccaaacaagtgatgtttatagtttggcaatgagcaaattgtaatgtaattttccttggttaatttgttttgtgataaatatcatgagtcccatacttgttttttgagtggactcaaaacatgcattattgtctataaccaagaatcatttaaaacagcactacatatggtttaagatagcatgcctaaactagtattgtttatagtctagcataatgcaaattgtacttaaaattagaataaatttttttctgtatttaattcttttgttgtaaatatcattgatataactataatagaataataacaaagtatcttaaaacatggatcgaactaaaagcagaattacattaatatagctgtcaactccgaaaaattaccagtctaaaaaatatacatgttgcactataaacatttctaaagttacctcattcttcatatctacaaactctagtgccagcattcgaacatctaatatcttgggccccaaactca

SEQ ID NO: 783 - DNA, 2011 bp, Zea mays
ggcttgcctgaataacactaggttagtgttgttaggtggcgtccacttgacgaccatcctttgtcttcgcattgttctaattatccatcttcaggttaatccatcagcatcatcctgcaaattatcctgcgcttgggtcgacttggcttgtcttcagcatcacgcgattaattatcgtacctcatgagatgcacgatgcacatgtatgagcacgagtataacgagtataagatagatactctatactaaaaaggatgaaacacttaaaatcaagcattaagcaccatggatattacagcagggcatcgattacatctattaaccaaattgacataataacactagaacatctatttttattcctagctttttattaactctttaaactatgtaccttatatattaataaaacttttcatttttaacacctatagtcccgcaaccactgagacctattgagatctttttcatcttacgacatcgaccaaattactaaaatgactcaggcaaacaataaatattaaacctagtcaaaccatccaccaatccactaacacgagtaacaaatttacttaccctgaaaaattcgacacgatagtcacaaacacgactacgggttccgattgacgttatccagaggccttcttttctttggtaatcaattactgaagatcttttcctcaactgaataattttgacgaaccgaacttgagtcgcgcaggatggctgagctttttgtcgcacacttggtgaacaccacgctgctggtcttcgtcttcacctgatgacccgatgcttgggatttcttggagatgcacgaacgacgacgagatcgtgtttggagcgatctggtggggtgggggtcgagcaggggatgacgggttcgatgacttgacggcaaacacgagcacgcatgaaacccgatagaggagagcgagtgcccgcagtgacaacgagcagacgtgcgagcgttaacgcgagccagcggcaaacacgagtgctgaggtacaaccgacaacactcgacgagcatgcagcgaggcacacaaccgcgacgatagtcgaattggcaacaacgtgttggcgaacctgacgaacatgaccacggtcacgtgctgatgcggtcaagataactgtggctaacgagtttgcgacagaagcgatgatggtgtgggagctctgtggtgagcagataaaatttgtccgtgcggcaaacaaagaaaacggagagcagaggggctgggcatctccatgggcgagcagagaagcacgacgcgcgacatggaagcttcgagcagcggacggcatcgcgcatggggaattttgtgcggtcgtggaagctccaagccggtgcggggaagaggccaagctgggagggaggctgcgtgccgaggaagctgccgcaggggaaatcgccatggatgcgcaggggcagagaagacgctggtgagcagcaaggacggcgccgctggagattcgacgagcaggagccaggcgcagaggcgagctccacggagaagaagctgagggggggtcgcgaccagggagatgggcaggggttgagctcggccggacggctgccatggcaacgtcaaagggattccggcgagcagagaagtacataggggcggcggctgggcacagggcaagccatggagatgggcgccgagctggaggagcaagggtgcgcggcgatgggggcagagcacgccagggagaggcgaccgcggcaaccatggggaacgagccggagttgcgcgcactggaaaatcaccaaacagaggacgactggagaagataaggcaggggatggagagaagacgagctcaagttgggataactggataaggccatttgttgtacacggtggggaatatcaaagaaggcagcggcagccggcagataagaacggccagggatgaggccgacagccaacacagtgaaagaaaaatctgagaacgtgagtggtggagaagatagagtagaagacggctgggagatatttttatttt

SEQ ID NO: 784 - DNA, 2011 bp, Zea mays
aggagagattgcatataatgtgtgggatgtaatgcattgagcctctagggagaatatataggagtacatgacttggagggtaagaagcctatcctagggataaggaatgttatcctagatataaggtatcccgggattacgatcaatcctaaaccaaccatatcaggagttgcctaatatactctaacatgcctaatatactctaacatccccgcagttgtagcgttagcaacatgaacgaatagactgaagaatagtggggatatacccccatagtcgtagcgttagcaacacgaacggacagactgaagaataatggagatataccccccacagtcggaatgtggtgtgaatgctgcgactagagtagcccatgcagatgatagcactgtgtaccgataacgttgggatagccaaggaagaggacacggagccgttgtcgaagtgccgtgcatagggtagccgtggtcgaggaagctgtcgaggacgtcataaaagacatgccgcataagtcgtgggcgttggtgcggcacgagggaaggtccaaatcgcgctagaggacgttgtggtgacggtggtgctgtgaagcagccgtagacgaaggcacaatgcgtcgaggtagatgagggtgtcgatgccgggggcggcgcgtcaagcaaccatggacgatgcatgttccaggtttgccaagcctagaaacgtgtcgtggatgactgcacgtgccggtggtgccagtaccgattgtactaggtagagggccccaaccatatgtgcctgcatctcaagggaccagcagagaaggccttcgcgatggttgtgatgcagcacgacgggagtgccggcccaacgcatggttgtcaaagcggagtagatgaattagttgaggacaaaacgatgatgctggcaacgaggttgtgctggacgaagcgaagagataggcgtggtgacacaaagtagaagagataggcgtggcgacacatcgaggttcctagagtccttgcagcgagagccacgacgcataggaaacgagcctcaatggtgccagtggagcacgatggcagtgtttgtcgaggaaaaactcgatgaaaaatgcggtgcagaccggcgacggtggctggcacgcctaggataggcgcaacaccagcgcaaggtgttgacgtagcatgtaggaggacccgcaacgtagacaacggttgtgtcgcgtaactcaaatgtgtcgaacatcttgttcattcgtgtgagacgcgccgacgaagtcgacagcgatgtagatgcaatggtgttggttgacgatagacgatgatggtgttttcgaggaggcgatgcattgacgaccttcttgcttggcgaagcatcgcgcgatggacgacaaacatctcgggaggatggttcgcccgcgatcggttgatcaggccgatggcgtgcgagtcggaaacgatgatggtgatgtctatggtggagcctcccgatcggtggtggcgacgatgaaccggcatagatggacgtgcagacaaagaggcgcgacacaggcaggcgttcgaattacgctgcatgccatgtcagttgcaccgtcgaagaagatgaagaagccggtgttgttgaagccgatgtcgagggtgagcgagtcgactggcggtgggcgatggagacgcaaacccgatcaatgactgggaaaacaaaaaaaagacacaacaacaacagatctgggaattcactggcggtacctaagcgcgtcccctgcgggcgcgcggcccgacggcgcgaccacacggaactggctcgttggtgcaaccctggcggctcagctcgggcgcggcagccctagccccggcagcaagcgggcgtggccacagcatggcgcggccaagcgaggttgcagccacggtgtgggcacaacgtccccggcgcaggcacgcggctcccgtgccagcgtgcaagcctggcgtgcggctccggcgcagctggcagcgagagtcgaagctaccaccatggcggcgcacgacccagccgg

SEQ ID NO: 785 - DNA, 1896 bp, Zea mays
tccctcctctctatttcccttgagctcaagtgcagggagttgcgcccttcttctccacagcgctcaacgcccctccccctgttgttccctgaaccccattttcttccatgtaaaaccagcaggaggcccccctcccctcaactccaatggtgagcctctccatggccggtgccccgcgcagcgcctctgctcgactccctctccgcagcagcatgctccggatttctgtacgccgacatggagttgcgcagtcctggcccaaagcgtcgcgtgggtgtttggccagccccatgctgcgtcgttgatctgcgcggttcgaccgtctcctcgtctcgcttcgtcgggtctacacagcgccggcgtgccgtcgttgaaacccgtggtgagaccccgcagtcctgcgcttttcgtgttcgattgaatggccgcaccaacaaatcgtgttataaactgtgtcgtgctcgcagcccgtgtcgtcgtcacgcctcgcgcgtcgctcgtcggcaaagagcccaatctgatggcatgcatgtgcaactccgatcggatttcggccaggttgttcgccttgaatgattcgcgatttgttttatttacgtatttggtcgatgatgtgcatgtgtgaatatgtgcgtgaaattataattgtatgaatgcatgcgtatatagaagaaaatgaagtagaacaagaactcggatgtttttatatcttggtaggaaaaatatgtgatgcgttgtttgatgcgaaaaactaagttacaaaatgcggattatgttttgggagatgcatcgataggtgtttatgtgaaaagtgtaattgttttatgcgagtgatcggtgattgggattgtcgaggcgaatgaggagtatgagtaatcctgttggagtcacttgtacggttgatgccttgtgcgtattatggggacacgtaggtgcgtgggtgagccgaggtgttattttgttgttggattggatagatatgtggctgcgatagttccttggggcgtcgtagggattggtcgcgaatgtgttaatggtttgctaacatgcttcatcgtacattaatgtgttagtgcggcaaaaatttggtaaatcctaaagcatgcttggtgacttctgcactcggctagtgagtcagtctaggataattatatttatgtgttcatcgttggtgtaggttaaattaggtgaaaatgtaaatttcgtgacataaaattggtgtttggaagatgagatagattaatttagaaagatgtgttatcaaacatgtgtgccgaaatgcgttgtagtagtgattgcgttaacttgaacaaagagtctcaagtgcatcctgtgctatggttgtatttgggatagtaaattataagagttgcgcaatatgaggttcgatcgatgtagttaatattgagtggactgtagagaggtggtgacatgccgaagtagtcatcacttcctctgcggttaagttgaggtcatgtgtgatgatgctatttacgtggtgaatgtgtttgttgaatgttgatggtaattttagtgcactaaatgacacggataaaaattagtagtgctcatgtggtgtctaagctaagatgcaaaatattgggtgaaaagcgcttcgatattgattatcggggagaacacgttgttaattaagtatggtacttctagcgcccgaaataacttggataaaattagtaagtcgacttgttgatcctaatttgattgttttaactctaacaaacgtaaagtgttagagtaattctagtcgccaggacagggtaatttttgaagtaaatagaagctgaaaattattagttgctgttttggactgcacgcagtgatgtcctcgtgttaaatgtttgatgaacaaaatcatgttttctgtagagaagctat

SEQ ID NO: 786 - DNA, 2010 bp, Zea mays
agcctaggacagctcggccggaatgcagagcacatagaaatcctcgtgcagtccgagcactccaagaattctccagattgagtgtaacaagagagcacactgcataactgttaacacctctctgaatgtaaaactatatatccattcgattctgatcactgtacattcctattcagcacccatcctttttccgtgtcagcgtcgttgctgcatcagtgtggtgtggcactggcaacctctgacaaagaacagcaggtggctggcggaagatgcgcacccaacacccatgcatgacgcatcattgaaaacaatctgtccgttactgctcaccacaccagtacgcattctggcacacatcgccacgcaaagaatcttccatattctgcaaccttatctctggcgatgttgaggtggggtgtcgatcatgtcgatcattcaggcagccgaccgacggttagaagtccactccaatccattcaaccagtgaccaaaacccaaacaccaccagcaccgccaggccccgtgtgcccccatcactgatcggtgatcgccccgccctcctccactcagtggctcactcagtcctcacgtcccgggtcatgtccatgcttgccgttgccgatccaacgccggctgcaggggtgtctgccgtgccgggatggcgcacctgaaaccagcatgcccggcgttcggcatccgtgtctgtgcaacgctctcggttgttcggatccccagctcccaactgtccgtcgcgctggtcagctggtgcgctcctgccgctgccgcctgatccgtccacccgccgtccgtccgtccaaaaagctcgtgctggcctgggctggctgtattcactgcgtgccagccagggtgcaccgccgccgtagtagcattgaccctgacagcttaggaatgacaccagtaggcgacagctgcgcaggagcaggcggatgttcctgttgtttggtagcgccgccgtagtagcattgtagggccgttgtttggtagcgcccgcgtcaataatttaaatgatgatctcgcatgcgtaatcaattggcggtcggggacagagttagcgaaacccttgctgatgaaattttgaaactcccacgcaagttgaactgtgtacgcacttgtttattttattggaaatgtcgtttcgaaataaagcatttgccaaggttgttgaatagtacagaactcattcagttattgtttggttcttttataacgcgacgaataactaataacattaaatcatgcttatttaattttaactataattagatatcatgataaaaattgataccggtctattcaaacttgttgccgttgatatttaagtttgaatcattactaccattgttacttttcgtgaaccaaacaacatttaatattcatgactcccattccatatttatgcaccggcaagctgccatagtaccattacaataacctgcaaaccccagcatgatcaagcaggaacaaaaaaaaaacccgggatcggaagccgcggaaaaaggcgcgcgatccaccgaccgactccatcgtctaccggtaggtagtgccgtaccgctaccagtgctatagcctgtagtggcggtaggacttgagcatggcgccgcagaaggtgcagatgatggcgcgccaggtgctccggtgcacggtgagcaggtagcagaccctggtggcggtctccatgtccgccacgctggcgcacccgccgcagcgcgagcagatccccgccgccggcttgctgctccgcaccgtccgccgctggtccaccaggaagcagaagaacaccatcgctcctgcactgccactgcactgcacgctcctcctccctggttccttggattggatcgcgcgctctctccaacaacaacaacaaccgaacagacaccgttgttctgcttgcgtgttgcgccgcgcgcgctggctgccggcggcaggtggcaataatgcggagcgaggcttgcaagcaacggccgggcgggctagcttttcggtggc

SEQ ID NO: 787 - DNA, 2010 bp, Zea mays
ccggctgggtcgtgcgccgccatggtggtagcttcgactctcgctgccagctgcgccgaagccgcacgccaggcttgcacgctggcacgggagccgcgtgcctgcgccggggacgttgtgcccacgccgtggctgcaacctcgcttggtcgcgccatgttgtggccacgcccgcttgctaccggggctagggctgtcgcgcccgagctgagccgccagggttgcgccaacgagccgggtccgtgtggtcgcgccgtcgggccgcgcgcccgcaggggacgcgcttaggtaccgccagtgaattcccagatctgttgttgttgcgtctttttttgttttcccagtcattgatcgggtttgcgtctccatcgcccaccgccagtcgactcgcgcaccctcgacatcggcttcaacaacaccggcttcttcatcttctttgatggtgcaactggcatggcatgcagcgtaatcggaacgcctgcctgtgtcgggcctcttcgtctgcacgtccatctatgccggctcatcatcgccaccaccgatcgggaggctccaccatcgacatcaccatcatcgtttccgactcgcacgccatcggcctgatcaaccgatcgcgggcgaaccgtcctcccgagacgtttgtcgtccatcgcgcggtgcttcgccaagcaagaaggtcgtcgatgcgtcgcctcctcgaaaacaccatcgtcgtctatcgtcaaccaacaccattgcatctacatcgctgtcgactttgtcggcgtgtctcacacgaatgaacaagctgttcgacacatttgagttgcgccgacacaaccattgtctgcgttgcgggtcctcctacatgctacgtcaacaccttgcgctggtgttgcgcctatcctaggcgtgccaacaactgttgccggtctgcacacatttttcatcgagtttttccccgacaaacactgccatcgtgctccactggcaccattgaggctcgtttcctatgcgtcgtggctctcgctgccgtgactctaggaacctcgatgtgtcgccacgcctatctcttctactttgtgtcaccacacctatctcttcgcttcgtccagcacaacctcgttgccagcatcatcgttttgtcctcaactaattcgtctactccgctttgacaaccatgcgttgggtcggcactctcgtcgtgctgcatcacaaccatcgcgaaggccttctctgctggtcccttgagatgcaggcacatatggttggggccctctacctagtacattcggtactggcaccaccggcacatgcagtcatccacgacacgtttctaggcttggcaaacctggaacatgcatcgtccatggttgtttgacgcgccgcccccggcatcgacaccctcatctacctcgacgcattgtgccttcgtctacggctgcttcacagcaccaccgtcaccacaacgtcctttggcgcgatttggaccttccctcgtgccgcaccaacgcccacgacttatgcgacatgtcttctatgacgtcctcgatagcttcctcgaccacggctaccctacgcacgacacttcgacaacggctccgcgtcctcttccttggctatctcaacattatcggtacacagggctatcatctgcatgggctactctagtcacagcattcgcaccacattctgactgtggggggtatatctccattattcttcagtctgtccgttcgtgttgctaacgctacgactatgggggtatatccccattattcttcagtctattcgttcatgttgctaacgctacaactgcggggatgttagagtatattaggcatgttagagtatattaggcaactcctgatatggttggtttaggattgatcgtaatcccgggataccttatatctaggataacattccttatccctaggataggcttcttaccctccaagtcatgtactcctatatattctccctagaggctcaatgcattacatcccacacattatatgcaatctctcct

SEQ ID NO: 788 - DNA, 2007 bp, Zea mays
  misc_feature (1223)..(1224): n is a, c, g, or t
acgaacagccgagcgcggtaagaagctcgacgacggttgatggcacggacagcaaaagagatggagacgatggcgttcgcagctgcaaggcgaggctgagtccgccgcgaaggaacagcccgcagccagagtgcccacgcgatgaacaggacgatgccgatgaatcgacgacgagcaccatcacggggggagccgcagtggctctcgacggtggggcacagtgaagaagctgcgtctggcagcactcaagtagcgtcgtacgtcgaactgtaggacggcatagggacgaagcttgcagggatccacgtgcgaagttggcggtcagtgctggagctgcagatcgaggagctcgatcggtcgcgatcgcacctgtaggcttggacgaagaacgcgacaggtgacagtccatggcgagctccagccaccatgtagccgagcgagcagagagggggtgctggcgagctggcgagctgggactgggagagatccgagctgggggctgggcacacggtggcttgagggagacgatcgtgggaggggcctcggccggacgggaggagcatagggcgcggcagccatggaaggggagctcggccgccatggagatgcgcaccgtggctggacgagtgctggcagcggcagccgacgaagttccaactgcggcatggaggaagaagtcaggcggctaggcacctgggagccgatgctgagcaccgctgctccacgggtgtgctactgcgacgacggaaggtgaagggcacgacatggcagggagacgtaccagggattagtgcctgtcatatacgtagaggagcagagaaggcttacggcattaaggaatctgaaggaggcggtggctgggataaagtgaaggcagtgagcggcggaaggataagaatcggagggagaaaaatctggttgggagcagcggtgcaaaaaaaaatctccaggacataaacatgagttggcagttagtaaatatccatctgataaacgacggtttagaattgtgaggagctggaacatgcgacgttgaagatatggaaaatttctttccaagaagctgaacgcgcgcatgcactggataggaatggatgacctatgcggtggaaatacttgagaaaaatattcttttttttattttcccactttttctttacaagagagcacagataatttagttatcagattgagtatgcacgagatgtaaaccagacgaaacnncaaaagactacacaaataattttttcttctccatggtgggacaaaagatttttccttctccaatttttgttacaaaagactacacaaataatttacatcccagattaagattgcgcgagatgtaaaccagacgaaacaaaagatacaagataaactagtatagactgcgcctgatttaatttagagcagataattttatccatggtctgaacataaaaacaaattaattatgaatactcagttcggttctagttatctcggtccgatttaatttttgcatcaatattgttatcgtcgagttctaataatatttgtttaggacgacaatcactagtgggtcggggctccaaattcatgttctcttaatccataatttttaaactcgcactagactcgacatttcacgaaataaatatgcgagatttctgcggcatcgaaattataatcctttcgaaagcgacatcacgcatcgttcacgtgggcgaaaggttgtgcgctgtccagacaccggttagcaccagccacgcgccacgatgccaggccacagagagacaagtgcaacgcaagtgtgaaagaatttgaaacaaagtttaggaaccaaatccgatttcaagaattagagtttgggcaagatgtcgatggctcaacccaaacgatattggattcaatttttcggaagattactcaagtctaaattttgcaaaaataaattaggacaatttagacagatggagacaggcacaatataaaaatcgtgataaacgaagatgattaaaatttagt

SEQ ID NO: 789 - DNA, 2030 bp, Zea mays
aaaaagtttctagcttctcacttgattgtggtatacaacacgaccaaggtgaaagtatactggcagaaaaggtaaaatcataggagccaccacaaagcatgtgaagcccaatagtccaaacaatagaacttttggcaattcatgctgataggggaatgtgggaacaaattctgtatcttctctatattctccctttctcaaaatatatttccttataaagctcattatcagattaaagaactgcaaaggtttggatgataaactagcccatcccgaggtcataacataggtgatgaagaaggtagcctgcaataaaaataaaatcacagaaaagaaacataaatgttagatgaaaaataaatacacaaaaccaatatattatctttccatatagaaaagggaaggtgtgctaaacatatctagttaaagcgatagcaagcttgacatgaatgtcctttgagcttaataacaaatccaattgacacatgaatgtaccagatagtacattaacaaagagtatgttccaaactatgaagcacaacaatttaaagcaagtactcctcttccttgcactgtgagaagtggaatcttccagtttagaaacttttatcatcaatgtcccaacaatatacagaataatttgtgtgattacactaggaaggtatcccattactaggttactcatgtagtttttcctgcaaataggccaggtaatatatattcaataggtgcaatatggagacatgtcaaatggatagtatatatatttgtagcgacataagatcacacatctatagagatagcccaactgaagtttcagtacttacttctccaacctttcttttaaggaagcaggaatcaactgttgcaactgctctaggtcagataatgcttgtatacacaccatcagcatcaaaagtaagaatgcaaaaataatacagcctagaactagtgttgatttacgccacttattagattgccaaagattggaccaatacatgtcttctggttctggagccggactagtaacccatttcattaggttagatgtctggaccatattcgatgcagtaactacatcatagcgagttttgaaaaatacaaaagcagttgtgcattcctgctgtatataattccacatagaaattactaatttaatccatattattattgttaaattaagcaattaacaaatgcatgcatgcaagaattttaacctcatgatctaagtttagggtggattcttcattgtcagggttcctcttgttttgctcgcatttagagttgaacttcgaagaatttggagagcgtggtcccgcaaaacaacaacttttggtagttgtcgtcctacatccccgactgccgatttcagctatgaaatgtttaaacttcttatgtgccttctttgcgccagtctgtcagataagttaaatacaccataaccaagaggtgaaaaacaaacacgcataaataaagaaaaaccattcaataatgaaggaactggacatttgttcacatgttcatgtcaaaaagacaaaaaaaattatgagaaaactagcttttcataagatgaagaagtcttaattatacttcctttagaatatataatagtaaatgttcttcgtttgtaaaatagaaatgcatgcattgagtactaggtagatatcattatctggtggacatgcccaactttgaagacaatttgatggaagagataactacacgagtggtactttgtgaagaaatttccaacatcatcactgtatgattctaaatgcatgcattgagtactaggtagataccattatcttgtggacatgcccaactttgaagacaatttgatggaagagataactagacgagtgatactttgtgaagaaatttccaactacatcattgtatgattctgtagatgtctttggtatttcacgaacaaggagtgcaaatttgcttggatttagctttgctcttctgagatgaagggacatcaacgtggcaatgtgcttcccctcctgcattgaaggaaaaaa

SEQ ID NO: 790 - DNA, 2006 bp, Zea mays
gaataacactagtttagtgttgttaggtggcgtccacttgacgaccatcctttgtcttcgcattgttctgattatccatcttcaggttaatccatcagcatcatcctgcgaattagcctgcgcttgggtcgacttggcttgtcttcctcatcacgcgattaattatcgtacctcatgagatgcacgatgcacatgtatgagcacgagtataaggagtataagatagatactctatactaaaaaggatgaaacacttaaaatcaagcattaagcaccatggatattacagcagggcatcgattacatgtattaaccaaattgaaataataaaactagaacatctatttatattcctaactttttattaactctttaaactgtgtaccttatatattaataaaacttttcatttttaacacctatagtcccgcaaccactgagatctattgagatctttttcatcttacgacatcaaccaaattactaaaacgactcaggcaaacaataaatattaaacctagtcaaaccatccaccaatccactaacacgagtaacaaatttacttaccctgaataattcaacgcgatagtcgcaaacacgactacgggttccgattgacgttatccagaggccttcttttctttggtaatcaattactgaagatcttttcctcaactgaataattttgtcgaaccgaacttgagtcgcacaggatggctgagctttttgtcgcgcacttggtgaacaccacgctgctggtcttcgtcttcacccgacgcttgggatttcttggagatgcacgaacgacgacgagatcgtgtttggagcgagctagtggggtgggggtcgagcaggggatgacgggttcgatgacttgacggcaaacacgagcacgcgcgaaacccgatagaggagagcgagtgcccatagtgacaacgagcagatgctcgagccagcggcaaacacgagtcctgaggtacaaccgacaacactcggcgagcacacagcgaggcacacaaccgcgacgacagtcgaattagcaacagcgtgttggcgaacctgacgaacacgaccacggtcacgtgatgatgcggtcaagataattgtggctaacaagcttgtgacagaagcgatgatggtgtgggagctcgacacgctgtggcgagcagataaaattcgtgcgcgcggcaaacaaagaaaacggagagcagaggggctgggcaactccatgggcgagcagagcgcgccaccatggcgagcagagaagcacgacgagcgacatggaagcttcgagcagcggacgacagcgcgcatggggaatttggtgcggccgtggaagctccaagttggcgcggggaagaggccgagctgggagggaggctgcgcgccgaggaagctgccacaggggaaatcgccatggatgcgcaggggcagagaagacgctggtgagcagcaaggcgacggcgccgctggagattcgacgagtaggagccaggcgcagaggcgagctccacggagaagaagctgaggggggtcgcgaccagggagatgggcagggtttgagctcggtcggacggctgccatggcaatgacaaagggattccggcgagcagagaagtacataggggcggcggctgggcgcagggcaagccatggagatgggcaccgagctggaggaggaaggggtgcgcggcgatgggggcagagcacgccagggagaggcgaccgcggccaccatggggaacgagccggagctgcgcgcgctggaaaatcaccaaacagaggacagatggagaagataaaggaaggggatggagagaagacgagatcaagttgggataactggataaggccattggctgtacacgatggggaatatcaaagaaggcagcggcagccggcagataagaacggcctgggatgaggccgacggccaacacagtgaaagaaaatctgagaacgtgagcggtggagaagatagagtagaagacgactgggagatattt

SEQ ID NO: 791 - DNA, 2004 bp, Zea mays
taagggagaaaattaagtcgggtgtattatcgcatgtaaatgcgagattaaatttcaagcatgcaacaacgatgtaaacaaccgacactatattttttagatctgctaaccacctgtcataaagttgatatagttaggcgtcatttggatcagctaaactcaactacatctaactcttacgtttttgtctcttgttgatcttcatttttattagttttaagatctttatgcttaacaaaatagaacaatttttgcagcgcatacacaataaatggcatactatatttggcatttgtcgtcattaattatagtctaatatagtctaacaatttcatcatcctttgtttggcctcacacttgcagcttatcaacattatgcaaaagttttagatcttattaaatagacagctttacctgtaagttgttccttttaatggtcccactgtaacattcttacattgtgttaagttgtttccacacataattctttttcgtttgttttgttgaaattttatggtgcttctctaactttaggatcttgtaagctttatttagtttttaaccacttccctaatatcttctccaattttttgggtatctgaattgtcaatactaatttatgaaataaaatttagtcccgacaatttggatcgcaaaaaaagttggaagatattagataagagataataaaacaaaagaaagcttccaaggttatgagatcagataaggacaaagaaaattcagcataactgcggaaaagaattttgtgtggaaccaactaaagacaatggaagatgcttacactaggaccattaagaggaagaatatagaggcaaagcaggctactgaagccattaaaaagtttttgcataatgttgaagagtttatttgtttgcccaaaagaagaatgatgaaattgttagactaaaaatattgacgacaaatgccaaatagagaatgtcatttcttgaggatgaggtgcaaaaattgtcgtcattggtcaaggacaaagatcttgaaacttataaaaataaaatcaactagagactaaaatacaagatttagttgtagtccagactaactaatccaaatgagacctaactatatgaataggtggttagcaggttactggttcttattggttgagaaacttctaatgccgatggaatttgctatgtgggtaaaacctgaatcatgtcacatccactcttctagagactaaacataagagttaggtgtagtttagtttaactgatccaaattaggcccaactatatgaaatttatgacatgtggttagccggttactggggtattattgggtgagaaacttctcaggctcgtcaagtttttatgtgtgtaaaacctctatcatgtcacatccactcgtaagaagactcggttgtattcctattaatagaaatgggtgtttcctctctaaaaaatttgaactaacttagtctctatagacaagtttagtgacctcatgggcaatttactctagcaggccccaaaagacaaacaacaagttacctacttctccataaggaagtagcaatcaataacatgcatgtttgtcaaactgaccactaagacctgattgtagcaaggtcgcacgatagttcctgaccgacgagacccaatttgcagtagaaaagcatgcataaggttttgttgacacctagaggagacagatcctactatcaggtcctaaggaagcccacggaggggctgcggcagcagcagccatgggccctccaagggggattagataagaatagttagagataagattagaagattagttgagattatctaaaagattagttgagattatctagtaaggttgtcagttagtatttgttgagagttttaaggagataaggatctctagctagataggggcggctagctggactatttatatgatcaatggatgagaaataaagtaggcaagaattagaagggagaaaccctcctcttgctcggccgtgggcagaggccc

SEQ ID NO: 792 - DNA, 11147 bp, Zea mays
agattttaagtgggtttgcttggactatgctatttctgaataatattttctatttcttaggagatcttggtcccttatttatagttctagcattaaccggtctggaattaggtgtagctatatcacaagctcatgtttctacgatctcaatttgtatttacttgaatgatgctacaaatctccatcaaaatgagtcatttcataattgcataaaaacgaggagccaatcatagaactacatatggtctgatactactaacttccttgaaaagtggaagagtagttatgtaggcagttgccgttccagaaatgtagcggttgctcgaccaaagccggtcatcaaagagtcagtaagtagtaattctatcaattaccaattcgtggaattctcatgttccaatcaataagtgtgtctacttaaaagtaagttcaacttgcttgtgttaagctttgctcgaacttgattacttcctcgctctccttcactcggtcaagggattcacctttacctcgttctggtcttccagcttgaaagacaaggtccttattcaaaactggctccttcgagttagtctttattgtttcatagaaaggcttccttctacgactggagtgaaatcctctatgctgacataagcggagaggcaagcaacaaccattatattgaacctgccctgaaggctttgtttgcctaagtgcataagtcaaagaagggttttcttgccgaaagcagtgttcagacctcaatctgtagcggcgcacttccctcttatgattgcttttcaaggacatccggataaggggactgagagagtagatatgggacttttcctcataaaagcctatataggtgggtggtatgatagtaagtcttttcctactgatgtgttcagtcgatggcttgattctcctccgggcgtgaattggaagggccaagggtttacaatgaaacaaattgcgtataatttgcacggcgatacgaacagtatagaatttctgcactccttatatgcagacttagttagtcaagggaaggggtgcatagccaatacttccttctcagaagtggctacgaaccacggtgtcggggttcgaatccacttctgagcgggctggcggctccaccgggagcgagcctactgaaggaaagttttattgttgaacttctatttttatccaatatttatcttttgtttggaaaaaccaaacccacatattgatctttaagtctccctttctcttttgggagcagatctttcaaagatgggaaattccaatgattctttccgttttgtcgagccctgctttggtctctggtttgatggttgtacgtgctaaaaatccggtacattccgttttgtttcccatcctagtcttttgcgacacttctggtttacttattttgttaggtctcgacttctccgctatgatcttcccagtagttcatataggagctattgccgtttcattcctattcgtggttatgatgttcaatattcaaatagcggagattcacgaagaagtattgcgctatttaccagtgagtggtattattggactgatcttttggtgggaaatgttcttcattttagataatgaaaccattccattactaccaacccacagaaatacgacctctctgaaatatacggtttatgccggaaaggtacgaagttggactaatttggaaacattgggcaatttactttatacctactattccgtctggtttttggtttctagtctgattttattagtagctatgattggggctatagtacttactatgcataggactacaaaggtgaaaagacaggatgtattccgacgaaatgccttggattctaggaggactactattcatattcagaacagaaggttcttctcccacaaaggggatgacgcacctgtcccccccgctgatccggaatccatttaatctgatttggcagagagaatagaaaggatttataggcgggccggggaggagcaatctttagtagaagccgggactacgccaagggaacttgtagataacgtcctgccagagggggcggagctaccgcttctacaagaaacctgggttcagtttgtacgggacgagtcacacagcgagttttgggtagagatcgattcgataatctgctaaggaaatatgggcacgcggcgcgcggtgagcccgacacccccgatcccgatgctcgagcctgatgcccctcaatcaggaggaggcgactcagcggggagcacggggaagaaaattgtccgggggcggggaaggaaagtaggaacctccgaaggcccgcccgagtcaaggaagcgcaaaagttattctgattctgattccggggggatgatgggagtgaccctgctccggatccttctcctttcttttgattttgactaaaatgagaggtggagaaattgagttcttttgagcagcgttgtctgtagtagagtagcttttttttttttcttttacagaaagaaggcgaggcccacctgccttctctaggtactttacttggaaaggtgtcaccgccttccttcttctctaggtactttacttggaaaggtaggtgcgggaaagaagagcgggtatgtgggcttctttcaatcgaaacttttttgaagccgtcaaactttatcgtttcattatagatggatctaaaacattgcgttgcagagtggaggcgtgaagaaggttaagagaagcaagccaaaggaaagaaaaagcaacttgatacaatattgaagataaacactcaggaaagcactgggtcaactgactccactagccagcttctgcttcagaacttacttcaaagaggctgacttagcacttagcataatgcttttgttccggtgcataaaagtaagtgagcaggtgggtgagtccaaaggtttttccgaagcgcgaaggacttgcagttctaaaataggaagggctctgtactcaaatcaaagcaaagtagtagtttcataggtcgttgtgctagagctaagatttatatgaaagtgtgaggggaagccatttccagcttctactttctgcgaaccgggctcattaccggcctacagtagcattctactgtgagctttctcactgcggatcgccttgattcactgatcgttgacagctactcaggagaggttatcctttgccagactttgtgttgagatgagttctccgcttcccgaaaagatgatttttgtcaatcagcgtagagtggtggattataaagtggtacagtccgaatgggttggttcaagctagctgttcttactgaacaggtgttttagcattcttttcgaattcgaagttgcggggtgctttggcttttcaaagttctcaaagagaataaagtaaaggcgctacgcgtggatcgaattaaagtaacgtaaggtttcgtaagaaacaattgaataagcgtatcaaagagaatgaggtctagcactccgaaataccattgagaaagagcaatagaacaaggttagaataagatctccaaaatggttgatgactcccacaacttgtcaggctgcattcccgtgaaattgttttgggacaattccagttttactatctatgcggtagctcagccaagtaatctggtatctcaccattaagacggttacctagcaagttcagctctgtgaggttcttgcatcctttaaatgaatgtctctagaatactcccagtcagattgttattgtgcaatatgagtgactgcagagagttggcttgacatatctcggctgggatagaatagaacctgagagctggttggtttctgcagagaaactaacaagatgctgcaatggcagcgctggcagaggcccacggaacatgttttctgcaagagatatggatcgaacactcgccctgttccgtatccaatctggaatatgacccgtaagtttgttcccttcaacgaaaattgtggcaatagcttctaaatctgcaagttcttcagggatagagcctgtgaaggcattgaagggacggacagatttttgagcgtaagcttcttgcagttactaagctcttttggtatgctcccactgagcccagcacctttgcaaacagccgagttagattgcccagctcaccgacagatgttggcagttcagcattgaagtagttctctgatatataaagttccttcttttgagaccaccaattgaccaagggatggtgcctgtgaacttgcatccggggagttgaagaacttttagcagcttcaggttaccaatctcttctggaatgcttccactaagaccattctgtctctaaattagcaattccttattttccagttgaccaatctccctaggtattggccccaccaaactgtttgatgagagatcaagtgtcaactggttcaccaacgcagttattcccgggaatatttatcccgtgaggttattctggcttgcatcaaggtgctagagccgagactggttaccaaaagcagctggtatcgacccgttgaatgtgttcatgtgaaggtccaggatatcctcgaggatgaaggccagatcacgcccaattcgatccttgaaagacccattgcactacagcggcagctcgggctcgagcaacggcgggagataagtcttctcttcattcagcattcagtctatcttcggaaagcagcaataattgatgcacgcagacgatggttaaatgctttcttgatttactactaataggtggtgtctagacgctaggaaaaagtgaggattatagcttctgccccatagaccattcggaaaggagtctgtcccttcggtcttatatgttagtataggttggttcttccgaatgcacataagaccactggtcaccctcaatccttagcattgaacttgactgatttggctaagatctggggaactagagcagtccccagagggcactacacaaggcaggagaggcaatagcgaagcgaagccctagttcaatcgaggatggattcattgagtgggcgaggaagatgattggtatgggaagatcggtctttcactaatggagcatctccaccctagccttgaagttgaacatccggggatatctaaatattgaaccagtgattaaaaagaatggcaagactgcggttgaagtcccagctggaaatccaaattgctcgaacacaaaaaatctagacaaaggaaagaaacctggtttgcatattttcgtatatgcccaactaatctatcgcataggaagatcgcccctgtaagtttatttcacacattatgttactttgtttatggtgtggaaataaatatcaatattctaacttgccgctttctatggatgcatcctctactctagtgcttacctgtcctactttctttaattcattcctatttcctctcctgtacttatatttatcttgcctgcggcagttttgtaatcaatttctactagggatagggagcgtgaactttctctcatccagtgaatgagttacctgaagatcgatggcatataaaacgccctaattcaatataaaatctgttatttcactttcaaaatgccccgttcgcacttgcttgagtgaggcgcaagccgttttcttgctaggcaagataggtcaacggatagcttgttggttgatacgggaccccttctcaacttcatgtgttttgtaactgccataaagcaaggccatagtccaacattccatccttttccaccgctgtattggcttctgcttctcttccttttgccgaggaagatctgcttctcttgcatcctccagtcttaaattcctatccgtactagactagaccttcccttagccatcaacctaccgaacccaggaatgagatccacaaggaaagagattggcagaaatccagaaagaatgatgcacaagaaatggttagaacctcgagaatagatgcgaatagcagctcagatcagatccgagatggagcagcaataaagcaaagaggagcagaaaggttcgaatcgaatcgcaagcagctgactagagagagatgagttgagaaataaagactatccaaatattggataagttgtttcgtaattcatctttgtcattgacttcggcctctcatttatccttatttggtagctgagaagtgaagcacaacaaagttttaatagatctcttcctgtcattcaataaccatcctttatttttgcagtatagagaagtgattagccggtgcccaggataaggtagtggaactggtgcgtatcaggtttggcattagctcttttgaataatagagctgagcagctaagaacagatagcaatctggaacagctctgaaatgcaaataaaatgatgattggtcctagcttatgggttgcgataagacagtttcgaaggttctagccatctcaaggaagtatataagtagctatcggcaccttttgaagaaggaggctcggtagcagagatgttgagtaaagtctagatgacacgaaccctagcagatctgctatagcaaagtggtaagttaccagcggtgtcgatagaatagaagagaagcatcagagcgagcgttatagatcagtcagcattagcgacatcaattctgctacagttttgttaaagaaaggtgaatacattctaaaaagtctaaaactcatcttatttcttaaagagcatataacaacaaacgatttcacttacaagggggtgcagctgcaggaactgggtgctgtgccgcccgctgcctacttaatgtttcgcttgccttctacacttctgcaatgggagtcaccacatgagatgctatttttcacctttcgctattattcgctcttgcgtgtctttggagcccgatctttcccttgcttacgcccctagaaactccgtgaaaaaaccacctcgtttttccataaataaaggattcctaataaagtttttacatatcatatcccagcggtatttttttaataatttttgcataaataaagtataatttccacaaaataacacttttaggcgcccacttgaaattcaacttaacgttggacgttgaccaggccctctctattgccagaattggggactggctcttctccacaactagaaaacacagaactgccagaggtttggtcataaccagcacgcaccctcgccaatttcgttctaagctcaatccaagattgtgatcgggttgcctttcgatataacttggttcaagcttggatccagtggatagatactttaaacgatggtaggaacgggagctaccctggatcacttgaggaagtaagaacgcaagtctctcagttgaaattagatcgttccaggataatagctgaagcggctgagaactcccaaagagaagagaaccagcttaaggagcaggtatccggagtatcagcaagctataaatagctttaggattgtatgaatagagttgaggatcaagtatccctcatatttagatcccccgttgggaaaagccccttttttaaatcctttcacgctttccctttgccgaaggccggcctctttagttcctacgttttcggaaaagaaggtgagacgctagctagcaacgggaaaaaacgagtagttaaagatgtgaatgtaagactactcgaaagtacttccatttttattatattatatagtttctaatagagagtacagttgtatctatgtgcgaaacgacgaaagaaagatggaaggcccaaagagctctacagtagtgccccggaatggggtcgtagagccggtaacccactctgtttagtattttgatttcgttcaaggtgttgctctgtcaaatagagattgtgtgggtgttcagtctaccactcatgttcacgttctacaaatctaagggagtgctcctagactggacgacttcccgtaaataacctagttcatgttcctttgaaagaaataaaatgaaagcttttgaagcgaagatgtcaacgcggtgctaggtttgcgccggccacgattatttataagtatattggaaagaagagtgactaggctacggtctaactttttcttcctagcggagttcaatacgaaaataaaggcgctccgcgttgggaatggcgtacgtagtacgggtggtatttccggtataactgatcagggttgttctgaaagcaagtcaattggtgctttggaaagtgagtgccagaggctagtcactgcttggtttacagaagggaaggaagaaagagataccgaagcagattcagtatagaaaagaagaaattgataccattcattccagcttatttgatacccacttaaagtttctatcaaaccatgtctttttcttcgaacgtcaatctcgtaggaatttagattggaagtgtggtattgaagggcgaagcctttactcttttacttgtttctttgaatataatataacatagtattgactacgcacttcgaaagataatggtgtattccgaggatcagtccgttttttattgaattcgcaaattgatagatctggatgattaaaagaatgattcttccctgggtatttccccgctaccattatggaaattggagcttttcaattccattttggagatgctcgtaacgatttttttcttttgggtgggcaagaaaaggatttgactcttgaagatatcaactcatacgcctgctccatacattaaaaaacattttgggtactttctattagaatggataaatagaaatgggtacattcctctttctctttcctggccaaactaccaaaaaaaaagaagagagagagctgtaagagcggtaaaagcaagctcggtggcccggttcactacaggttgatgtatccttttgaaagaaaagtcaatctctctaaaaaataagcacttcaacaagtcagggcccttttttatacaactcctatgcgtaattgatagctttttggtattctccatatatactactaggtacgaaataacaggaaagatagaaatagtgactttggcttcaaatagagagcagcttaaagggaaggaggacagctctgaaaaaataactgaacactggctaggaactgggctgcactaagcccggcactttttgggcttcttcatgaatctcgttttcaggtaaggtcagacttattgaatatatatctgaaagaaagcaaaggaatgaatcgtttttccaattaccttctctcgaaaaccatagatcttctggttaccattgactatccggcactttcgtctgtagagcgaagcaagaaattgcatggaagggcttgccctgctaatatcagccttgtttggaacaatagatgcaatccatttcagtgtatgtcactgagttcaccattgcagttgagacgtcaggcaattgagcgttccctagagtttggttcaaaggctaaggactccccgccgccttcataagggcactaaggcggagcacggaaaagaaaatggggcacccatgttttaccagtcccggatctcagggccgttttgcacatgaacgaaatcgaatttcattgcgggaaatttggatttcatgagggaggaaaaggcaaggcggagggtggagagtcgtacaatgcattggtgggatgaaggtgctagcttggctgagataggaagtttcgatgtgtatgtagatttggttctagtgccccacccttttcgagatctgtcaggatttaaaagatgttatagtgtaaactatagagaaatggaatgaatgaaatgtatctaagaagaaaggaagccatgctccatcctgtttataaaaagaacatcacctcccttccctttttggttagataccgctccgttaggtactaatgcttctacctatcaccctccgggtgagtttgagagctgtgttttttccaacgttaatagcattccgcgagaaaagagaaaagtcatctactgatgttgtcagcggagtccctcgtccatccatgtatgaatagcggtatcccccattttggacagtgatgaggtagtcgacgcaatttgcatgtgtatttgcgttcggctttgctactttccttctagactataaaagaatgtccgcggaagggaatagtctacgtggcccgggcccggggtagtctttcaattcctttatcgggtgggagagtttagaacctgttaagccaatagctgcagctttagtcacactagctacatcagtggatcatggatttagcataccacctcagaatagtctacgtggcccctacttttattttactacttttttttccagtaatgcagacagccctttttaaagcgctaggccgggcagttggtacgaaaacagaaccattagtggagtaagatcccgatcaaagcagagcggtctaatcgaaataatcatatctaagagcaggcaggcacacgactggatatcaaaggtggggctcccctcctctactctactctactctactaaatgaaatgaaatagtatttgtatttgggtcgtctttgtgttcgattcgaatagaagcgccattgtcatccgctgcagttcttcatagtccgtcctagtaagctggtaggttggtggatgtgaacataaactcctcatatttcctactgttgcttcctgtataaaggaagagttgtcagacaatgatactctttccaaatctgcaatcttcgtcgttgtaatgcctcagtcatcaatagtagatagttgctcaactatgcaataaggattttcctctcctcacagattggaggactttcacttgactcactagtgggttttgcctcgggaaacaagaatatggatttgagcaagtctgttttcccatgggcctactacctgctattttcaaagcgtagaggacccgcctttctgatcaaagtatgcttcccttatgggcgaaaccactgaatcggacggatccttttttcttggattgaccaggccagcttctccacccaattcttttcttacgagacgagataggcacagtgtcagggtcatgtgatgtgaatggtttgtttgatctgtttcttgtccctatgggttcgattggcaatcaggatatcggtcgcttggcactagtcgaataggcgattcagtcgtgatagtgccatcccttgccccttggagtgagttgaaagcactcttccagctcttgattcgcggaattcattacgaagcaag

SEQ ID NO: 793 - DNA, 7902 bp, Zea mays
acccaaaaaggtggcagcaacagtatcgatgaagtctcactccgtttttaaagaggttttatgtttaaaaaacatcagcatcatggttgtcacatacttcactctagtattggaagtaaagcgtaagaagtgagccaaacaaactataggtatgtaaaaggagttgccttcattcctatctcaaaccttttagaatggtgaaacacaaaatatagacatgacgatagaacatgttgaagatttactacatagctctctaattagcactaagcatgagaaaagaatgattaaaagtagtaaagaaacaatgtatgcacaccaaaaaaagatttggagtggcatgttttgctgagactaagaggaaaatatacaaatgcagagcatgcttgtcaacaaacctctctatccacaaggcaaatggctgctccactcgtatatttaagggacatttacatttcacccactagacgtcttgcttagatctagctacccccaattctctactcatttttgccctcccaccttcacaacccactcaaaaatcccctcacgacgctattccttccatcaaattcctcttacaggtggacctgacagcttacaagtgggacccgcatagcttcattgtgagaaaaaagatgcagaaaaaagaaggcaaaaatgcagagcatgcttgtcaacaaacctctctatccacaaggcaaatggctgctccactcgtatagttaagggacatttacatttcacccactagacatcttgctcagatctacccccaattctctactcagttttgccctcccaccttcacaacccactcaaaaatcccctcacggcgctattccttccgtcaaattcctcttacaggtggacctgacagcttacaagtgggacccgcatagcttcatagtgtaaaaaaagatgcagaaaaaagaaggcaaaaatgcagagcatgcttgtcaacaaacctctctatccacaaggcaaatggctgctccactcgtatagttaagggacatttacatttcacccactagacatcttgctcagatctacccccaattctctactcagttttgccctcccaccttcacaacccactcaaaaatcccctcacggcgcaattccttccgtcaaattcctcttacttgtggacctgacagcttacaagtgggacccgcatagcttcatagtgagaaaaaagacgcagaaaaaagaaggcaaaaatgcagagcatgcttgtcaacaaacctctctattcacaaggcaaatggctgctccactcgtatatttaagggacatttacatttcacccactagacgtcttgctcagatctacccccaattctctactcagttttccctcccaccttcacaacccactcaaaaatcccctcacggcgcaattccttccgtcaaattcctcttacaggtggacctgatagcttacaagtgggacccgcatagcttcatagtgagaaaaaagacgcagaaaaaagaaggcaaaaatgcagagcatgcttgtcaacaaacctctctatccacaaggcaaatggctactccactcgtatatttaagggacatttacatttcacccactagacgtcttgctcagatctacccccaattctctactcagttttgccctcccaccttcacaaccctaaaaaaatcccctcacggtgctataccttccgtcaaattcctcttacaggtggacctgacagcttacaagtgggacccgcatagcttcattgtgagaaaaaagacgcagaaaaaagaaggaaaaatgcagagcatgcttgtcaacaaacctctctatccacaaggcaaatggctgctccactcgtatatttaagggacatttacatttcacccactagacgtttttctcagatctacccccaattctctactcagttttgccctcccaccttcacaacccactcaaaaatcccctcacggcgatattccttctgtcaaattcctcttacaggtggacctgatagcttacaagtgggacccgcatagcttcatagtgagaaaaaagacgcagaaaaaagaaggcaaaaatgcagagcatgcttgtcaacaaacctctctatccacaaggcaaatggctgctccactcgtatatttaagggacatttacatttcacccacgagacgtcttgcttagatctacccccaattctctactcagttttgccctcccaccttcacaacccactcaaaaatcccctcacgacgctattccttccgtcaaattcctcttacaggcggacctgacagcttacaagtgggacccgcatagcttcatagtgagaaaaaagacgcagaaaaaagaaggcaaaaatgcagagcatgcttgtcaacaaacctctctatccacaaggcaaatggctgctccactcgtatatttaagggaaatttacatttggacacactagatgtcttgctcagatctacccccaattctctactcagttttgccctcccaccttcacaacccaatcaaaaatcccctcacggcgctattccttccgtcaaattcctcttacaggtggacctgacagcttacaagtgggacccgcatagcttcatagtgagaaaaaagacgcagaaaaaagaaggcaaaaaatgccgcatggccaagattcaaacccattcccctgacccacacagagcctcacaatggaactcaataaccaatgggacagatacagaattcgtgtatgcaatgcaaaaacgactttataacgtgtaagtactagtataaaccataccaaaatgtcttttcaagctgaaaataaataaataagtaccaaatgttgtcagaaaatagtgaaacttggcatggagtcataatttggtcctagctgcttgagataaatagatcatgaggttatgcaaaagtgttaatataggtgtttcacaaatggacacatctatctctaagtttcatgacattcaactataacatcagtgattgagctatatttcttacgtttgtcattgtctttgcttcaaaagtgcaccattagttcatctaacagttacaaacttacttcaggtaaagatgccacttttttattgtttactaatttatatgctttaaatgtcttttcaagtcgaaaataaataaataaataccaaatgttgttagaaaatagtgaaacttggcatgaagttataatttggtcctagctgattgagataaatagatcatgaggttatgcaaaagtgtgaatataggtgtttcacaaatggacacaaacgcgacatactccctagacgcggacactaggacgcggagaatgttcggggtcggggctgactgtaggatgtaggagacaggacgtcgagacggcaggcggtcgatgaagcttcgaggcttgaagcgatgacagtcgctcgggtcaatgtaagcccagatgcccgcggttgacggagagccgcgtcgcgcgctagtcgtcgaggctgctacgtcaaggtcacgccgttcgcagacgccgactacccgctcgtcgtagcctcaatcaacacacacgccgtcgagctgtcacaggccgcgccggagatgataaaggcctcggggacgagatcggcttggatgacaatgacgattggccggagatggagtcgggctcggggaggagcgctggcacgcgctggtgatccgcccccaacgacggagaactactggagaactactgcgcgtcgaagatctgcctgccaacgtcatagctgttgccggagatcactcgccaactccgcgcgaccctgtcggtcacacgcgccgcgccggagaaaaggaaggccacgccggagatccagtcgccagcgccgtagctgctgccgcatagcactgaccagctccgcgcgaccctatcagccgcatgtgcaagagaaagggaagtccacgccggagatccagctgccagcgcctcgcgacccggccgaccgcatgggccagagctacagccgagatttggatacgcgcgcaccggagctgcagtctcgacgcggcagctgcaagctgcgcgccccaagatctgcccgccagcaccggtgacccggccggcagcacggcgtcgaagatgcagctgggagagacgaagatggaggcggcgagtggacggacagtgttgcggcggtgctgtccaaagtgcaggaccgattcgatttgggaacgatgggtgaggaaggggaaagagaatggccccacttgtaagagcacgggtccacatgtaacaagtttaactgagtagataatttggacagggatatagtgagtcaaccgtaaaaatccctatatttaaatccgaaagcaactccggccgctcccactgccgatcaaagagccgtcgtcttgccacgcatattccgatcatacaagcaagatagtgacgccagccgcttctaatgcaccctggactcttggaggagcatcgccaccgccgagtcgatggtgcgacgtccatctggccaatgaacaggctcgccaacctcgagtcaccctcgaggcctcgagctgcacatcctttggcgtcggcaaggtatcctttggccaatgaacatgcgtacctccgaggacgcttcgttaatggcatcggcatcgtcctcgtgctcgcgaggggaaggtggtgacggctaaaaatacttggtgcccttgaggatcttctcctccctctccctattggcgtccgtcagtgccgcttccaggagagccttagcctccggatccaggtcgctgatgacattatgcggggaaggccacaccacgggccaccgatgatgggttcagcagcaccgcgcactccccgtggttgcgcttcagcgcggcggcgtaaggaatcgtcctgcagtgacccaaaaccatccattcattcttttcagcaaaagcgcacttcgagaacgacgctgtgacgccgtccaagctgatcccctccccaaaatgtggaaccggtaatagtcacagagatgcggcactcaccctgctgagtccctctagagatgatccacaccctaggcgagcattttccggatgcaatctaggtccccactgcgagcggcgagcaatcaatcatacatgggtgagcccgctcccgggcggctgcggggcaacgcttcgcggggtgccgcgcgacgtcggcgttgacaagggagaccgcatccgctttcgctcctacgtactcgagttcaaccaggtgatgagggggactcgacagacggctacggttccggcgggaagacggaggctgctaattccggcggttggagaggttcgcgggaggcgggcatcaagtactcaatctactttctttctggatgatgttttggacccaaaggatggatccatagggcaagatgatgtccaatggttaacacctcaaaacgtcttacgagaaagtagtgatccgttgtatggcatacgagctcatggatcagtttctcgtttttgggcggatggtgataccttggatgatgacccggtcgagcttttatctaattcggatcggcaaaatttggagctacaaccgggacagaaagctgcacagtactcagtatcggtgcaaggtgaagtagaatctgtcccggaggctacatatatacgatcctttgtgggatcagtgacagagaaacgagaagaagggatgctatctcaactagaattatcgaaggcacagaaaacgctgcatgcatctcttcagaacatacccaaaggtccacagatgggaaaaaaatttggtgcagcaccgctgcaaaccagagtgtttgcagcccctcacaaaaaggagtatagaccccacccgcaacaacaataatacaactaaaacattatctggtggacttgcaggtggggtctattcccctttttgtgaggggctgcaaacactctggtttgcagtagtgctgtaccaaatttttttcccacagatgacggtgcaggtgccgtatgtcaatccagtagcagtgcttgtgcatcgatcagatagggtaaaaccatggaggagacctcttccacctcgacggatttcaccaccattaactctatcggattgcatagggaaaacgaatggaagatcaagacgtctaggaagactggtgagaccagaaacgcagccttgccggagaagtgggtcgccgacggtgggctctggttttcaaaattcaaactcgtttcatttaccgccaacgggtaaacgaaatgtagattgcgatctttacggcacaaagcccgcgactctttcgtttcctgcaaaccaagttataggcccacatatgagccgtcgaggggttttatcccggcccaaaaataaccctgaaaagttccattgtcccaagtctggtggttctcgtgacctggatcttaggacgccgccgtcacctcgacctcttactctctttccacctgcgacctcttttgccgatattgttcgtgttggcggaaagaagatgcaaggatcaggagggtttgggtcagcatatggcgggggtcgtggtcagggagatggaggatctcgtcggccacaagatgcagacaaggcgcgtggacaagttcctgatgctggaattcggcaaagggtccagggaggaagtcaaacggctggtaacattctggaatcagcaggtttcggccctaacactggcccccatatgcctggaggttcccaaggatttatatttggttctgctgctaatagatcacttggacagagtaatctgaattttggacgtcagccatagggtgctcaaacaaggggtctgagaaatggtgttgctagaaggtggcctagaccgtatgagcgccaacaacagaaacaagttagtagaccacctgtacagcgccatggtggatttgcaaacccagtattttttggtgatgtttctcatgtcaaccagaaccagaacactggcatgcagctatttgccgggtttcagtcaaaggtcttgccgagaacatcctcaaaggatttgactgatgctgataatgttgaacagacaattgctttagatctagtagaaggcaataaggagactttaacctatgctgtgaatcgaagaccatggtacaaccagcggagagtgcaaaatcaaagggtaaatggtgctttcgctgccgatcgaagggccatatttcagcagagtgctccacaattttgttttgtgctatttgtgaagggagggaccatgttgcagcgtcctgcccaactaaaaagaaagctaagcctaaggtattttcagttggttatgctatagatgggctggggttctttcacataccccatccccctttctctggtccaaaaaaagaaggaagcaaggcgttgatatcagttcagggggtgtcctttcggaagctgaggttgtctcacatttgctgcggctagttcccggaaaacatgagtgggatgtgcagctccaggcaccgaataaatgggtgactgccttcccttccaaggtctttggagttgctgatttaaagaatggaatgtgcttgaaatttgatattttttaagaagaagaatttatgggtgaagaattaccaagagtcgttatgcgtgtgctcaatcttccggcagtccttcgcacttatgaggtactgtggggcaattggcactatgttcggagcaacggcaaaggtggatatgataactactaggatgaattcttttggtcggttcaaggtggcggttctaaatctgaccattgtaccgacagagatggatgtggttattggcactcgttggtttgagctaaagttccaagtggaagaatcgaatcaaggggatgagactagtagacatgaacaagatgttgtctgtgggggagacacatcggatcagctctctgttcaaggtcattcaagtctgatcggtactaaatttcagtcttatg

SEQ ID NO: 794 - DNA, 7803 bp, Zea mays
gatatgtagggagtttacactctagtagtgcttgtcactgattttgtaccctcccttatatttcctcagtccttcaagaggatcaactctcctcgttcttcttgagagcacgttctctgacccgtttcccatctggccatctctaacaaatccctacacactactcacacaagcaacaaagatcagatgccatattcacatatacccccccacaagaaaaatgtcaaatagggttgtacaaacaacacaaaagaatggtgcagtacagacaaacataacaatatgaatgagcatgagggtttatgaaaagtatctaaagttcttgtcctcctcgcttaattaggagactgtatatatgaatccgagaccaatagcctgtcggattgtagaaaatctcccaaacctaattaagtcacgatttagcagaaaggaggtggaaatccaaccaagaaatgaacctgtacggctgtgccaacccgagagcttacctcgccgccgctgcagaaaaaaagaccaaaagagcttacctcaccgccgctgtagatccttcaggaggcgtcggctcaatccatagagagatcgtgcctagtttttggatcgcgggggagaggcgaccccggtattccatagagagattggtcacgagggagaggccgaggaggacaccgcgacatgggagtggatcgcgccgatctgcgcgccgaggaggagatccgtgccgcaacacgggaggggatcgcatggatgggtgggggactggatcgcgccaatggagagcagatgggtgggggagtggatcacgctgatctacgtgccgaataggagatctgcgccgcgccgaggaggagaactggatcgcgccgatctgcacgtcgaggaggagatctgcgccgcgccgaggtggagaactggatcgcgccgagacatgggaggggatcgcgccgagacacgggaggggatcgcgtcgatgggtgggggagtggacctcgacacgggagtggtgtggggcgggatacccggcggcgagcttggtggcgggcggcctcgggggcggggttggtgggggcgcgggctctggggcgggataccggcggcgatggctggctgcggggctggccatcgaaggaaaaaagcgccatccaaggaagccacaggcgggattggaggatggagcgcggagggagcgcgggagggggcgcgcagcgtgtggggaagatggcagaaccgcacctgtggacgcctacaataaatacataagtagtattagagattgtttatttctaaacactaagatacatgtgatctggtggtggcttcatgggaagtgggaagtagctgagagcgtgctgagcgtggggaacaaaatatattgtgttttacaactattttttatataattatgatagaacaattatatcatctccagcaacatcctctaaaaccggtcctctatatgtacaatgttaacataatccatatactaggtgaatgcccgtgcgttgtaacgggggtaaaaaaatttgtataaaacatatataatgccaaaggaagatcttgataggatcattggggtcaacatattttaacatatatcaagtgttttgccaattcagttaacatatatcaactcacgcatgacacatcctatcatacacatattgcaaagggtccacagattctctgctgcattgactgagacaaggtttggtgctcgacatattaatctggaaacaaaatatgctgctatgatcccatcacgattcttactacaaaatataaataatgttagtgagaaaactgacatctatgttgagtggaagtgcttggttctacctgatgttgatgtgggaaagagctacttctgttggcaatgtttcctcaagtatttggaagcctactgttccaagccgatatctgtagcatttaaagccggtacaccctaaacccaagaatctggccaatgcagctgccacaggactgcaatcgcatttcaattaatatgttgacttaatacagcacaacagaacaaaatgtatgaaaagacatacaactcacctccctagatgattgtctgcaatagatagcacatcaaggagttgcttcacatttgtgaggcagtccagaagtataatcacaccaatactggacaactcacagttctcaactgttaatctcagaagtggattttccttttgaatagaccatgacatgaaagggatcaatgatctgcaatttaagagaaactggtgagtgcttcagtaaacaaacaataaacggcttggctgaggcaacaattattcacaaatattcagaagtattgtgcatatgcaagaaagttggaggcaactgaacacagacatgaaaaaacaactggacaacctgtattgatcattgtagaatactgatgaatattctgttaagtcagctagtacctgataccttcatccatgagttcctcttcatcagtagtcactccctacaaaagcatgccttgagaagctccatcttgctgataccaaactttgatgttgtgagggcagcagggttgttcttgattcgatcgaaggggccctcaaatctgaagtaacttgatcgccgagtgtgctaactacgacttacattctggattcatatacacagcacatccaaaaaagggaactcttggattagttacgcttttgatgttgatgtccattttaaagtctttattagaccccgttggactggtaaagcttgcagatctacttctcgttcaaaagtttgaaagtgatcatatttttggataagtttaattaagattgagcaaaatctgactaaaacttctcacagttttctaggagaagtactaaagtttggacgaatctggaaaatagaaacaagtgcaaactaatccaagctacacactacgttagtgactaatataaattttgggatccgctggtataataaaatctggcactggctacttcccgttcttgtctacaaagatggccccgatcgatgtgacactgctgttgctgccatccttcgaaaaggcatgtgctttagcaactggtacaaggaacgaagttttcttttttctgttctgctggggaaaacaaagaacaagagggaaaaatagaatctatatttataacagatgaattaagcaccaagcacctgggaaaaatagaagctatatttttttcgtttacacaaatttcaaacaagttctaaatatgacaagaatcaactgactgcatttgaaccaaaactttcgtacaaatagcaccaactacagtaatggacatgtagccagaccagatatcacctattcaattatcggctatttaccagagtgacacaaccagaaccccactgattaagaaaaagggcaaggaagtcaactttctgaattttgcgtctccatgaatatgttacacatcgaacctaagcatctccatgggactaagtggaacctttgaggctccatcagatgcatgttccgggaccaccttcctccaagagagtagaacagaaaacccacatatgatcctcaaactgcttgtacagtaatggtccaaccagttccaagtgcttcctgcacgtccatcatcatccgccatcacgtgagcggaactctgctgccctcaaattcatttcatatctcaggattttgttcgcccattggatactctgatacagcactgtcagcagcttgttcagggtgcttgattgagtcgatgtcagatgaaacaggcgatgctgcttctgcctcaggtgctgaagatccaagcataccaccactcttcttttcctctcctaactcggcatcgcaaagcataacatcgtcaatggaattcagctgcttttcactttcaacctcaatatcaggaactgcagtatccttctcagcaacatcaccaggttcagcttcttcctccttccattccacaaactcaggttgactctcttttacatccggagtcagtggcctgatatcatcttcccgtttgtcaatggtaccatttgccaagacggtgtaaccagactcttcgtttgcgtctttgttggagattggtagagttggttgagaaccttctgtgtcatctattacttcgccaagaatgacttcatcatcctcttttagtgcagatatttctaaatttggagatggggaagcttctgggctaaccaaaccatcattcagtgccttgtcctcgtcaaatgcaaaccagttggaatttgtaaagagcgaggcactgcaaatgacatcttcattagccaattcttgtatcaaacaccaaatatgcttacaaaaggaagaacagtagtcaaatcaaatataaaaagaataaacctttcttggtcgtctccaaggcgaagggaggagattactacctctgcagattcatcatcaaaatatacatcctgcggcagatataataaccagaaagaaaaacatcaaacactaatctgttcagttcaattcgaaatgatacagtgaatataaacagtaaatctgaatatacctcatcatcccgctcaagtgatgcatgtatcaaatataaacaaaaagttactgaataattttttaaaactgttaatgtgttgcaacaacagccaaagcttgttgtttaggtccatagtaaaatttaagaatattcttttaatgtaattcagaattttggatctcagtaaaaacaatgattcaatcttttaatgtaaatcaatatgcctatatataaagcactaaagaatgctaatagaccaaatttcgatccaacatgattgttttcttgaatcccaggtacctgtacaaataagtagcactcgatatgtgcaggtggatacttccgatgcagaatttactcgatgaaaaacataatgcaaatcttcagaatatgttgttcgttcaaaaacagactaagttgagattatggatacctccggtgtccttcgacaactttagccatgttgccatcatatgtgggaacaaatatatcactttccagtgataccaagtaatccagtgcagccatttgcgacgaatggttctgaaagaacatgaaatcagaaggttccagaagtgtctcctttctcacctgcacacattgtccgaacaacccattagtgaaaacaggaaagagataaatcgattgatgacagcacaatacagcagtggtgtcgcaactcacaagtgaagcatttggtccataccacgttacggtaagccaaggtaagacaagccattctgtgttttccaccatatatctccccagccattctgtgttttccaccacatagatacaacacatacatactgaatactaaaaaatatgcagcaaagaatataaaagtctagtcgctgcaaattttagagcatcatttcagagctagttattaattgctgaacagatcatcatttcagagcaacgtatccaaagacataggcacgtagaagccaatgcaccatccgctcgaactgctcgaagacggcgaggtccgcgccgctgttggagtgggcagtggcagggcggccgctccatgatcggatccacacggcaaggggcgtcgtcgtcgccaatcgaggtggtttgagacgtcgacaatctagatccacaccatggggaggaagcaggccccgagggagggagggagggaggagcaccaacgagacgagatgaaaataacaactacgtgagaaaagcaaccatcaatcaatttaacagaaagggggacaggtcgcacgcaagcggcaaaccttcctttcattagttcatcacgagcttcagccagctttctgccaaaatgataatcccatccacaaccacagaccgtctgcggtgcccaatcagcggaacgctacatcacgtggagagaaaggaagcaactacctggcgtggtagtagagctgggagtcggcatcccacacgaacccgtctccaatgtccgccactgcgtcgtaaaaaatgcagtagatcctgtgctgcccctgtccttccatcaccgagatcccgtgccgccgatggtaggagggcactgaggatggaagggggtcggctgcacaattagcatagccagcgacagacagaacggcggtgcaccgggctgttcaccacgaaaaataaaattgtattataccatatactgttctatgctttcaaccttgtagcatccatgagtcaaccaaaacacttcaatccatcatccatacttgctcgtctaatatgttttgaaccaatgagcagaaccatcaatgtgagcagtcaattacggtcagcggggcaaacacacatattagtaatcacaattagtgtctaacctggtctagtcttgtagggtattatgtagctccctttgtgtttaggtcaccttgagggtagtgttttctgtttgtttgtcatcttgagggaaggagacctcagctagttccttgattcctacatgaaaccaagaacagatcaaacctgcaaaacctgcaaaatcaatatgtgatgaaatttgtgtagctaacaatatttgaagttctgaactgagagcacattacctcgtatgaccagccaagcaatcccagcttgcattccctggttctatcccaaccaaatgtgatttatcccatgcacataccacggtggggtccagatcaggactccattgatagttagtgtcaattatttagacagtggcaatttcaaagtgaaaaaaagaatgaagcagaaccacgatctgttctcaactattagcagaaaacaattgaggtagcaaaataattaacaataaataatgatggtttttttatatttgcaaccataccaaaatacatttgtagcaccttgaacaagagcagagctatatcatagcaatatttctttttcgtcaagaggggcttcaaacaactgcataacaaaaatgtaatcagtaaactaagtttaaatatgaatgtatctataattgagaaaatcatgtcttgtgaaggaataatcagtaaacttgccaagggctggcgtgcgtctctatgctctgctccctgaggctgctgcgtctatctggaaggcaaaagaattccgggggcgcggcgagatttctgaggccggggacgactcgtggggcggggatggtggaggccggggcatgaagcacggtgggggtggaaggggtgcgggaggagtatggaaggggcgggggaggcggcgcaacgcacgaccttccatcggagcgaggcggaagggtgcggacgcgcggtagaaccgtgcaccccgcagtggtgcggacgtctacaatagcctcttaaggaatagtagagataagcgccacaaatgagatgcaggtgggtttgcaactggatttacagcaaagaattcctataaatgtttcaacgtaaaaaaatgaatttcaataatgcacattgcctacagtggaattccctacagagaaatagagctagctaattcaatcctacattgttgaatgcagtaataccaaataagaaaggaacttttacagagtgagagcattgtcacttggacaaacaaaacatatcgagaccagcggtgtgtgaaagtgaaaccgacagacacatagctaacgaggaacagtggcagcgattccccagcatgattagcatttcaaagtcaccgccaaaatgcagttgagaccgccaaaaatcccaagaagaaattggataagcacagcggagagatggcaatagtcaattttctttgtgaagacgacatcactgccagcaggccgtcacgttcggcgggggcgatttagtcaacgtaggggagaaaatcgggcactaacctcgagcttattgaacct

SEQ ID NO: 795 - DNA, 7498 bp, Zea mays
ccttacaccacctcaaacatataatatcatttcttctcaactactaatccaagtaaactctcaagcacatttcatcgaacaccattatgcgtagccaatggcgcgctttgcagccaaaagatgggctccactagtgcggcggtaacggtagcggcaacggccatggtttgcaggcggctgtatcgaaggcggagtgaccgattttccctatgatttcccttataccacgtcaaacatataatatcatttcttctcaactactaatccaagtaagcaatcacgcacatttcatcgaacaccattatgcgtaactaatggcgcgctttgtagccaaaagatgggctccacgagtgcggcggtcacggtagcgacaacggccatggtttgcaggcggctgtatcgaagacagagtgaccgattttccctatgatttcccttacaccacctcaaacatataatatcatttcttctcaactactaatccaagtaaacactcacgcacatttcatcgaacaccattatgtgtagccaatggcgcgctttgcagcccaaagatgggcaccacgagtacggcggtcacggtagcggcaacggcaatggtttgcaagaagctgtatcgaaggcagaatgaccagttttccctatgatttcccttacaccacctcaaacatataatatcatttcttctcaaccactaatccaagtaaactctcatgcacatttcatcgaacgccattatgcgtagccaatggcgcgctttgcagccaaaagatgggctccacgagtgcggcggtcacagtagcggcaacgacgaaggtttgcaggcggctgtatcgaaggcggagtgaccggttttccctatgacttcccttgcaccacctcaaacatataatatcatttcttctcaactactaatccaagtaaactctcactcacatttcatcgaacaccattatgcgtagccaattgcgcgctttgcagccaaaagatgggctccacgagtacggcggtcacggtagcggcaacgacaatggtttgcaggaagctgtatcgaaggcggaatgaccggttttccctatgatttcccttacaccacctcaaacatataatatcatttcttctcaactactaatcaaagtaaactcccacgcacatttcatcgaacaccattatgagtagccaatggcgcgctttgcagccaaaagatgggctccatgagtgcggcggtcacggtagtggcaacgaccacgaattgtaggtggctatatcgaaggcggagtgaccggttttccccatgatttcccttacaccacctcaaacatataatatcatttcttctcaactactaatccaagtaaactctcacgcacattttatcgaacaccattatgcatagccaatggcgcgctttgcagccaaaagatgggctccatgagtgcggcggtcacggtagcggcaacgacaatggtttgcaggaagctgtatcgatggtggagtgaccggttttccctatgatttcccttacaccacctcaaaaatataatatcatttcttctcaactactaatccaagtaaactctcacgcacatttcatcgaacaccattatgcgtagccaatggcgcgctttgcagccaaaagatgggctccacgagtgcggcgttcatgaaagcggcaacggctatggtttgcaagcggctatatcgaaggcggagtgacggttttacccatgatttcccttacaccacctccaaaatataatatcatttcttctcaactactaatccaagtaaactctcacgcacatttcatcgaacaccattatgcatagccaatggcacgctttacagccaaaagatgggctccacgagtgcgtcggtcacggtagcggcaacggccatggtttgcaggcggctatatcgaaggcggagtgaccggttttccccatgatttcccttacaccacctcaaacatataatatcatttcttctcaactactaatccaagtaaactctcacacacatttcatcgaacaccattatgcgtagccaatggcgcactttgcagccaaaagatgggctccacgagtgcgacggtcacggtagcggcaacgaccatggtttgcatgcggctgtatcaaaggcggagtgataggttttccctatgattttgcttgcaccacccaaacatataatatcatttcttctcaactactaatccaagtaaactctcacgcacatttcatcgaacaccattatgcgtagccaatggcgcgctttgcagccaaaagatgggctccacgagtgccgcggtcacggtagcggcaacggccatggtttgcaggcggctgtatcgaaggcggagtgactggttttccctatgatttccctcataccacctcaaacatataatatcatttcttctcaactactaatccaagtaaactctcacgcacatttcatcgaacaccattatgcgtagccaatggcgcactttgcagccaaaagatgggctccacgagtgcggcggtcacggtagcgacaacagccatggtttgcaggcggctgtatcgaagatagagtgaccggttttccctatgatttcccttacaccacctcaaacatataatatcgtttcttctcaactactaatccaagtaaacactcacgcacatttcattaaacaccattatgcgtagccaatggcgcgctttgcagcccaaagatgggctccacgagtacggcggtcacgatagcggcaacggcaatggtttgcaggaagctgtatcgaaggcggaatgaccggttctccctatgatttcccttacgccacctcaaacatataatatcatttcttctcaactactaatccaagtaaactctcacgcacatttcatcgaacaccattatgtgtagccaatggcgcgctttgcagccgaaagatgggctccacgagtgcggcagtcacggtagcggcaatggccatggtttgcaagcggctatatcaaaggcggagtgatggttttcccaatgatttcccttacaccacctccaatatataatatcatttcttctcaactactaatccaagtaaactctcacgcacatttcatcgaacaccattatgcgtagccaatggcaagctttgcagccaaaagatgggctccacgagtgcgacggtcacggtagcggcaacggccatggtttgcaggcggctgtatcgaaggcggagtgaccggttttccctatgatttcccttgcaccacttcaaacatataatatcatttcctctcaactacttatccaagtaaactctcactcacatttcatcgaacaccattatgcatagccaatggcgcgctttgcagccaaaagatgcgctccacgagtgcggcggtcacggtagtggcaacgaccacgaattgtaggtggctatatcgaaggcggaatgaccggttttccccatgatttctcttacaccacctcaaacatataatatcatttcttctcaactactaatccaagtaaactctcacacacatttcatcgaacaccattatgcgtagccaatggcgcgctttgcagccaaaagatgggctccatgagtgtggcggtcacggtagcggcaacggcaatggtttgcaggaagctgtatcgatggtggagtgaccggttttccctatgatttcccttacaccacctcaaaaatataatatcatttcttctcaactactaatccaagtaaactctcacgcacatttcatcgaacaccattatgtgtagccaatggcgcgctttgcagccaaaagatgggctccacgagtgcggcgttcatggaagcggcaacggctatggtttgcaagcggctatatcgaaggcggagtgacggttttacccatgatttcccttacaccacctccaaaatataatatcatttcttctcaactactaatccaagtaaactctcacgcacatttcatcgaacaccattatgcatagccaatggcacgttttacagccaaaagatgggctccacgagtgcgtcggtcacggtagcggcaacggccatggtttgcaggcggctatatcgaaggcggagtgaccggttttccccatgatttcccttacaccacctcaaacatataatatcatttcttctcaactactaatccaagtaaactctcacgcacatttcatcgaacaccattatgcgtagccaatggcgcactttgcagccaaaagatgggctccacgagtgcgacggtcacggtagcggcaacgaccatggtttgcatgcggctgtatcaaaggcggagtgacaggttttccctatgatttcgcttgcaccacccaaacatataatatcatttcttctcaactactaatccaagtaaactctcacgcacatttcatcgaacaccattatgcgtagccaatggcaagctttgcagccaaaagatgggctccacgagtgccgctgtccacggcaacggccatggtttgcaggcggctgtatcgaaggcggagtgaccggttttccctatgatttcccttataccacctcaaacatataatatcatttcttctcaactactaatccaagtaaactctcacgcacatttcatcgaacaccattatgcgtagccaatggcgcactttgcagccaaaagatgggctccacgagtgcggcggtcacggtagcgacaacagccatggtttgcaggcggctgtatcgaagacagagtgaccggttttccctatgatttcccttacaccacctcaaacatataatatcgtttcttctcaactactaatccaagtaaacactcacgcacatttcatcaaacaccattatgcgtagccaatggcgcgctttgcagcccaaagatgggctccacgagtacggcggtcacgatagcggcaatggcaatggtttgtaggaagctgtatcgaaggcggaatgaccggttctccctatgatttcccttacgccacctcaaacatataatatcatttcttctcaactactaatccaagtaaactctcacgcacatttcatcgaacaccattatgtgtagccaatggcgcgctttggagccgaaagatgggctccacgagtgcggcagtcacggtagcggcaatggccatggtttgcaagcggctatatcaaaggcggagtgacggttttcccaatgatttcccttacaccacctccaatatataatatcatttcttctcaactactaatccaagtaaactctcacgcacatttcatcgaacaccattatgcgtagccaatggcaagctttgcagccaaaagatgggctccacgagtgcgacggtcacggtagcggcaacggccatggtttgcaggcggctgtatcgaaggcggagtgaccggttttccctatgatttcccttgcaccacttcaaacatataatatcatttcctctcaactacttatccaagtaaactctcactcacatttcatcgaacaccattatgcatagccaatggcgcgctttgcagccaaaagatgggctccacgagtacggcggtcacggtagcggcaacgacaatggtttgcaggaagctgtatcgaaggcggaatgaccggttttccctatgatttcccttacaccacctcaaacatataatatcatttcttctcaactactaatccaagtaaactctcacgcacatttcatcgaacatcattatgcgtagccaatggcgcgctttgcagccaaaatatgggctccacgagtgcggcgatcacggtagcggcaacgaccatggtttgtaggcggctatatcgaaggcggagtgaccggttttccccatgatttcccttacaccacctcaaacatataatatcatttcttctcaactactaatccaagtaaactctcacgcacatttcatcgaacaccattatgcgtagccaatggcgtgctttgcagccaaaagatgggctccacgagtgcggcggtcacggtagcggcaacggcaatggtttgtaggaagctatatcgaaggcggagtgaccggttttccctatgatttcccttacaccacctcaaaaatataatatcatttcttatcaactactaatccaagtaaactctcacgcacatttcatcgaacaccattatgcgtagccaatggcgcgctttgcagccaaaagatgggctccacgagtgcggcagtcacggtagcggcaatggccatggtttgcaagcggctatatcaaaggcggagtgacggttttccccatgatttcccttacaccacctccaatatataatatcatttcttctcaactattaatccaagtaaactctcacgcacatttcatcgaacaccattatgcgtagccaatggcaagctttgcagccaaaagatgggctccacgagtgcggcggtcacggtagcggcaacgtccatggtttgtaggcagctatatcgaaggcggagtgaccagttttccccatgatttcccttacaccacctcaaacatataatatcatttcttctcaactactaatccaagtaaactctcacgcacatttcatcgaacaccattatgcatagccaatggcgcgctttgcagccaaaagatgcgctccacgagtgcggcggtcacggtagcggcaacgaccatggtttgcaggaagctatatcgaaggcggagtgaccggttttccctatgatttcccttaccccacctcaaacatataatatcatttcttctcaactactaatccaagtaaactttcacgcacatttcatcgaacaccattatgcgtagccaatggcgcgctttgcaaccaaaagacgggctccccgagtgcggcggtcacggtagcggcaacgaccatggtttggaggaggctatatcgaaggcggagtgaccggttttccctatggtttcccttacaccacatcaaacatataatatcatttcttctcaactactaatccaagtaaacactcacgcacatttcatcgaacaccattatgcgtagccaatggcgcactttgcagccaaaagatgggctccacgagtgagacggtcacggtagtggcaacggccatggtttgcaggcggctatatcgaaggcgagtgaccggttttccctatgatttaccttacaccacctcaaacatataatatcatttcttctcaactactaatccaagtaaactctcacgcacatttcatccaacaccattatgcaaagccaatggcgcgctttgcagccaaaagatgggctccacgagtgcggcggtcacggtagtggcaacggccatggtttgcaggtggcaatatcgaaggcggagtgaccggttttccctatgatttctcttacaccacctcaaacatataatatcatttcttctgaactactaatccaagtaaactctcacgcacatttcatcgaacaccattatgcgtagccaatggcgcgctttgcagccaaaagatgggctccacag

SEQ ID NO: 796 - DNA, 6651 bp, Zea mays
cataaacatcacttgtttgggcatgttatctcataagatatgtagaaaattttcaaatgtttcatggttatgaacattaatgtatgtttgaagcggttcaaagccataaatgatgtaatgtttagaacggtagtttttacaaaaatgagccaacaaggtttgtcatcaatgttttcgcaatacactgatttgtgagtaaagggtcatgattttgtgcatgtttttctcgaaaagattgtggcatgaaacatgcaaaaactttgaagctttttgaagccctaaattatgtggtagatttacagaatgatccaacatgttgtttcacatgctccggcatcaactaaaattcaacacaatcaataacttgagtatgggacccacataattagatgatcgcatgccgattaaagttcaatgttttaaagaatgaggtaactttaaaagtatttgatttgcaatattcagatttttcaagataaactattttgcagagttacgacctctatcaatggaaaaaagttaatggaagaaaatttatatttccactttcattactcttttctaaatgtcatactgtaagacatacttgtttagacatgttaccttgaaacatatattgttctatttgcaacgtttcctcagttgtgaacacttgaacccaaatttaaggccgatcaaaacatgagtttgctacatgatatatcgatttctgatgtgcatcaactttgatgcattttgaaacccaaaatgttgtattgtttagacagacaatttttacggatggacccaacatgttgtttcgcatacaccatcattaacccattttctagacaaccataacatgattatgtgaccctaaattgtcacatgctagccctagatttggtcatatgaaggatgaggtgactcgaaaagcgcttgaagcacaacatgtagctttttttagatcatcaatttactataggtgtgagctatgcaacatggtgtttcacatgcttcatcatcaacccaagtgcaagacaacctatagcatgagtttgggcccaagatattggatgttcgaatgctagcactatggtttgtagatatgaagaatgaggtaactttagaaatgtttaaagtgcaacatgtatattttttagatcggtaattttccagagttgagagctatatttatacaattctgcttttattctgatccatgttttaagattctttgttattattctattacagtaatatcaatgatatttataatagaagaattaaatatagaaaaaaatgcattccaattttagttacaatttgctttataccagactataaacaaaaatagtttaggcatgctatcttaaactatatgtagtgctattttaaatttatgcctcgttatggacaacaatgcatgttttgaggacactcaaaaaaaaactatgggacacatgatatttatcacaaaacaatttatccaaggaaaattacattacaatttgctcattgccaaactgtaaatatcacttgtttggcatgttatctcataacatacgttgaaaattttcaaatgtttcatggttatggacattaatgtaagtttgaatcggttcaaagccctaaatgatgtaatatttagaacggtagtttttacaaaaaggacccaacaaggtttttcatcaatgttttcgcaatacactgatttgtgagtaaaggggtcatgatttcgtgcatgttttcttgaaaagattgtggcatgaaccatacaaaaactctgaagcttttcgatgccctaaattatgtggtagatttacagaatgatccaacatgttgtttcacacgctccaccatcaactaaaattcaacacaatcaataacttgagtatgggacccacatatttagatggtcgcatgccgattaaagttcagtgttttcaagaatgaggtaactttaaaagtatttgaattgcaatatgcagatttttcaagataaactattttacagagttatgacctctattaatggaaaaatagttaatggaagaaaatttatatttccactttcattactcttttctaaatgtcgtactataagacaaacttgtttaggcatgttaccttaaaacatatattgtgctatttgcaacgttccttagttgtgaacacatcaacctaagtttaaggccaatcaaaacatgagtatgagactaatgggttttaatttcatataagtttactgcatgatatatcgatttttgatgtgcgtcaacttcgatgcattttgaagccctaaatgttgtattgtttagatagacagttttacagatggacccaacttattgtttcgcatgcaccataattaaccaatgttcaagacaaccataacatgagtatgctaccttggattgtagcatgctagcactagatttggtcatgttaaggatgaggtgactgtagaagcgcttgaagcataacatgtagattttttctaatcatcactttactatagacgtgagctatccaacatgttgtttcatatgcttcgtcatcaacccaagtgcaagacaacctatagcacgagtttggggcccaagatattggatgttcgaatgctggcactagagtttgtagatatgaagaatgaggtaactttagaaatgtttaaagtgcaacatgtatatttttcagatcggtaattttccagagttgagagctatatttatgcaattctgcttttatttcgatctatgttttaagattctttgttattattctattacaattatatcaatgatatttataacaaaagaattaaatttagaaaagatttcattccaattttaattacaatttgctctatgccagacaataacaatattagtttaggcatgctattttaaaccatatgtagtgctattttaaataatccttcattatgaacaacaatgcatattttgaggccactcaaaaacaagtatgggactcatgatatttatcacaaaacaatttaaccaaggaaaattacattacaatttgctcattgccaaactgcaaacattacttgtttaggcatgttatctcataagatatgtggaaagatttcaaatgtttcatggttatggacattaatgtaagtttgaagcggttcaaagccctaaatgacgtaatgtttagaatggtagttttacaaaaatgacccaacaagaattgtcatcaatgttttcgcaatacactgatttgtgagtaaactgtcatgatttttgtgcatgttttttcaaaaaattgtggcatgaaccatgcgaaaactttgaagcttttcgaagccctaaattatttggtagatttacagaatgatccaacatgttgtttcacacgctccaccaacaactaaaattcaacacactcaataacttgagtatgggaccacataattagatggtcgcatgccgattaaagtttagtgttttaaagaatgaggtaactttaaaagtatttgaattgcaatatgaagattttcaagataaagtattttgcagagttatgacctctattaatggaaaaatagttaatggaagaaaatttatatttccactttaattactcttttctaaaagacatacttgtttaggcatgttaccttaaaaacatatataatgctatttgcagtgtcctcagttgtttacacatcaacccaagtttaaggccgatcaaaacatgagtataggactaatgggtattatattcgtacaagtttgctgcatgatgtatcgatttctgtcgtgcatcaactcgaagcatttgaagccctaaatgttgtattgtttagacaaactgtttttatagatggaaccaacgtgttgtttcgcatgcaccatcattaaccatgttcaagacaaccataacatgagtatgcgaccctagattgtcgcatgctagcagtagatttggtcatataaaggatgaggtgactctaaaagcgcttgaagcacaacatgtagattttttcagatcatcaatttactataggtgtgagctatgcaacatgttgtttcacatgcttcatcatcaacctaagtgcaagacaacctatagcatgagtttgaggcccaagatattggatgttcgaatgctgccactatagtttgtagatatgaagaatgaggtaactttagaaatgtttaaagtgcaacatgtatactttttagatcggtaattttccagagttgagagctatatttctacaattctgcttttatttcgatccatgttttaagattcattattatcattcttatagttatatcgatgaatttataacaaaagaattaaatatagaaaaattttcattcaaattttaattacaattggctctatgccgaactataaacaataatagattaggcatgctatcttaaaccatatgtagtgcttttttaaatgattcttggttatggagaacaatgcaagttttgaggccactcaaaaacaattatgttactcatgatatttgtcacaaaacaatttaaccaaggaaaattacattacaatttgcttattgccaaactgtaaacatcacttgtttaggcatgttatctcataagatatgtggaaaatttttaaatgtttcatggttatgaacattaatgtaagtttgaagcggttaaaagccctaaatgatgtaatgtttagaactctagtttttacaaaaaggacccaacaaggtttgtcgtgaaagtttttgcaatacactggtttgtgagtaaagcgtcatgatttcgtgcatgttttctcgaaaagattgtggcatgaaccttgcgaaaactttgaagcttttcaaagccctaaattatgtggtagatttacagaatgatccaacatgttgtttcacacgctccaccatcaactaaaattcaacacaatcaataacttgagtatgggacccgcataattagatggtcgcatgtcgattaaggttcagtgttttaaagaatgagaaactttaaaagtatttgaattgcaatatgcagatttttcaagataagctattttgcagagttacgacctctattgatggaaaattagttaatggaagaaaatttatatttccactttcattactcttttctaaaagacatacttgtttaggcatgttaccttaaaacatatattgtgctatttgcaatgttccccagttatgaacacatcaacccaagtttaaggccgatcaaaacatgagtatgggactaatgggtattatattcgtacaagtttacttcaggatatatcgatttttgatgtgcgtcaactttgatgcattctgaagccctaaatgttgtattgtttagacagacattttttacggatggacccaacgtgttgtttcacatgcaccatcattaacccatgttcaagacaaccatatcatgagtatgcgacctagattgtcacatgctagcactagatttggtcatatgaaggatgaggtgactctaaaagcgcttgaagcacaacatgtagattttttcagatcatcaatttactatagtcttgagctatgcaacatgttgtttctcatgcttcagcatcaacccaagtgcaaaacaacctatagcatgcgtttggggcccaagatattggatgtttgaatgctggcactatagtttgtagatatgaagaatgatgtaactttagaaatgtttaaagtgcaacatgtatattttttagatctgtaattttccggggttgagagctatatttatgcaattctacttttattttgatccatgttttaagattccttgttattattctattacagttatatcaatgatatttataacaaaagaattaaatatagaaaaaatttcattccaattttaattacaatttgctctatgctagactgtaaacaataatagtttaggcatgctatcctgaaccatatgtagcgctatttttaatgattattggttattgacaacaatgcatgttttgaggccactcaaaaacaagtatgggactcatgatatttatcacaaaacaatttaaccaaggaaaattatattacaattttatcattgccaaactataaacatcacttgtttgggcatgttatctcataagatatgtagaaaattttcaaatgtttcatggttatggacattaatgtaagtttgaagcggttcaaagccctaaatgatgtaatgtttagaacggtagtttttacaaaaatgacacaacaagttttgtcatcaaagatttcgcaatacattgatttgtgagtaaagggtcattatttcgtgcatgttttctcgaaaagattgtggcatgtgaaccatgcgaaaactttgaagcttttcgaagccctaaattatatggtagatttacagaatgatccaacatgttattttacacgctccaccatcaactaaaattcaacacaatcaataacttgagtatgggacccacataattagatggtcacatgccgattaaatttcagtgttttgaagaatgaggtaactttaaaagtatttaaattgcaatatgcagatttttcaagataaactattttgcagagttacgacctctattaatggaaaaatagttaatggaagaaaatttatatttctactttcattactcttttctaaatgtcgt

SEQ ID NO: 797 - DNA, 6435 bp, Zea mays
tggggaaaggcacaaaaggatgatggctgctaagggtgggaggcttctagggttagggaggtataaataaaagaaaacttccacaatcctaatttccaatttcttagatcaaccgacactcgaaaagactcatccggactccaaacaaggcaaactagtaattgatcggaatcatctcgatgagatctatacatctacgacctccaatcatccataggacacaccatatttggattataaacatggtttaatttttagggcgatacatttgggcatgttatctcataagatatgtggaaagatttcaaatgtttcatggttataaacattaatgtaagtttgaagcggttcaaagccctaaatgatgtaatatttagaacagtagtttttacaaaaaggatccaacaaggtttgtcatcaaagttttcacaatacactgattttggagtaaacggttatgatttcgtgcatgttttctcgaaaagattgtggcatgaaccatgtgaaaactttgaagcttttcgaagccctaaattatgtggtagatttacagaatgatccaacatgttgtttcacacgctccaccatcaactaatattgaaaacaatcaataacatgattgtgggacccacatagttagatggtcgcatgccgattaaagttctgtgttttaaagaatgagataaatttaaaagtatttgaattgctatatgtagatttttcaagataaactattttgcagagttacgacctctattaatggaacaatagttaatggaagaaattttatatttgcactttcattactcttttctaaatgtcgtactgtaagacatacttctttaggcatgttaccttaaaacatatatagtgccatttgcaatgttcctcagttgtgaacacatcaacccaagtttaaggccaatcaaaacatgagtttgggactaatgagtattaatttcatataagtttactgcatgatatattgatttttggtgtgcgtaaacttcaatgtattttgaaggcctaaatgttgcattgtttagatagacagtttttatggatggacccaacttattgtttcgcatgcaccatcattaaccaatgttcaagacaaccataacatgagtatgcgaccctagattgcagcatgcttgcactagatttggtcatatgaaggatgaggtgactctagaagcgcttgaagcataacatgtagatttttttcagatcatcacttaactatagacgtaagctatcgaacatgttgtttcacatgcttcatcatcaacccaagtgcaagacaacctatagcatgagtttggggcccaagatattagatgttcgaatgctggcattagagtttgtagatgtgaagaatgaggtaactttagaaatgttgaaagtgcaacatgtatatttttaagatcggtaattttccagagttgagagctatatttatgcaatttttcttttatttcgatccatgttttaagatactttgttattattctattacaattatatcaatgatatttataacaaaagaattaaatatagaaaaaatttcattccaattttaattacaatttgcttaatgccagactataaacaacattagtttaggcatgctgttttaaaccatatgtagtgctattttaaatgattattggttatgaacaacagtgcatgttttgaggccactcaaaaaacaagtatgggactcatgatatttatcacaatacaatttaaccaaggaaaattacattacaattttctcattgccaaactgtaaacatcacttgtttaggcatgttatctcataagatatgtggaaagatttaaatgtttcatggttatggacgttaatgtatgttcgaagcggttcaaagccctaaatgacataatgtttagaacggtagtttttacaaaaatgacccaacaatatttatcatcaatgttttcgcaatacactgattgggagtaaagtgtcatgatttcatgcatgttttttttgaaaagattgtggcatgaaccctgctaaaactttgaagcttttcgaagccctaaattatttggtagatttacagaatgatccaacatgttgtttcacacgctccaccaacaactataattcaacacactcaataacttgagtatgggacccacataattaaatggtcgcatgccgattaaagtttagtgttttaaagaatgaggtaactttagaagtatttgaattgcaatatccagatttttcatgataaactattttgcagagttacagcgtctcttttctaaatgttgtagaatacttgtttaggcatgttaccttaaaaacatatatagtgctatttgcaatgttcctcagttgtgaacacatcaatccatgtgcatgggactaatgggtattatattcgtacaagtttgcagcatgatatatcgatttctgatgtgcgtcaacttcgaagcattttgaagccctaaatgttgtattgtttagacagacaatttttacatatggacccactgtgttgtttcgcatgcaccataattaacccatgttcaagagaaccataacatgagtatgcgaccctagattgtcgcatgctagcagtagatttggtcatataaaggatgaggtgaatctaaaagcgcttgaagcacaacatgtagatttttttcaaatcatcaatttactataggcgtgagctatgcaacatgttgtttcacatgcttcatcatcaacctaagtgccagacaacctatagcatgagtttggggcccaagatattggatgttcggatgctgccactatagtttgtagatatgaagaatgaggtaactttagaaatgtttaaagtgcaacatgtatattttttggatcggtaattttccggagttgagagctatatttatgcatttctgcttttatttcgattcatgttttaagattctttgttattattctattacagttatatcaatgatatttataacgaaagaattaaacatagaaaaattttcattccaattttaattacaatttgctctatgctagactataaacaacaatagtttaggcatgctatcttaaaccatatgtagtgctattttaaatgattcttggttatggacaacaatgcatgttttgaggccactcaaaaaacaattatgtgactcatgatatttatcacaaaacaatttaacaaaggaaaattacattacaattggctcattgccaaactgtaaacctcacttgtttgggcatgttatctcataagatatgtggaaaatttttaaatgtttcatggttatggacattaatgtaagtttgaagcggttcaaagccctaaatgatgtaatgtttagaacgatagttttcataaaaaggacccaacaaggtttgtcatgaaagttttcgcaatacactgatttctgagtaaagggtcatgatttcgtgcatgttttctcgaaaagattgtggcatgaaccatgagaaaattttgaagcttttcaaagccctaaattatgtggtagatttacagaatgatccaacatgttgtttcacacgctcaaccatcaactaaaattcaacacaatcaataacttgagtatgggacccacataattaggtggtcgcatgtcgattgttttaaagaatgcggtaactttaaaagtatttgaattgcaatatgcagatttttcaagataaactattttgcagagttacgacctctattaatggaaaaataattaaaggaagaaaatttatatttccattttaattactcttttctaaaagacatatttgtttaggcatgttaccttgtaatatatattgtcctatttgcaacgttcctcagttgtgaacacttcaacccaagtttaaggctgatcaaaacatgagtatgggactaatgggtattatattcgtacaagtttgctgcatgatatatcaatttctgatgtgtgtcaacttcgatgcattttgaagccctaaatgttgtattgtttagacaaacaattttttacggatggacccaacgtgttgtttcacataaaccatcattaacccatgttcaagacaaccataacatgagtatgcgatcctagattgtcgcatgttagcactagattgggtcatatgaaggatgaggtgactctaaaagcgattgaagcacaacatgcagattttttttggatcatcaatttaatataggcgtgagctatgcaacatgttgtttcaattgcttaatcatcaacccaagtgcaagacaacctatagcatgagtttggggcccaagatattggatgttcgaatgctggcaccatagtttgtagatatgaagaatgaggtaactttagaaatgtttaaagtgcaacatgtatattttttagatcagtaatttccagagttgagagctatatttatgcaattctgcttttatttcgatccatgttttaagattctttgttattattctattacagttatatcattgatatttataacaaaagaattaaatatagaaaaaaattcattccaatttgaatttcagtttgctctatgccagactataaacaataatggtttaggcatgctatctttaactttatgtagtgctattttaaatgattcttggttatggttaacaaaccatgttttgaggccactgaaaaaaagtatgggactcatgttatttatcacaaaacaatttaaccaaggaaaattacattacaatttgctcattgccaaaatgtaaacatcacttgttttggcattttatctcgtaagataagtggaaaattttcaaatgtttcatggttatggacattaatgtaagtcagaatcggttcaaagccctaaatgatgtaatgtttagaatggtagtttttacaaaaaggacccaacaaggtttgtcatcaaactttttgcaatacactgatttgtgagtaaaagagtcatgatttcgtgcatgttttctcgaaaagattgtggcatgaaccatatgaaaactctaaagcttttcgaaaccttaaattatgtggtagatttacagaatgatccaacatgttgtttcacacgctccaccatcaactaaaattcaacacaatcaataacttgagtatgggacccacataattagatggtcttatgccaattaaagtttattgttttcaagaatgaggtaactttaaaagtatttgaattgcaatatgcagatttttcaagataaactattttgcagagttacgacctttattaatggaaaaatagttaatggaagaaatttatatttccactttcattactcttttctaaatgtcgtactgtaagacatacttgtttaggcatattaccttaaaacatacataatgctatttgcaacgttcctcagttgtgaacacatcaacccaagtttaagaccgatcaaaacatgagtaatggactaatgggtattatattcgtacaagtttgttgcatgatatatcgatttgatgtgcgtcaactttgatgcattttgaagccctaaatgttgtattgtttagacagacagcttttacggatggacccaacgtgttgtttcgcatgcaccatcactaacccatgttcaagataaccataacatgagtatgagaccctagattgtcgcatgctagcacaagatttcgtaatatgaagaataaggtgactctaaaagcccttgaagcacaacttgtagattttttcagatcatcaatttactataggcgtgagctatgcaacatgttgtttcacatgattcatcatcaacccaagtgcaagacaacctatggcatgagtttgggccccaaattattggatgttcgaatgctggcactatagttcgtagatatgaagaatgagataactttagaaatgtttaaagtgcaacatgtatattttttagatcggtaattttccagagttgagagctatatttatgcaattcttcttttatttcaatccatgttttaagattctttgttattattatattacagttatatcaattaaatatagaaaaaatttcattccaattttaattacaatttgctctatatcaaactataaacaataatagtttaggcatgctatcttcaactatatgtaacaccttaaagttcaatcttgtgaaaatgaggaaaattctccaggggcttttaaatcaaaacacctttccttgagaatattcataatttcaaagttactactcccaaaattaatataaatttttttgactaaaataaaaagatacctagataaacaaatttgttcttggagtgaaattataagaattattattaaactatatataatctacaatataagttataattccaaaaacaaattcatgagatgtgaactattctctatttcataattagaatcatgtataaaagaactaaaaa

SEQ ID NO: 798 - DNA, 6150 bp, Zea mays
tttttttagttcttttatacatgattctaattatgaaatagagaatagttcacatctcatgaattttttttggaattataatttatattgtagattatatatagtataataataattcttataatttcactccaagaacagtttagtttatctaggtatctttttattttagtcaaaaaattatattaattttgggagtagtaactttgaaattatgaatattctcaaggaaaggtgttttgatttaaaaacccctggagaattttcctcattttcacaggattgaactttagggtgttacatatagttgaatatagcatgcctaaactattattgtttatagtctgatatagagcaaattgtaattaaaattggaatgattttttttctatatttaattcttttgttataaatatcattgaaataactgtaatataataataacaaagaaccttaaaatatggatcaaaataaaagaataattgcataagtatagctctcaactctagaaaattaccgatctaaaaaatatacatgttgcactttaaacatttcttaagttacctcattcttcatatctacaaactatagtgccagcattcgaacatccaataatttgggccccaaactcatgctacaggttgtcttgcacttgggttgatgatgatgcatgtgaaacaacatgttgcatagctcacgcctatagtaaattgatgatctgaaaaaaatctacatgttgtgcttcaagcgcttttagagtcacctcatccttcatatgaccaaatcttatgctagcatgcgacaatctagggtctcatactcatgttatggttatcttgaacatgggataatgatggtgcatgcgaaaaaacacattgtctaaacaatacaacatttagggcttcaaaatgcattgaagttgacgcacatcagaaatcgatatatcatgcaacaaacttgtaggaatataatacccattagtcacatactcgtgttttgatcggccttaaactttggttgatgtgttcacaactgaggaacgttgcaaatagcaaattgtatgtttaaggtaacatgcctaaacaagtatgtcttacagtacgacatttagaaagagtaatgaaagtggaaatataaattttcttccattaactatttttccattaatagaggtcgtaactctgcaaaatagtttatcttcaaaaatctgcatattgcaattcaaatacttttaaagttacctcattcttgaaaacactaaactttaatcggcatgcgaccatctaattatgtgggtcccatactcaagttattgattttgttgaatattagttgatggtggagcgtgtgaaataacatgttggatcattttgcaaatctaccacataatttagggcttcgaaaagcttcagatttttcgtatggttcatgccacaatcttttcgagaaaacatgcacaaaatcatgactcttttactcacaaatcagtgtattgcgaaatgtttgatgacaaaccttgttgggtcctttttgtaaaaactaccattctaaacattacatcatttagggctttgaaccgattaaggcttacattaatgtccataaccatgaaacatttgaaaattttcgacttatcttacgagataacatgccaaaacaagtgatgtttacattttggcaatgatcaaattgtattgtaattttccttggttaaattgttttgtgataaatatcatgagtcccatacttttttagtggcctcaaaacatccattgttaaccataaaaaagaatcatttaaaatagcactacaaaaagttaaagatagcatggcgaaaccattattgcttatagtctggcatagagcaaattgaaattcaaattggaatgaatttttttctatatttaattcttttgttataaatatcattgatataactgtaatagaataataacaaagaatattaaaacatggatcgaaatgaaagcagaattgcataaatatagctctcaaccctggaaattacagatctaaaaaatatacatgttgcattttaaacatttctaaagttacctcattcttcatatctacaaactatagtgccagcattcgaacatccaatatgttgggccccaaactcatgctataggttgtcttgcacttgggttgatgatgaagcaattgaaacaacatgttgcatagctcacacctatagtaaattgatgatctgaaaaaaatctacatgttgtgcttcgatcgattttagagtcaccttatccttcatatgaccaaatctagtgctaaaatgcatcaatctagggtcgcatactcatgttatggttgtcttgaacatgggttaatgatggtgtatgtgaaacaacacgttgggtccatccgtaaaaactgtctgtctaaacaatacaacatttagggcttcaaaatgcatcgaagttgacgcacatcagaaatcgatatatcatgcagcaaacttgtacgaatataatacccattagtcccatactcatgttttgatcggccttaaacttgggttgaagtgttcacaactgaggaacgttgcaaatagcacaatatatgttacaaggtaacatgcctaaacaagtatgtcttttagaaaagagtaatgaaagtggaaatataaattttcttctattaactatttttccattaatagaggtcgtaactctgcaaaatagtttatcttgaaaaatctgcatattgcaattcaaatacttttaaagttaccccattctttgaaacattgaactttaatcgacatgcgaccatctaattatgtgggtctcatactcaagttattgattgtgttgaattttagttgatggtggagcgtgtgaaacaacatgttggatcattctgtaaatctaccacataatttagggctttgaaaagcttcaaagtttttgcatggttcatgccacaatcttttcgagaaaacatgcaggaaatcatgaccctttactcacaaatcagtgtattgcgaaaactttcatgacaaaccttgttgggtcctttttgtgaaaactaccattctaaacatttcatcatttagggctttgaaccgattcaaacttacattaatgtccataaccatggaacatttaaaaattttccacatatcttatgagataacatgcccaaacaagtgaggttttcggtttggcaatgaacaaattataatgtatttttccttggttaaattgttttgtgacaaatatcttgtcacataattgttttttgagtggcctcaaaacgtgcattgttgtccataaccaagaatcatttaaaatatcactacatatggtttaagatagcatgcctaaactatagttgtttatagtcaagcatagagcaaattgtaattaaaattggaatgaaaatttttctatacttaattctttcgttatgaatatcattgatttaactgtaatagaataataacaaagaaccttaaaacatggctcaaaataaaagaagaaatgcataaatatagctctcaactccaaaaaattaccgatctaaaaaatatacatgttgcactttaaacatttctaaagttacctcattcttcatatctacaaactatagtggcagcattcaaacatccaatatcttgggccccaaactcatgctataggttgtcttgcacttaggttgatgatgaagcatgtgaaacaacatattgcatagctcacgcctatagtaaattgatgatttgaaaaaaatctacatgttgtgcttcaagcgcttttagattcacctcatcctttatatgaccaaatctactgctagcatgtgacaatctagggtcacatacttatgttatggttgtcttgaacatgagttaatgatggtacatgcgaaacaacacgttgggtccatctgtaaaaactgtctgtctaaacaatacaacatttagggcttcaaaatgcttcgaagttgatgcacatcagaaatcgatatatcatactgcaaacttgtacgaatataatacccattagtcccatacagatgttttgatcggccttaaactcgggtagatgtgttcacaactgaggaacattgcaaatagcactatatatgtttttaaggtaacaagcctaaacaagtgtgtcttatagtacgacatttagaaaagagtcatgaaagtggaaatataaattttcttccattaactatttttccattaatagacgtcgtaactttgcaaaatagtttatcttgaaaaattggcatattgtaattcaaatacttctaaagttacctcattctttaaaacactaaactttaatcagcatgcgaccatttaattatgtgggtcccatacttaagttattgagtgtgttgaattttagttgttggtggagcgtgtgaaacaaaatgttggatcattctgtaaatctaccaaataatttagggctttgaaaagcttcaaagttttagcagggttcatgccacaatcttttcaaaaaaacatgcacgaaatcattacactttactcacaatcagtgtattgcgaaaacattgatgataaatcttgttgggtcatttttgtaaaaactgacgttctaaacattacgtcatttaggcctttgaaccgcttctaacttacaataatgtccataaccatgaaacatttaaatctttccacatatcttatgagataacgtgcttaaacaagtgatgtttatagtttggcaatgagaaaattgtaatgtaattttccttggttaaattgtattgtgataaatatcatgagtcccatacttgttttttgggtggcctcaaaacatgcactgttgttcataaccaagaatcattcaaaatagcactacatatggtttaaaacagcatgcctaaactaatgttatttatagtcacgcataaagcaaattgtaattaaaattggaatgaaatttttttctgtatttaattcttttgttataaatatcattgatatacttgtaatagataaataacaaagtatcttaaaacatggatcaaaatgaaagaaaaattgcataaatatagctctcaactctggaaaattaccgatcttaaaaatatacatgttgaactttaaacatttctaaagttacctcattcttcatatctacaaactctagtgacagcattcgaacatccaatatcttgggccccaaactcatgctataggttgtcttgcacttgggttgatgatgaagcatgtgaaacaacatgttggatagctcacgtctatagtaaagtgatgatctgaaaaaatctacatgttatgcttcaagcgcttctacagtcacctcatccctcatatgaccaaatctagtgcaagcatgcagcaatctagggtcgcatactcatgttatggttttcttgaacattggttaatgatggtgcatgcgaaataataagttgggtccatccataaaaactgtctatctaaacaatacaacatttagggcttcaaaatacatcgaagttgacgcacaccagaaatcaatatatcatgcagtaaacttatatgaaattaatactcattagtcccatactcatgttttgattggctttaaacttgggttgatgtgttcacaactgaggaacattgcaaatagcactatatatgttttaaggtaacatgcctaaagaagtatgtcctacagtacgacatttagaaaacagtaatgaaagtgcaaatataaattttcttccattaactatttttccattaatagaggtcgtaactctgcaaaatagtttatcttgaaaaatctgcatatagcaattcaaatacttttaaagttatctcattctttaaaacactgaactttaatcggcatgtgaccatctaactatgtgggtcccacaatcacgttattgattgttttcaatattagttgatggtggagcgtgtgaaacaacatgttggatcattctgtaaatctaccacataatttagggcttcgaaaagcttcaaagttttcgcatggttcatgccacaatcttttcgagaaaacatgcacgaaatcatgaccctttactcccaaatcagtgtattgtgaaaactttgatgacaaaccttgttgggtcctttttgtaaaaactattgttctaaacatt

SEQ ID NO: 799 - DNA, 5802 bp, Zea mays
ccaaacaagtgatgtttacagtttggcaatgagcaaattgtaatgtaattttccttggttaaattgttttatgataaatatcatgagtcccatacttgctttttgagtggcctcaaaacatgcaatattgtccataaccaagaaccatttaaaatagcactacatatggtttaacataacatgcctaaactagttttgtttataatctggcatagagaaaattgtacttaaaattggaatgaaattttttgtatatctaattcttttgttacaaatatcattggtataactgtaatagaataataacaaagtatcttaaaacatggatcaaaataaaagcacaattgcataaatatagctctcaactccggaaaattacagatctaaaaatatacatgttgcactttaaacatttataaagttaccttattctgaatatctacaaactatagtgtctgcattcgaacatctaatatcttgggccccaaactcatgttataggttgtcttgcacttgggttgatgatgaagcatgtgaaagtaaattaattatctgaaaaaaatctatatgttatgcttcaagcgcttctagagtgccctcgtccttcatatgaccaaatctagtgctagcatgcgacaatctagggtcgcatactcatgttatggttgtcttgaacatgggttaaggatggtgcatgcgaaacaacaagttgggtccatccgtaaaaactgtctatctaaacaatacaatatttagggcatcaaaatgcaaggaagttgacgcacattagaaatcgatatatcatgcattaaacttgcatgaaattaatacccattagtcctatactcatgttttgatctgccttaaacttggtttgatgtgttcacaactgaggaacatgttttaaggtaacatttctaaacaagtatgtcttacagtactacatttagaaaagagtaatgaaagtggaaatataatttttcgtccattaactattttccgttaatagaggtcgtaactctgcaaaatagtttatcttgaaaaatctgcatattgcaattaaaatacttttaaagttacctcattttttaaaacatttaactttaatcggcatgcgaccatctaattatgtgggtaccatattcatgttttgattgtgttgaattttagttgctggtggagtgtatgaaacaacatgttggatcattctataaatctaccacataatttagggcttcgaaaagcttcaaagttttctcatggttcatgacacaatcttttcgagaaaacatgcatgaaatcatgacccttcactcccaaatcagtgtattgcgaaaactttgatgagaaaccttgttgggtcgttttgtaaaaactaccattctaaacattacatcattgagggctttgaaccgcttcaaacttacattaatgtccataaccatgaaacatttgaaatttttccacatatcttatgagataacatgcccaaacaagtgatgtttacagtttggcaaagagcaaattgtaatataattttccttagttaaattgttttgtaataaatatcatgagtcccatacttgttttttgagtggcctcaaaacatgcactgttgtccataaccaagaaatatataaaatagcacctacatatggtttaagataccatgcctacactagtattgtttatagtctctcatagagcaaattgtaattaaaattggaatgaaatttttctatatttaattcttttgttacaaattgatataaatgtaatagattaataataaagaatcttaaaacatggatcaaaataaaagcagaattgcataaatatttctctcaattccagaaaattaccaatctaaataatatacatgttgcactttaaacatttctaaagttacctcattcttcatacctacaaactttagtgctagcattcgaacatccaatatcttgggccccaaactcatgcgataggttgtctatgttttaaggtaacatgcctaaacaagtatttcttacagttcgacgtttggaaaagagtaatgaaagtgaaaatataattttttcttccattagctatttttcctttaatagaggtcgtaactctgcaaaatcgtttatcttgaaaaatcttcatattacaattcaaatacttttaaagttacctcattcttcaaaacactgaactttaatcggcatgcgaccatctaattatgtgggtcccacactcaagttttgattgtgttgaattttagttgctggtggagcgtgtgaaacaacattttggatcattctataaatctaccacataatttagggtttcgaaaagcttcaaagttttagcatggttcaagccacaatcttttcgagaaaacatggatgaaatcatgaccctttactcccaaatcattgtattgcgaaaacttttatgacaaaccttggtgagtcgtttttgtaaaaactttcattctaaacattacatcatttagggctttgaacgtcttcaaacttacattaatgtccataaccatgaaacatttgaaatctttccacatatcttatgagataacatgcttaaagaagtaatgtttaaagtttggcaaagagcaaattgtaatgtaattttacttggtcaaattgttttgtagtaaatatcatgagtcccatacttgtttttgagtggcctcaaaacatgcactgttgtccataaccaagaaatatataaaataacactacatatggtttaagatagcatgcctaaactagtattgtttatagtctcgcatagagaaaattgtaattaaaattggtatgaaattttttctatatttaattcttatgttataaatatctttgatataactataataaaataataacaaagtatcttaaaacatggatcaaaataaaagcagaattgcaaaaatatagctctcaacttcggaaaattaccaatctaaaaaatatatacatgttgcactttaaacatttctaaagttaactcattcttcatatctataaactctagtgccagcattcgaacatctaatatcttgggccaaaactcatgctataggttgtcttgcacttgggttgatgatgaagtatgtgaaacaacatgttcgatagctcacgtctatagtaaagtgatgatctaaaaaaaatctacatgttatgctttaagcgcttctagagtcaccacttccttcatatgaccaaatctagtgcaagcatgctgcaatctagggtcgcatactcatgttatggttgtcttgaacattggttaatgatggtgcatgcgaaacaataagttgggtccatccgtaaaaactgtatgtctaaacaatacaacatttagggcttcaaaatgcatcgaagttgacgcacaccagaaatcgatatatcatgcagtaaacttatatgaaattaatactcattagtcccatactcatgttttgattggccttaaacttgggttgatgtgttcacaactgaggaacattgcaaatatcattatatatgttttaaggtaacatgcctaaacaagtatgtcttacagtacggcatttagaaaagagtaatgaaagtggaaatatattttttcttccattaactatttttccattaaaagaggtcgtaactatgcaaaatagtttatcttgaaaaatctgcatatagcaattcaaatacttttaaagttatctcaccctttaaaacactgaactttaatcggcatgcgaccatctaatgatgtgggtcccatactcaagttattcattttattgaattttagttgatggtggagcctgtgaaatagcatgttggatcattctgtaaatctaccacataatttagggcttcgaaaagcttcaaagttttcgcatggttcatgccacaatcttttctagaaaacatacacaaaatcatgaccctttactcccaaatcagtgtactgtgaaaactttgatgacaaaccttgttgggtcctttttgtaaaaactaccgttctaaacattacatcatttagggatctgaaccgcttcaaacttacattaatgtccataaccatgaaacatttgaaaaattcccacatatcttatgagataacatgcttaaacaagtgatgtttacagtttgacaatgagcaaattgtaatgtaatttttcctaggttaacttgttttctgataaatattatgagtcccatacttgtttttgagtggcctcaaaacatgcattgttgtccataaccaagattcatttaaaatagcactacatatggtttaagatagcatgcctaaactagtattgtttatagtctcgcatagagaaaattgtaactaaaattggaatgaaattttttctatatttaattcttttgttgtaaatatcattgatataactgcaatagaataataacaaagaatcttaaaacatggatcgaaataaaagcagaattgcttaaatatagctctcaaatctgataaattagcgatctaaaaaaatataattgttgcactttaaacatttctaaagttgcctcattcttcatatctacaaactctagtgccagcattcgaacatccaatatcttaggccccaaactcatgctataggttgtcttgcacttggatgatgatgaagcatgtgaaacaacatgtttgatagctcatgcctatagtaaattgaggatacgaaaaaatatacatgttatatttcaagcgcttatagagtcacctcatccttcatatgaccaaatctagtgctagcatgcgacaatctaggatcgcatactcatattatggttgtcttgaacatgggttaatgatggtgcatgcgaaacaagttgggtctatccgtaaaaactgtctatctaaacaatacaacatttagggcttcaaaatgcatcaaagttgacacacatcagaaatcgatatatcatgcagcaaacttgtacgaaattaatacccattagccccatactcatgttttgatcggccttaaacttgggttgatgtgttcacaactgaggaacattgcacattgcactatatatgtgttaatgtaacatgcctaaagaagtatgtcttacagtacgacatttagaaaagagtaatgaaagtgaaaatataaattttcttccattaactattttccattaatagaggtcataactctgcaaaatagtttatcttgaaaaatctgcatattgcaattcaaatacttttaaagttatctcattatttaaaacactgaacattaatcggcatgcgaccatctaactatgtgggtcccacaatcacgttattgattgttttcaatattagttgatggtggagcttgtgaaacagcatgttggatcattctataaatctaccacataattttttcgcatagttcatgccacaatctttttgataaaacatgcacaaaattatgaccctttactcccaaatcagtgtattgcgaaaactttgatgacaaacatttttgggtcctttttgtaaaaattaccattctaaacattacatcatttagggctttgaaccgcttcaaaacttataataatgtccataaccatgaaacatttgaaatctttccacatattttctaagataacatgcccaaacaagtgatgtttacagtttggcaatgagcaaattgtaatgtaattttccttggttaagttgttttgtgataagtatcatgagtcccatacttgttttttgagtggcctcaaaacatgcattattgtccataaccaataatcatttacaatagcactacatatg

SEQ ID NO: 800 - DNA, 5709 bp, Zea mays
aattgcaatatgcagatttttcaagataaactattttgcagagtgacgacctctattaacggaaaaatagttaatggaagaaagatattttcactttcattactcttttttaatgccgtattgtaagacatacttgtttaggcatgttaccttaaaacatatatagtgttatttgcaatgttcctcagttgtgaacacatcaaaagttcaaggccgatcaaaacatgagtatgagactaatgggtattaatttcgtgcaagtttactgcatgatatatcgatttctgatgtgcgtcagcttcgatgcatttgatgccctaaatattgaattgtttagacagacagtttttacggatggaccaaacttattgtttcgcatgcaccatcattaacccatgttcaagacaaccataacatgagtatgcgaccctagattgtcgcctgctagcactagatttggtcatatgaatgataaggtgactctagaagcgcttgaagcataacatgtagatctttttcagatcatcaatttaatataggcgtgagctatccaacatgttgttttacatgcttcatcatcaacccaagtgcaagacaacctatagcatgagtttggggcccaagatattagatgttcgaatgctggaactagagtttgtagatatgaagaatgaggtaactttagaaatgtttaaagtgcaacatgtatatttttagatcggtaattttttcagagttgacagctatatttatgtaattctgcttttatttcgatccatgttttaagatactttattattattctattacagttatatcaatgatatttataacaaaataattaaatatagaaaaaaatttattccaattttaattgcaatttgctttatgccagactataaacaatactagtttaggcatgctatcttaaaccatatgtagtgctattttaaatgattctcggttatagacaataatgcatgttttgaggccactcaaaaaacaagtatgggactcatgatatttatcacaaaacaacttaaccaaggaaaattacattacactttgctcattgccaaactgtaaacatcacttgtttggacatgttatctcataaaatatgtggaatgatttcaaatgtttcatggttatggacattaatgtaagtttgaagcggttcaaagccctaaatgatgtaatgtttagaacggtaatttttacaaaaaggactcaaaaaaggtttgtcatcaaagttttcgcaatacactaatttgggagtaaagggtcatgattttgtgcatgttttctcgaaaagattgtgggatgaaccatgcgaaaactttgaagcttttcgaagcactaaattatgtggtatatttatagaatgatccaacatgttgtttcacacgctccaccatcaactaaatataacacaatcaataacttcagtatgggacccacatatttagatggtcgcatgccgattaaagttcaatgttttaaagaatgaggtaactttaaaagtatttgaattgcaatatgcagatttttcaagataaactattttgcagagtgacgacctctattaacggaaaaatagttaatggaagaaagattatattttcactttcattactcttttttaatgccgtattgtaagacatacttgtttaggcatgctaccttaaaacatatatagtgttatttgcaatgttcctcagttgtgaacacatcaaaccaagttcaaggccgatcaaaacatgagtatgagactaatgggtattaatttcgtgcaagtttactgcatgatatatcgatttctgatgtgcgtcaacttcgatgcattttgatgccctaaatattgaattgtttagacagacagtttttacggatggaccaaacttattgtttcgcatgcaccatcattaacccatgttcaagacaaccataacatgagtatgcgaccctagattgtcgcctgctagcactagatttggtcatatgaatgataaggtgactctagaagcgcttgaagcataacatgtagatctttttcagatcatcaatttaaaataggcgtgagctatccaacatgttgttttacatgcttcatcatcaacacaagtgcaagacaacctatagcatgagtttggggcccaagatattagatgttcgaatgctggaactagagtttgtagatatgaagaatgaggtaactttagaaatgtttaaagtgcaacatgtatatttttagatcggtaatttttcagagttgacagctatatttatgtaattctgcttttatttcgatccatgttttaagatactttgttattattctattacagttatatcaatgatatttataacaaaataattaaatatagaaaaaattttattccaattttaattgcaatttgctttatgccagactataaacaatactagtttaggcatgctatcttaaaccatatgtagtgctattttaaatgattctcggttatagacaataatgcatgttttgaggccactcaaaaaacaagtatgggactcatgatatttatcacaaaacaacttaaccaaggaaaattacattacactttgctcattgccaaactgtaaacatcacttgtttggacatgttatctcataaaatatgtggaaagatttcaaatgtttcatggttatggacattaatgtaagtttgaagcggttcaaagccctaaatgatgtaatgtttagaacggtaatttttacaaaaaggactcaaaaaggtttgtcatcaaagttttcgcaatacactaatttgggagtaaagggtcatgattttgtgcatgttttctcgaaaagattgtgggatgaaccatgcgaaaactttgaagcttttcgaagcactaaattatgtggtatatttatagaatgatccaacatgttgtttcacacgctccaccatcaactaaatataacacaatcaataacttcaatatgggacccacatatttagatggtcgcatgccgattaaagttcaatgttttaaagaatgaggtaactttaaaagtatttgaattgcaatatgcagatttttcaagataaacttttgcagagtgacgacctctattaacggaaaaatagttaatggaagaaagattatattttcactttcattactcttttttaatgccgtattgtaagacatacttgtttaggcatgctaccttaaaacatatatagtgttatttgcaatgttcctcagttgtgaacacatcaaaccaagttcaaggccgatcaaaacatgtatgagactaatgggtattaatttcgtgcaagtttactgcatgatatatcgattttgatcgtcaacttcgatgcgattttgatgccctaaatattgaattgtttagacagacagtttttacggatggaccaaacttattgtttcgcatgcaccatcattaacccatgttcaagacaaccataacatgagtatgcgaccctagattgtcgcctgctagcactagatttggtcatatgaatgataaggtgactctagaagcgcttgaagcataacatgtagatctttttcagatcatcaatttaaaataggcgtgagctatccaacatgttgttttacatgcttcatcatcaacccaagtgcaagacaacctatagcatgagtttggggcccaagatattagatgttcgaatgctggaactagagtttgtagatatgaagaatgaggtaactttagaaatgtttaaagtgcaacatgtatattttttagattggtaatttttccagagttgacagctatatttatgtaattctgcttttatttcgatccatgttttaagatactttgttattattctattacagttatatcaatgatatttataacaaaataattaaatatagaaaaaaatttattccaattttaattgcaatttgctttatgccagactataaacaatactagtttaggcatgctatcttaaaccatatgtagtgctattttaaatgattctcggttatagacaataatgcatgttttgaggccactcaaaaaacaagtatgggactcatgatatttatcacaaaacaacttaaccaaggaaaattacattacactttgctcattgccaaactgtaaacatcacttgtttggacatgttatctcataaaatatgtggaaagatttcaaatgtttcatggttatggacattaatgtaagtttgaagcggttcaaagctctaaatgatgtaatgtttagaacggtaatttttacaaaaaggactcaaaaaggtttgtcatcaaagttttcgcaatacactaatttgggagtaaagggtcatgattttgtgcatgttttctcgaaaagattgtgggatgaaaccatgcgaaaactttgaagcttttcgaagcactaaattatgtggtatatttatagaatgatccaacatgttgtttcacacgctccaccatcaactaaaatttaacacaatcaataacttgagtatgggacccacataattagatggtcgcatgacgattaaagttcaatgttttaaagaatgaggtaactttaaaagtatttgaattgcaatatgcagatttttcaagataaactattttgcagaattacgacatcttttaacggaaaaatagttaatggaagaaatattatatttgcactttcattactcttttctaaatgtcgtactgtaagacatacttatttaggcatgttaccgtaaaacatatatagtgctatttgcaatgttcctcagtcgtgaacacatcaacccaagtttaaggccgatcaaaacttgagtatgggactaatgtgtattaatttcgtgcaagtttactgcatgatatatcgatttttgatgtgcatcaactttcatgcattttaaagccctaatattgtattgtttagacagatagtttttatggatggacccaacttgttgttttcgcgtgcaccatcattaacccattttcaagacaaccataacatgagtattcgaccctagattgttgcatgctagcactagatttaatcatatgaaggacgaggggactctagaagcgcttgaagcataacaaatagattttttagatcatcaatttactataggcgtgagctatccaacatgttgtttcacatgcttcatcatcaagccaagtgcaagacaactttatagcatgagtttggggcccaagatattagaagttcaaatgcaggcactagagtttgtagatacgaagaacgaggtaacttagaaatgtttaaagtgcaacatgtatatttttttagatctataatttttctggagttgagagctatatttatgcaattgtgtttttattttgatccatgttttaaaatactttgttattgttctattacagttataacaatgatatttgtaacaaaagaatttaaatatagaaaaaatttgattccaattttaagtacaatttgctctatgccagactataaacaaaactagtttaggcatgttatgttaaaccatacgtagtgctattttaaatgattcttggttatggacaatattgcatgttttgaggccactcaaaaaacaagtatgggactcatgatatttatcataaaacaatttaaccaaggaaaattacattataatttgcctgttgccaaactgtaaacatcacttgtttggtg

SEQ ID NO: 801 - DNA, 5407 bp, Zea mays
tctttgccaaactgtaaacattactaatttgagcatgttattttataagatatgtggaaagatttcaaatgtttcatggttatggacattaatgtaagtttgaagacgttcaaagcccttaatgttgtaatgtttagaatgaaagtttttacaaaaaacgacccaataaggtttgtcatcaaagttttcgcaatacaatgatttgggagtaaagcgtcatgatttcgtgcatgttttctcgaaaagattgtggcatgaaccatgcgaaaactttgaagcttttcgaaaccctaaattatgtggtagatttatagaatgatccaaaatgttgtttcacacggtccaccagcatctaaaattcaacacaatcaaaacttgagtgtgggacccacataattagatggtcgcatgccgattaaagttcagtgttttgaagaatgaggtaactttaaaagtatttgaattgtaatttgcagatttttcaagataaacgattctgcagagttacgacctctattaaaggacaaatagttaatggaagaaaaattatattttcactttcattactcttttccaaatgtcgtactgtaagacatacttgtttaggaatgttaccttaaaaatagacaacctatcgcatgagtttagggcccaagatattggatgttcgaatgctagcactagagtttgtaggtatgaagaatgaggtaactttataaatgtttaaagtgcaacatgtatattatttagatcggtaattttctagaattgagagaaatatttatgcaattctgcttttagtttgatccatgttttaagattctttgttattattctattacatttatatcaatttataataaaaaaattaaatatagaaaaaatttcattccaattttaattacaatttgctctatgagagactataaacaatacttgtttaggcatgctatcttaaaccatatgtagtgctattttatatatttcttggttatggacaacaatgcatgttttgcggccactcaaaaaacaagtatgggactcatgatatttattacaaaacaatttaactaaggaaaattatattacaatttgctctttgccaaactataaacatcacttgtttgggcatgttatctcataagctatgtggaaagatttcaaatgtttcatggttatggacattaatgtaagtttgaagcggttcaaagccctaaatgatgtaatgtttagaatggtagtttttacaaaacgacccaacaaggtttctcatcaaagttttcacaatacactgatttgggagtgaagggtcatgatttcgtgcttgttttcttgaaaagattgtgtcatgaaccatgcgaaaactttgaagcttttcgaagccctaaattatgtggtagatttatagaatgatcaaccatgttgtttcacatgctccaccagcaactaaaatttaacacaatcaaaacatgagtatgggacccacataattagatggtcgcatgccgattgaagttcagtgttttaaagaatgaggtaactttaaaagtatttgaattgcaatatgcagattttttaagataaactattttgcagagttacgacatctattaatggaaaaatagttaatggaagaaaaaatatatttccactttcattactcttttccaaatgtcgtactgtaagacatacttgtttaggcatgttaccttaaaacatatataatgctatttgctatgttccttagttgtgaacacatctatccatgtgtatggcagatcaaaacatgagtatgggactaatgggtattaattttgtgcaagtttaatgcatgatatatcgatttctgatgtgcgtcaactttgatgcattttgatgccctaaatattgtattgtttagacagacaatttttacggatggacccaacttgttgtttcgcatgcaccataattaacccatgttcaagacaaccataacatgagtatgcgaccctagattgtcgcatgctagcactagatttggtcatatgaaggatgaggtcactctagaagcgcttgaagcataatatgtagattttttatcagatcatcaatttactatttgcgtgatctatccaacatgttgtttcacatgcttcatcatcaacccaattgcaagacaacctatagcacgagtttggggcccaagatattagatgtttgaatgctagcactagagtttgtagatatgaagaatgaggtaactttggaaatgtttaaagtgcaacatgtatattttttagatcgataattttccggagttgagagctatattgatgcaatcatgctttttatttcggtccatgttttaagatactttgttattattctattagagttatatcaatgatatttataacaaaagaattaaatatataaaaaatttcattccaattttaattacaatttgctttatgcgagactataaacaatactagtttaggcatgctatattaaaccatatgtagtgctattttaaatgattcttggttatggacaataatgcatgttttgagaccactcaaaaaacaagtatgggactcatgacatttatcacaaaacaatttaagcaaggaaaattacattacaatttgctcattgccaaactataaacatcacttgtttgggcatgttatctcataaaaaatgtggaaagatttcaaatgttttatggttatgaacattaatgtaagtttgaagccgttcaaagccctaaatgatgtaatgtttagaatggtagtttttacaaaaatgtcccaacaatatttgtcatcaaagtttttgcaatgcactgatttgggagtaaagggtcatgatttcgcgcatgtttcctcgaaaagattgtggcatgaaccatgcaaaaactttgaagcttttcgaagccctaaattatgtggtagatttacagaatgatccaacatgtttcatacactcctccatcacctaaaattcaacaatcaataacttgattatgggacccacataattagatggttgaatgccaattaaagttcaattttttaaaaaatgaggtaactttaaaagtatttgaattgcaatatgcagatttttcaagataaactattttgcagagttacgacctattaacagaaaaatagttaatgggcgaaagattatattttcactttcattattcttttctaaatgtagtactgtaagacatacttgtttaggcatgttacattaaaacatatatagtgttatttgcaatgttcctcagttgtgaacacatcaaaccaagtttaaggccgatcaaaacatgagtataggactaatgggtattaatttcgtgcaagtttactgcatgatatatcgatttctgatgtgcgtcaactttgatgcattttgatgccctaaatattgtattgtttagacagacagtttttatggatggacccaacttgttgtttcgcatgcaccatcattaacccatgttcaagacaaccataacatgagtatgcgaccctagattgtcacatgctagcactagatttggtcatatgaatgatgaggtgactctagaagcgcttgaagcataacatgtagatctttttcagatcatcaatctactatagtcgtgagctatccaacatgttgttttacatgcttcatcaacccaagtgcaagacaacctataacatgagtttggggccatagatattagatgttcgaaagctggcactagagtctgtagatatgaagaatgaggtaactttagaaatgtttaaagtgcaacatgtatattttttagattggtaattttccggagttgacagttatatttatgtaattctgcttttttatccatgttttaagatactttgttattattctattacagttatatcaatgatatttataacaaaagaattaaatatagaaaaaaattattccaatttgaattacaatttgctttatgccaaactataaacaatactagtttacgcacgctatcttaatccatatgtagtgctattttaaatgattcttggttatagacaataacatgttttgaggccactcaaaatacaagtatgggactcatgatatttatcacaagacaacttaaccaaggaaaattacattacaatttgctcattcccaaactgtaaacatcacttgtttggacatgttatctcataaaatgtggaaagatttcaaatgtttcatggttatgaacattaacgtaagtttgaagcggttcaaagccctaaatgatgtaatgtttagaacggtaatttttacaaaaaaggacccaaaaagttttgtcatcaaagttttcgcaatatactgatttgggagtaaagggtcatgatttcgtgcatgttttctcgaaatattgtggcatgaaccatgcgaaaactttgaagctttttgaagcactaaattatgtggtagatttaaagaatgatccaacatattgtttcacatgctccatcatcaactaaagtttaacacaattaataatttgagtatgggacccacataattagatggtcgcatgacgattaaagttcaatgttttaaagaatgaggtaactttaaaagtatttgaattgcaatattcagatttttgaagataaactattttgcagaattacgacctctattaacggaatagttaatggaagaaaaattatattttcactttcattactcttttaaatgccgtactgtaagacatacttatttaggcatgttaccttaaaacttatatagtgctatttgcaatgttcctcagttgtgaacacatcaacccaagtttaaggccgatcaaaacttgagtatggactaatgtgtattaattttgtgcaagtttactgcatgatatatcgatttctgatgtgcgtcaacttccttgcattttaaagccctaatattgtattgtttagacaaatagtttatacggatggacccaacttgttgtttcgtgtgcaccatcattaacccattttcaagacaaccattacatgagtatgcgaccctagattgtggcatgctagcactagatttaatcatatggaggacgaggggactctagaagcgcttgaagcataacatatagattttttcagatcatcaatttactgtaggcgtgagctatccaacatgttgtttcacctgcttcatcatcaacccaagtgcaagacaacctatatcatgagtttggggcccaagatattagatgttcgaatgcaggcactatagtttgtagatatgaagaataaggtaactttagaaatgtttaaagtgcaacatgttttttttagatctgtaattttcccgagttgagagctatatttatgcaattgtgcttttattttgatccatgttttaatatactttg

SEQ ID NO: 802 - DNA, 5243 bp, Zea mays
ctatatgcagtgatattttaaatgattcctggttatggataacaatgcatgttttgaggccactcaaaaaacaagtatgggactcatgctatttatcacaaaacaatttaaccaaggaaaattacattacaagtttctcattgccgaactgtaaatattacttgttttggcatgttatctcataagatacgtgaaaaattttcaaatgttacatggttactgacattaatgtaagtttgaatcggttcaaagccctaaatgatgcaatgtttagaatggtagtttttacaaaaaggacccaacaaggtttgtcatcaaagttttcgcaatacactgatttgtgagtacaaggggcatgaaccatacgaaaactctgaagcttttcgaagctctaaattatgtggtagatttacagaatgatacaatatgttgtttcacatgctgcatcaattaaaattcaacacaatcattaacttgagtatgggacccacataattagatggccgcatgccgattaaagttcagcgttttcaagaatgaggtaactttaaaagtatttgaattgcaatatgcagattttacaagataatctattttgtagagttacgacctctattaatggaagaaaatttatatttccactttcattactcttttataaatgttgtactataagacaaacttatttaggcatgttaccttaaaacacatattgtgctatttgcaacgttccttagttgtgaacacatcaacacaagtttaaggccaatcaaatcatgagtatgggactaatgggtattaatttcatataagtttattgtatgatatatcgattttttatgtgcgtcaacttcgatgcattttgaaaacctaaatgttgtattgtttagacagacacttttacggatggatccaacttattgtttcgcatgcaccatcattaacccatattcaagaaaaccataacatgagtatgcgaccctagattgcagcatgctagcactagatttggtcatatgaaggatgaggtgactctagaagcgcttgaagcataacatgtagattttttcagatcatcactttactatagacgtgagttatccaacattttgtttcacatgcttcatcagcaccccaagtgcaagacaacctatagcatgagtttggggcacatgatattggatattcgaatgctggcactagagtttgtagatatgaaaaatgaggtaactaaatgtttaaagtgcaacatgtatattttttagatcggtaattttccggagttgagagcgatgtttatgcaattctgcttttatttcgatctatgttttaagatactttgttattattctattacaattatatcaattatatttataacaaaagaattaaatatagaaaaaaattcattccaattttaattacaatttgctctatgccgaactataaacaatattagtttaggcatgctattttaaaccatatgtagtgttattttaaataattcttggttatgaacaaaaatgcatgttttgaggccacccaaaaaacaagtatgggactcatgatatttatcacaaaacaatttaaccaaagaaaattacattacaatttgctcattgccaaactgcaaacatcacttgtttaggcatgttatctcataacatatgtggaaagatatcaaatgtttcatggttatgaacattaatgtaagtttgaagcggttcaaagccctaaatgacgtaatgtttagaacggtagtttttacaaaaatgacccaacaagatttgtcatccatgttttcgcaatacactgatttgggagtaaagtgtcatgatttcgtgcatgtttttttcgaaaagattgtggcatgaaccatgcgaaaactttgaagcttttcgaagccctaaattatttggtagatttacagaatgatccaacatgttgtttgacacgctccaccaacaactaaaattcaacacaatcaataacttgagtataggacccacataattagcgggtcgcataccgattaaagttcagtgttttaaagaattaaaagtatttgaattgcaatatgcaaatttttcaagataaactattttgcagagttacaacctctattaatggaaaaatagttaatgaaagaaaagttatatttccactttcattactcttttctaaatgtcgtcttgtaagacatacatgtttaggcatgttaccttaaaaacatatatagtgctatttgcagttcctcagttgtgaacacatcaacccaagtttaaggcagatcaaaacatgagtaatggactaatgggtattatattagcacaagtttgctacatgatatatcgatttctgatgtgcgtcaacttcaaagcattttgaagccctaaatgttgtattgtttagacacacagtttttatagatagcccaacatgttgtttcgcatggaccatcgttaacccatgttcgagacaaccataacatgagtatgcgaccctagattgtcgcattctagcagtagatttggtcatataaaggatgaggtgactctaagagcgcttgaagaacaacatgtagatttttttcagatcatcaatttactataggcgtgaactatgcaacatgttgtttcacttgcttcatcatcaacctaagtgcaagacaacctatagcttgagtttggggcccatgatattgtatgtttgaatgctgccactatagtttgtagatatgaagaatgaggtaactttagaaatgtttaaagtgcaacatgtatattttttagatcggtaattttccggagttgagagctatatttatgcaattatgcttttatttcgatccatgttttaagattctttgatattattctattaaagttatatcaatgatatctataacaaaagaattaaatatagaaaaattctcattccaattttaattacaatttgctctatgctagactataaacaataatattttaggcatgctatcttaaactatatgtagtgctattttagatgattcttggttatggacaacaatgcatgtgttgaggccactaaaaaaattatgtgactcatgatatttttcacaaaacaatttaaccaaggaaaattacattacaatttgcttattgccaaaatgtaaacatcacttgtttgggcatgttatctcataaggtatgtggaaaacttttaaatgtttcatggttatggacattaatgtaagtttgaagcagttcaaagccctaaatgatgtaatgtttagaactgttgtttttacaaaaggacccaacatggtttgttatgaatgttttcgcaatacactgatttgtgagtaaagcgtcgtgattttttgcatgttttcaagaaaagattgtggcatgaaccatgcgaaaactttgaagcttttcaaagccctaaattatggggtagatttacagaatgatccaacatgtttcacacgctccaccatcaactaaaattcaacacaatcaataacttgagtatgggacccacaaatttgatggtcgcatgctgattaaagttcagtgttttaaagaatgaggtaactttagaagtatttgaatttcaatatgcatatttttcaagataaactattttgcagagttacgacctctattaatggaaaattagttaatagaagaaaatttatatttccactttcatttgtcttttctaaaagacatacttgtttaggcatgttaccttaaaacatatattgtgctatttgcaatgtttcttagttgtgaacacatcaacccaagtttaaggccgatcaaaacatgagtacgggactaatggatattatattcgtacaagtttactgcatgatatatcgatttccaatgtgcgtcaacttcgatgcattttgaagccctaaatgttgtattgtgtagacagacattttttatggatggacccaacgtgttgtttcgcatgcaccatcattgtcccatgttcaagacaaccatatcatgagtatgcgaccctacattgtcacatgctagcactagatttggtcatatgaaggatgaggtgactctaaaagcgcttgaagcacaacatgtagattttttcagatcatcaatttactataggcgtgagctatgcaacatgttgtttcacatgcttcatcatcaacccaactgcaacacaacctatagcatgagtttggggcccaagatattggatgatggaatgctggcactatagattgtagatatgaagaatgaggtaactttagaaatgtttaaagtgcaacatatataatttttagatcggtaatttttcggagttgagatctatatttatgcaattctgcttttatttcaatccatattttaagatcccttgttattattctattacagttatatcaatgatatttataacaaaagaattaaatatagaaaaaaaatttattccaattttagttacaatttgctctatgctagactataaataataatagtttaggcatgcaatcttaaaccatatgtagcgctatttttaatgattcttggttatggacaacaatacatgttttgaggccactcaaaaaaccagtatgggactcatgatatttatcacaaaacaatttaaccaaggaaaattacattacaattttctgattgccaaaccataaacatcacttgttggcatgttatctcataacatatgtgaaaatttttcaaaagtttcatggttatggacattaatgtaagttggaagtggttcaaagccctaaatgatgtaatgtttagaacggtagttgttacaaaaacgacccaacaaattttatcatcaaagttttcgcaatacactgatttgtcagtaaagggtcattatttcgtgcatgttttctcgaaaagattgtggcatgaaccatgtgaaaactttgaagcttttcgaagccctaaattatgtggtagatttacagaaaggttcaacttgttgtttcacatgctccaccatcaactaaaattcaacacaatcaataaattgagtatgggacccacataattagatggtcgcatgctgattaatgttcagtgttttgaagaatgaggtaactttaaaagtatttgaattgcaatatgcagatttttcaaggtaaactattttgcagagttacaacctctattaatgcaaaaatagttaatgaaagaaaatttatatttccactttcattactcttttctaaatgtcgt

SEQ ID NO: 803 - DNA, 5189 bp, Zea mays
aacgttataaaattaatgagtgaatgaggaagtgttgaacaaatgctgcaaaattaattagtgattactgtaaaattactatgtaaatactcaatctgggtgattgaaattactgaataaatggtgcaaaattactgagtggagactataaaattatttagtttctcaatgggtaaatgaaattactgtgtgattaaggaattaccgaaaaaataatgtcaaattactgagtgatttatgtaaaattatcaagtgattattgtaaatcaagtgagtaactagacaatcattgcatatatgttgttcttttctcaatgtgtaaagaaaattactggatgattgataaatatagtaaacgttataaaattaatgagtgattgagaaagtgttgaacaaatactgcaaaattactgcatatttattgtcttttcttagtgtgttaatgaaattactcggtgactgaggaagtgttgaacaaatgctgcaaaattaattagtgaatactgtaaaattactatgtaactactcaatctgggtgattgaaatttctgaataaatggtgcaaacttactgagtggagactgtaaattatttagtaacaagataatcactaaatatccgttgttattttctcaatgggtaaatgaaattaatgtgtgatcaaggaattatcgaacaaatgatgtcaaattcttgagtgatttatgtaaaattagcgagtgattactataaatcaactgagtaacaagacaatcattgcatatatgttgttcttttctcaacgtgtaaagaaaattactggatgattgataattatagtacaaacgttataaaattaatgagtgattgagaaagtgttgaacaaatactgcaaaattactgcatatttattgttcttttcttagtgtgttaatgaaattactgggtgactgaggaagtgttgaacaaatgctgcaaaattagtcagagattactgtaaaattactatgtaactactcaatctgagtgattgaaattactgaataaatggtgcaaaattattgtgtggagactgtaaaattatttagtaactagataatcactacatatctgttgttattttctcaatgggtaaatgaaattactgtgtgattaaggaattaccgaacaaatgctgtcaaattactgagtgatttatgtaaacttatcgagtgattactgtaaatcaactaagtaactagacaatcattgcatatatgttgttcttttctcaacatgtaaagaaaattactggatgattgataattatagtacaaacgttataaaattaatgagcgattgagaaagtgttgaacaaatactgcaaaattactgcatatttattgttcttttcttagtgtgttaatgaaattactgggtgactgagtaagtgttgaacaaatgcagcaaaattaaccagtgattactgtaaaattactatgtaactactcaatctaggtgattgaaattactgaataaatggtgcaaaattactgagtggagaatgtaaaattatttagtaactagataatcactacatatttgttgttattttctcaatgggtaaatgaaattactgtgtgattaagtaattaccgaacaaatgttgtcaaattactgagtgatttgtgtaacattatcgagtgattactgtaaatcaactgagtaactagacaatcattgcatatatgttgttctttctcaacgtgtaaagaaaattactggatgattgataattatagtacaaacgttataaaattaatgagtgattgagaaagtgttgaacaaatactgcaaaattactgcatatttattgttcttttcttagtgtgttaatgaaattgctgggtgagtgaagaagtgttgaacaaatgctgcaaaattaagcagtgattactgtaaaattaatatgtaactactcaatctgggtgattgaaattactgaataaatggtgcaaaattactaagtggagactgtaaaattatttagtaaccagataatcactacatatctgttgttattttctcaatggctaaatgaaattacagtgtgattaaggaattagagaacaaatgttgtcaaattactaagtgatttatgtaaaactatcaagtgattattgtaaatcaactgagtaactagacaatcattgcatatatgttgttcttttctcaacgtgtaaagaaaattactggatgattgataattatagtacaaacgttataaattaatgagtgattgagaaagtgttgaacaaatactgcaaaattgctgcatattaattgttctttttttattgtgttaatgaaattactgggtgactgaggaagtgttgaacaaatgctgcaaaattagtcagtgattactgtaaaattactatgtaactactcaatctgagtgattgaaattactgaataaatggtgcaaaattactgagtggagactgtaaaattatttagtaactagataatcactacatatctgttgttattttctcaatgggtaaatgaaattactgtgtgataaggaattaccgaacaaatgctgtcaaattactgagtgatttatgtaaacttattaagtgattactgtaaatcaactaagtaactagacaatcattgcatatatgttgttcttttctcaacatgtaaagaaaattactggatgattgataattatagtacaaacgttataaaattaatgagtgattgagaaagtgttgaacaaatactgcaaaattactgcatatttattgttcttttcttagtgtgttaatgaaattactgggtgactgaggaagtgttgaacaaatgctgcaaaattagtcagagattactgtaaaattactatgtaactactcaatctgagtgattgaaattactgaataaatggtgcaaaattattgtgtggagactgtaaaattatttagtaactagataatcactacatatctgttgttattttctcaatgggtaaatgaaattactgtgtgattaaggaattaccgaacaaatgctgtcaaattacttagtgatttatgtaaacttatcgagtgattactgtaaatcaactaagtaactagacaatcattgcatatatgttgttcttttctcaacatgtaaagaaaattactagatgattgataattatagtacaaacgttataaaattaatgagcgattgagaaagtgttgaacaaatactgcaaaattactacatgtttattgttcttttcttagtgtgttaatgaaattactgggtgactgagtaagtgctgaacaaatgctgcaaaattaaccagtaattactgtaaaattactatgtaactactcaatctaggtgattgaaattactgaataaatggtgcaaaattactgagtggagaatgtaaaattatttagtaactagataatcactacatatctgttgttgttttctcaatgggtaaatgaaattactgtgtgattaagtaattacggaacaaatgttgtcaaattactgagtgatttgtgtaacattatcgagtgattactgtaaatcaactgagtaactagacaatcattgcatatatgttgttctttctcaacgtgtaaagaaaattactggatgattgataattatagtacaaatactgcaaaattactgcatatttattgttcttttcttagtgtgttaatgaaattgctgggtgagtgaagaagtgttgaacaaatgctgcaaaattaagcagtgattactgtaaaattaatatgtaactactcaatctgggtgattgaaattactgaataaatggtgcaaaattactaagtggagactgtaaaattatttagtaaccagataatcactacatatctgttgttattttctcaatgggtaaatgaaattacagtgtgattaaggaattagtgaacaaatgttgtcaaattactaagtgatttatgtaaaactatcgagtgattactgtaaatcaactgagaaactagacaatcattgattatatgttgttcttttctcaacatgtaaagaaaattacttgatgattgataattatagtacaaacgttataaaaattaatgagtgattgagaaagtgttgaacaaatactgcaaaattactgcatatttattgttcttatcttagtgtgttaatgaaattattgggtgactgaggaagtgttgaacaaatgctgcaaaattaatcagtgattactgtaaaattactatgtaactactcaatatgggtgattgaaattactgaataaatggtacaaacttactgagtggagactgtaaattatttagtaacaagataatcactaaatatctgttgttattttctcaatgggtaaatgaaattactttgtgattaaggaattatcgaacaaatgatgtcaaattattgagtgatttaggtaaaattagcgagtgattactgtaaatcaactgagtaactagtcaatcattgcatatatgttgttcttttctcaacgtgcaaagaaaattacaggatgattgataattatagtacaaacgttataaaaattaatgagtgattgagaaagtgttgaacaaatactgcaaattactctatatttattgttcttttcttagtgtgttaatgaaattactgggtgactaaggaagtgttaaacaaatgctgcaaaattaatcagtgattactgtaaaattactatgtaactactcaatatgggtgattgaaattactgaataaatggtgcagaattactaagtggagactgtaaaattatttagtaactagataatcactacacatccgttgttattttctcaatgggtaaatgaaattattgtgtgattaaggaattaccaaacaaatgctgtcaaattactgagtgatttatgtaaaataatcgagtggttactataaattaactaagtaactagacaatcattgcatatatgtgttcttttctcaacgtgtaaagaaaattactggatgattgataattatagtacaaacgttataaaattaatgagtgattgcgaaagtgttgaacaaatactgcaaaattactgcatatttattgttcttttcttagtgtgttaattaaattactaggtgactcaggaagtgttgaacaaatgctgcaaattaatcagtgattactgtaaaattactatgtaactact

SEQ ID NO: 804 - DNA, 5074 bp, Zea mays
acgacatttagaaaagagtaatgaaagtggaaatataaattttctttcattaactatttttgcattaatagaggttgtaactctgcaaaatagtttaccttgaaaaatctgcatattgcaattcaaatacttttaaagttacctcattcttcaaaacactgaactttaatcggcatgcgaccatctaattatatgggtcccatactcaatttattgattgtgttgaattttagttgatggtggagcatgtgaaacaacatgttggaccattctgtaaatctaccacataatttagggcttcgaaaagcttcaaagttttcgcatggttcatgccacaatcttttcgagaaaacatgcacgaaataatgaccctttactgacaaatcagtgtattgcgaaaactttgatgacaaaatttgttgggtcgtttttgtaacaactaccgttctaaacattacatcatttagggctttgaaccacttccaacttacattaatgtccataaccatgaaacttttgaaaaattttcacatatgttatgagataacatgcccaaacaagtgatgtttatggtttggcaatgagaaaattgtaatgtaattttccttggtgaaattgttttgtgataaatatcatgagtcccatacttgttttttgagtggcctcaaaacatgtattgttgtccataaccaagaatcattaaaaatagcgctacatatggtttaagatagcatgcctaaactattattatttatagtctagcatagaacaaattgtaattaaaattggaataaatttttttctatatttaattattttgctataaatatcattgatataattgtaatagaataataacaagggatcttaaaatatggattgaaataaaagcataattgcataaatatagctctcaactccggaaaattaccgatctaaaaaatatatatgttgcactttaaacatttctaaagttacctcattcttcatatctacaaactatagtgccagcattccatcatccaatatcttgggcccaaactcatgctataggttgtgttgcagttgggttgatgatgaagcatgtgaaacaacatgttgcatagctcacgcctatagtaaattgatgatctgaaaaaaatctacatgttgtgcttcaagcgcttttagagtcacctcatccttcatatgaccaaatctagtgctagcatgtgacaatctagggtcgcatactcatgatatggttgtcttgaacatgggtcaatgatggtgcatgcgaaacaaccacgttgggtccatccgtaaaaaatgtatgtctaaacaatacaacatttagggcttcaaaatgcatcgaagttgacgcacatcagaaatcgatatatcatgcagtaaacttgaacggatataatatccatttgtcctgtaatcatgttttgatcagccttaaacttgggttgatgtgttcacaactgagaaacattgcaaatagcacaatatatgttttaaggtaacatgcctaaacaagtatgtcttttagaaaacacaaatgaaaatggaaatataaattttcttctattaactaattttccattaatagaggtcgtaactctgcaaaatagtttatcttgaaaaatctgcatattgcaattcaaatacttttaaagttacctcattctttaaaacactgaactttaatcagcatgcgaccatctaatttgtgggtcccgtactcaagttattgattgtgttgaattttagttgatggtggagcgtgtgaaacaacatgttggatcattctgtaaatctaccccataatttagggctttgaaaagcttcaaagttttcccatggttcatgccacaatcttttcttgaaaaaatgcacaaaatcacaatgctttactcacaaatcagtgtattgcgaaaacattcataacaaaccatgttgggtccttttgtaaaaacaacagttctaaacattacatcatttagggctttgaaccgcttcaaacttacattaatgtccataaccatgaaacatttaaaagttttccacataccttatgagataacatgcccaaacaattgatgtttacattttggcaataagcaaattgtaatgtaattttccttggttaaattgttttgtgaaaaatatcatgagtcacataattgttttttgagtggcctcaacacatgcattgttgtgcataaccaagaatcatttaaaatagcactacatatagtttaagatagcatgcctaaaatattattgtttatagtctagcatagagcaaattgtaattaaaattggaatgagaatttttctatatttaattcttttgttataaatatcattgatataactttaatagaataatatcaaagaatcttaaaacatggatcgaaataaaagcataattgcataaatatagctctcaactccggaaaattaccgatctaaaaaatatacatgttgcactttaaacatttctaaagttacctcattctttatatctacaaactatagtggcagcattcgaacatacaatatcatgggccccaaactcaagctataggttgtcttgcacttaggttgatgatgaagcatgtgaaacaacatgttgcatagctcacgcctatagtaaattgatgatctgaaaaaaatcaacatgttgttcttcaagcgctcttagagtcacctcatcctttatatgaccaaatctactgctagaatgcgacaatctagggtcgcatactcatgttatggttgtctcaaacatgagttaacgatggtccatgcgaaacaacacgttgggccatctataaaaattgtctgtctaaacaatacaacatttagggcttcaaaatgcttcgaagttgacgcacatcagaaatcgatatatcatgtagcaaacttgtgctaatataatacccattagtccattactcatgttttgatctgccttaaacttgggttgatgtgttcacaactgaggaacattgcaaatagcactatatatgtttttaaggtaacatgcctaaacaagtatgtcttacaggacgacatttagaaaacagtaatgaaagtggaaatataaattttctttcattaactatttttccattaatagaggttgtagctctgcaaaatagtttatcttgaaaaatctgcatattgcaattcaaatacttttaattctttaaaacactgaactttaatcggtatgcgacccgctagttatgtgggtcctatactcaagttattgattgtgttgaattttagttgttggtggatcattctgtaaatctaccaaataatttagggtcctatactcaagttattgattgtgttgaattttagttgttggtggatcattctgtaaatctaccatgaaacatttgatatctttccacatatgttatgagataacatgcctaaacaagtgatgtttgcagtttggcaatgagcaaattgtaatgtaattttctttggttaaattgttttgtgataaatatcatgagtcccatacttgttttttgggtggcctcaaaacatgcatttttgttcataaccaagaattatttaaaataacactacatatggtttaaaattgcatgcctaaactaatattgtttatagttcggcatagagcaaattgtaattaaaattggaatgaattttttttttatatttcattcttttgttataaatataattgtaatagaataataacaaagtatcttaaaacatagatcgaaataaaagcagaattttataaacatggctctcaactccggaaaattaccgatctaaaaaatatacatgctgcactttaaacatttctaaagttacctcatttttcatatctacaaactctagtgccagcattcgaatatccaatatcatgccccaaactcatgctataggttgtcttgcacttggggtgatgatgaagcatgtgaaacaaaatgttggataactcacgtctatagtaaagtgatgatctcaaaaaatctacatgttatgcttcaagcgcttctagagtcacctcatccttcatatgaccaaatctagtgctagcatgctgcaatctagggtcgcatactcatgttatggttttcttgaatatgggttaatgatggtgcatgcgaaacaataagttgggtccatccgtaaaactgtatgtctaaacaatataacatttaggttttcaaaatgcatcgaagttgacgcacataaaaaatcgatatatcatacaataaactaatatgaaattaatacccattagtcccatactcatgttttgattggccttaaacttgggttgatgtgttcacaactaaggaacgttgcaaatagcacaatatgtgttttaaggtaacatgcctaaataagtttgatgtgtacaacatttataaaagaataatgaaagtggaaatataaattttcttccattaatagaggtcgtaactctacaaaatagattatcttgtaaaatctgcatattgcaattcaaatactttaaaagttacctcattcttgaaaacacttaactttatcggcatgcgaccatctaattatgtgggtcccatgctcaagttaatgattgtgttgaattttagttgatgcagcgtgtgaaacaacatattgtatcattctgtaaatctaccacataatttagagcttcgaaaagcttcagagttttcgtatggttcatgccccttgtacacacaaatcagtgtattgcgaaaactttgatgacaaaccttgttgggtcctttttgtaaaaactactgttctaaacattacatcatttggagctttgaaccgattcaaacttacattaatgtcagtaaccatgtaacattgaaaatttttcacgtatcttatgagataacatgccaaaacaagtaatatttacagtttggcaatgagaaacttgtaatgtaattttccttggttaaattgttttatgataaatagcatgagtcccatacttgttttttgagtggtctcaaaacatgcattgttatccataaccaggaatcatttaaaatatcactacatatag

SEQ ID NO: 805 - DNA, 5012 bp, Zea mays
tatgcagtaattttgcagtatttgttcaacactttctcaatcactcattaatttcataacgtttgtactataattatcaatcatccagtaattttctttacacgttgagaaaagaacaacatatatgcaatgattgtctagttactcatataatttacattaatcactcgataattttacataaatcactcagtaatttgacagcatttgttcggtaattccttaatcacacagtaatttcatttacccattaagaaaataacaacagatatgtaatgattatctagttattagataattttacagtcttcactcagtaattttgcaccatttgttcagtaatttcaatcacccagattgagtagttacatagtaattttacaataataactgattatttttgcagcatttgttcaacacttcctcagtcacccagtaattttattaacacactaataaaataacaataaatatgcagtaattttgcagtatttgttcaacactttctcaatcactcattaattttataacgtttgtactataactatcaatcatccagtaattttctttacacgttgagaaaagaacaacatatatgtaatgattgtctagttactcagttaatttatagtaatcactcgatagttttacataaatcactcagtaatttgacagcatttgttcggtaattccttaatcacacaataagttcattcagtaatttgacagcatttgtcggtaattccttaatcacacagtaatttcattcagtaatttgacagcatttgttcgctaattcctttcacacgtaatttcatttactcgttgagaaataacaacagatatgtagtgattatctagttactaaataattttacaatcttcactcagtaatttcaatcatccagattaagtagttagatagtaattttacagtaatcactgattaattttgcagcatttgttcaacacttcctcagtcacctagtaatttcattaacacactaataaaataacaataaatatgcagtaattttgcagtatttgttcaacactttctcaatcactcattaattttataacgtttgtactataattatcaataatccagtaattttctttacacgtttagaaaagaacaacatatatgcaatgattgtctagttactcagttaatttagagtaatcactagataatttacataaatcactcagtaatttgatagcatttgttcggtaattccttaatcacacagtaatttcatttacccattgagaaaataagaacaaatatgtaatgattatctagttactagataattttacagtcttgactcagtaattttgcaccatttgttcagtaatttcaatcacccagattgagtagttacatagtaattttacaataataactgattaattttgcagcatttgatcaacacttcctcagtcacccagtaattttattaacacactaataaataacaataaatatgcagtaattttgcagtatttgttcaacactttctcaatcactcattaattttataacgtttgtactataactatcaatcatccagtaattttctttacacgttgagaaaagaacaacatatatgtaatgattgtctagttactcagttaatttatagtaatcactcgatagttttacataaatcactcagtaatttgacagcatttgttcggtaattccttaatcacacaataatttcattcagtaatttgacagcatttgtcggtaattccttaatcacacagtaatttcattcagtaatttgacagcatttgttcggaaattccttaatcacacagtaatttcatttacccgtcgagaaaataacaacagatatgtagcgattatctagttactagataattttacagtcttcactcagtaattttgcaccatttgatcggtaatttcaatcacccaaattgagtagttacgtagtaattttactgtaatcactgattaattttgcagcatttgttcaacacttcctcagtcacctagtaatttcattaacacactaataaaataacaataagtatgcagtaattttacagtattggttcaacactttctcaatcactcattaattttataacgtttgtactataattatcaatcatccagtaattttctttacacgtttagaaaagaacaacatatatgcaatgattgtctagttactcagttaatttagagtaatcactcgataattttacataaatcactcagtaatttgacagcatttgttcggtaattccttaatcacacagtaatttcatttatccatgaaaataacaacagttatgtaatgattatctagttactagataattttacagtcttcactcagtaattttgtaccatttgttcagtaatttcaatcacccagattgagtagttacatagtaattttacaataatgactgattaatttgcagcatttgttcaacacttcctcagtcaccgagtaatttcattaacacactaataaaaaaataataaatatgcagtaattttgcagaatttgttcaacactttctcaatcactcattaattttataacgtttgtactataactatcaatcatccggtaattttctttacacgttgagaaaagaacaacatatatgcaatgattgtctagttactcagttaatttatagtaatcactcaataattttacataaatcactcattaatttgacagcatttgctcggtaattccttaatcacacagtaatttcatttacccatttagaaaataacaacatatatgtagtgattatctagttactagataagtttacagtcttcactcagtaattttgcaccatttgttcggtaatttcaatcacccagattgagtagttacatagtaattttacagtaatcactaattaattttgcagcatttgttcaacacttccttagtcacctagtaatttcattaacacactaataaaataacaataaatatgcagtaattttatagtatttgttcaacactttctcaatcactcattaattttataacgtttgtactataattatcaatcatccagtaattttctttacacgtttagaaaagaacaacatatatgcaatgattgtctagttactcagttaatttagagtaatcactcgataattttacataaatcactcagtaatttgacagcatttgttcggtaattccttaatcacacagtaatttcatttatccatgaaaataacaacagttatgtaatgattatctagttactagataattttacagtcttcactcagtaattttgtaccatttgttcagtaatttcaatcacccagattgagtagttacatagtaattttacaataatgactgattaattttgcagcatttgttcaacacttcctcagtcaccgagtaatttcattaacacactaataaaataataataaatatgcagtaattttgcagaatttgttcaacactttctcaatcactcattaattttataacgtttgtactataactatcaatcatccggtaattttctttacacgttgagaaaagaacaacatatatgcaatgattgtctagttactcagttaatttatagtaatcactcaataattttacataaatcactcattaatttgacagcatttgctcggtaattccttaatcacacagtaatttcatttacccatttagaaaataacaacatatatgtagtgattatctagttactagataagtttacagtcttcactcagtaattttgcaccatttgttcggtaatttcaatcacccagattgagtagttacatagtaattttacagtaatcactgattaattttgcagcatttgttcaacacttccttagtcacctagtaatttcattaacacactaataaaataacaataaatatgcagtaattttatagtatttgttcaacactttctcaatcactcattaattttataacgtttgtactataattatcaatcatccagtaattttctttacacgtttagaaaagaacaacatatatgcaatgattgtctagttactcagttaatttagagtaatcactcgataattttacataaacagtaatttgacagcatttgttcggtaattccttaatcacacagtaatttcatttacccatttaaaataacaacagttatgtaatgattatctagttactagataattttacagtcttcactcagtaattttgcaccatttgttcagtaatttcaatcaccagattgagtagttacatagtaattttacaataatgactgattaattttgcagcatttgttcaacacttcctcagtcacccagtaatttcattaacacactaataaaataataataaatatgcagtaattttgcagtattgttcaacactttctcaatcactcattaattttataacgtttgtactataactatcaatcatccggtaattttctttacacgttgagaaaagaacaacatatatgcaatgattgtctagttactcagttaatttatagtaatcattcaataattttacataaatcactcagtaatttgacagcatttgctcggtaattccttaatcacacagtaatttcatttacccatttagaaaataacaacatatatgtagtgattatctagttactagataagtttacagtcttcactcagtaattttgcaccatttgttcggtaatttcaatcacccagattaagtagttacatagtaattttacagtaatcactgattaattttgcagcatttgttcaacacttcctcagtcacctagtaatttcattaacacactaataaaataacaataaaatatgcagtaattttgcagtatttgttcaacactttctcaatcactcattaattttataacgtttgtatataattatcaatcatccagtaattttctttacacatttagaaaagaacaacatatatgcaatg

SEQ ID NO: 806 - DNA, 4975 bp, Zea mays
gttaggtgcagtttagcttaactgatccaaatgaggcccaactatatgaactttgtgacatatagttagcaggttactggggtcttattgggtgagaaacatcttaggctggtcaattttttacgtgtgtaaaacctcaatcatgtcacatccactcgtaagaagactcggttgtattcctgttaatagaaatggttgtttcctctctaaaaatatgttgactaacttggtctccatagataagtttagtgacctcgtgggcaatttactctagcaggccccaaaagtcaaacaacaagttacctacttatccataagaatgtagcaatcaataagatgcatgtttgtcaaactgacaactaatacccaattgcagcaagaccgcgtgacagttcctaacccacgagaccaaatttccagtagaaaagcatgcataagattttgttgacacaaagttgatatagttaggcctcatttggatcagctaaactcgactacagctaactcttgcgttttagtcttttgttgatcttcatttttattagtttcaagatcttcatgcttaacaaaagagaacaaatttcccagcgcatcctcaagaaatagcatattatctttggcatttatcgccactacatatcatctaacaatttcaacacctttatttgtgctcccacttgcagctcctcaacattatgcaaaagcttctgagctgcttcagtagcccactttacctgtaagttcttcctcttaatggtccaaccgtaacattcttccattgtcttaagctgtttccacacataattctttttcgtttgttatgctgaaatttcattatgcttctctcatcttaggatctagtaagctttctttagtttttaatctcttccctaatctcttctccaattttttgggatccgaattgtcaatactaatatatgaagtaaagtttagtcccaacaattcggatcaccaaaaaagtgaggaagatattaggtaagagataagaaaactaaagtaagcttcaaagatcatgagattagaggacagtgaaaaaagaattttgtgtggaaccagcttaaggcaatggaagatgattacactgggaccattaaggggaagaaaatagaggtaaagcaggctactgaagccgctaaaaagtttttgcataatgttgatgagttgcaattgggtgccaaatgaaggatgatgaaattgttagactacaaatagtggcgacaaatgccaaaaagaggatgttgtttcttgaggatgagctgcaaaaattgttgtctttggtcaaggataaagatcttgaaactttataaaaataaaatcaaccagagactaaaatgcaagatttagttgctgtctagattaactaatccaaacgaggcctaactatatgaataggtggttagcaggttactaggttcttattgggtgagaaacttttgatgccggtggattttgctatgtgagtaaaccctgaatcatgtcacatccactcttctcaagactaaacacaagagttaggtgcagattagtttaactgtggcctatataaaataatgtgtactaacttgttctctatagaaaattttttagtgatctcgtggaccaaaagttagacgaaaagttacctacttctccacaagaaagttgcaattaataacatgcatgttggtcaaactgaccactcagacccaattgcagcaagatttggcacacggacgaactgcaaacataaatgaacagtcaggactcacaaaatcaataggcttgtgctattgctctctctctctcactcaccgagaagacatgtacacaactctctatcttgtgagtattaggagcatcgtcttgctagctttctcctaccagagcaccacactttctcatagcactagatggcacatcattgatggatccctacatacaacgctagcacccattaaataaatagaagtagacgacgacatgcctagaaactacacctctcgtctcgtctgggccacatgatgcacgcgtcttaccatgagaagtggtcactactgcaggccaaccgtacatgtctctcaaacataggctgcactagagcgcgttcttcaactagtggacgcaagactcgcactaaatggaggcatggtctgcatgcacaaggcgctagcccgcacgcctcctccattgctccatgatatggggcgcgtcctttggctctgcaatccacctgaaccgctccactttttcatgtactcatcgttaaactccagcaggtttcatataaactcatgcatagtactagtatatggcatggcactccggtcgaaatccaggactgatggtctgatgtgctgcacgcatgttaggtaggcttcacacatcagtcgtgcttgcttgttcgtggagctagcttgctagcctttccctttctggtgttcttgcacctagctacagcagatcacgagagctttcaagcccgttgtatgtgctagaggccagaggctcttcgtagctccatctgaaaaaggctgcagcaggaaatgacttttgatcgagccgctactgctggtgcttcatctcttaggctctctattgatccatatcaatgtttggcactagtacggcgcggtcgtcagcaccacacacaacacagttcgatcctagtgtaatgtaacacccctggtgtttatattctgctcgacaacgagtatgaatttaagcacgtaatatcagtggataaaacggatgccaaattttaattattttcgtttatcgcgattttaatatcgcatctgtttcgtttgtcgcgagtgagatatcgtttttatttttatctatccgggctcttcctaaatttttgtgatgttcggaacatagtcatttcgaaaatcggagcgtcccatggttatttaaaattcatcgctcgcgcgaatacgaattcggaagcccgccccactttgatgattttattccgagcaaattagtttgaactggacaactaaaatgttcggggtaaaataattcgaatcgcgtgaaatcttgcacgaggttatgacccaatttttcctccagcacgttgttttggcgagcgtaagagtaataattgggcctcttttttctagtgtgttgtcttcggcagagtaatcgagtgcttgattagtggatgagattattaggttagacgagttaagccccgactaaatactgacgccaaaatctgtctaattcggtctatttgcatcctgtccgaagcaaaccaaaccactataattagtactgacagcaagtaattggtaaatgatttagtttgctaaaacattagaatgagatatgtagcccgtatcatcgaccctttaatcatcgctaaaaaaattacgtgttcatctcccttcattccttatcttgagtccgtgcttttctccggaaatatcccacagccctctattcctatgatctaattatctttatgtattcatttaagaaaatgggggataatccccttttcttctcaaccccacgtcatcccctcccaaggcttttagccttaccttctgttgatattatcttcagccggtacaagttcacaggtcacgtacatctcctagacgctagaaactttcctacgacatcctcttccttatccgcgtgcatgtttcctgctcatctccctatcatgtccaggctgtaggagcccccagcaagccacgtgctcccctcgcctaggtgcctggccgcgtgcccttcccatcgttctcctagccgccgctgggtatctccctcacacgctgatcttatcctcagctgtactcgacctccctaccgccgttcgtcgagcccctgttccgagctcgccgggcctcaccactacctcgccgtcacgctactggccagcaacactcgatcctggccgccatcgccgcactgcgcgtcgtgcacttgggctggccacctctgcgtgtggcctcgccggacaacaccgtcgtctgcaagctcaaaactgacatcgatccagtcgtcgtagctccgctgtcatggccgatctcggtttcatccgtgacaccgactgtcgacctcgtcgttgcctcacagcactcggacaccgctgtcgtcactcagccccgtgttcactcgtcaccacgccatcttcagcatcacagttctgcaggactccacgcactcgtcgacacccggctgccaatctccaccacgcagcgccactccggaccttcggccgtgttctcctctgctccaactcacgtccatgcccagaacgagctcgcgcacgtcgtcggagtcgctcaactcacccatcgcgcctaggccggtcgccattctgttcttcataagtcgtgctttggacgtcgtcgttgtttcttgttctcgcctcgacagaaccacgtccatgactcagccgttccaataatttcaccgcgccgcccttcaagttcgttgtcctcatccgcagaatcgtcgttgacctcgcggattcgggtcgagtttagttatggtgagttgattcgttattcccgtcaactagatagatggttcgattaaatagatgtatcgattgcgatgattctcttgtctattacttgatgcggaggttaaagttgaattttaggtttatgtgataagtatattggtaaatatatatgtggtgtgatgattgtctacttgatagattaagtatagtgtgatgttttattagtttggatattataaaggttaattcaaaagagtggtttaaatagttagttaagttgcttctgtccatagttctagtttggtgtcccaaaaatgagcctaagtctcgttcactttttggtgtgttctatagctaaggttgataaatacttgtgcttagtttattatcgcttgctgcttgaattggattcggttaagttaaaataacgtggacgttgtacttagtaatatcttgacatctagtttttttttcttttaagtgttatta

SEQ ID NO: 807 - DNA, 4964 bp, Zea mays
caatcacccagattaagtagttacatagtaattttacagtaatcactgattaattttgcagtattcgttcaacacttccttagtcagccagtaatttcattaacacgctaataaaataacaataagtaagtagtaattttgcagtatttgttcaacactttctcaatcactcattaatttttcaacgtttgtactataattatcaatcatccagtaattttgtttacacgttgagaaaagaacaacatatatgcaatgattgactagttactcatttaatttacagtaatcactcgataactttacataaatcacttagtaaattgacagcatttgttcggtaattctttaatcacatagtaatttgatttacccattgagaaaataacaacagatatgtagtgattatctagttactaaataattttacagtcttcactcagtaattttgcaccatttaagcagtaatttgaatcaccaagattgagtagttacatagtaattttacagtaatcactagttaattttgcaacatttgttcaacacttcctcagtcacccagtaattccattaacacactaataaaataacaataaatatgcagtaattttgcagtatttgttcaacactttctcaatcactcattaattttataacgtttgtactacaattatcaatcatctagtaattttctttacacgttgagaaaagaacaacatatatgcaatgattgtctagttactcatttaatttacagtaatcactcgataactttacataaatcactcagtaatttgacagcatttgttcggtaattccttaatcacacggtaatttgatttaccaattgagaaaataacaacagatatgtagtgattatctagttactagataattttatagtctccactcagtaattttgcaccatttaagcagtaatttcaatcacccagattgagcagttacatagtaattttacagaaatcactgtttaattttgcagcatttgttcaacacttcctcagtcaccaagtaatttcattaacacactaataaaataacaataaatatgcagtaattttgcagtatttgttcaacactttctcgatcactcattaattttataacgtttgtactacaattatcaatgatccattaattttctttacacgttgagaaaagaacaacatatatgcaatgattgtctagttactcatttaatttatgggatcctttttatttaagatcctcttttctccatctcatttctacttctactgcttattgggatgtatcagatcaggaatatcgtatttatctcttctaatctagatcccacttccctccacttcttgcctcacgcccgtcaaacctgactccacattaacgactgtccttccacccaattccccgcacccttgcaacctgatatctatctttcaatcttattacctgcctgaaagtcttatagcaagcaacttatcttattactgtctttcctaatactctaggtaatagcaactcagattcgcttcctctatttcttctatctcttaatctgtataagagagaaccccttggtaaaagtatagaaactgcatatcagcttacgactagaattcttgttcggtaattccttaatcacacggtaatttgatttacccattgagaaaataacaacagatatgtagtgattatctagttactagataatgttacattcttcactcagtaattttgcaccatttaaacagtaatttcaatcacccagattgagtagttacatagtaattttacagtaatcactgattaactttgcagcatttgttcaacacttcctcagtcaccaagtaatttcattaacacactaagaaaagaacaataaatatgcagtaattttgcagtatttgttcaacactttctcaatcactcattaattttataacgtttgtactataattatcaatcatctagtaattttctttacacgttgagaaaagaacaacatatatgcaatgattgtcttgttactcatttaattttcagtaatcactcgataactttagataaatcactcagtaatttgacagcatttgttcggtaattccttaatcacacaataatttgacagtcttctcttagtaattttgcaccatttaagcagtaatttcaataaccctgattgagtagttacatagtatttttacagtaatcactgattaattttgcagcatttgttcaacacttcctcagtcacctagtaatttcatttacaaactaataaaataacaataaatatgcagtaattttgcaatatttgttcaacactttctcaatcactcatcaattatataatgtttgtactataactgtcaatcgtccagtaattttctttacacgttgagaaaagaacaacatatatgcaatggttgtcttgttacttagttaatttacagtaatcactcgataattttacataaatcacttagtaatttgacatcatttgttcggtaattccttaatcacacagtaatttgatttacccattgagaaaataacaacatatatgtagtgattacctagttactggataattttacagtcttcactcagtaattttgtaccatttgttcagtaatttcaatcacccagattgaatagttacatagtaattttaaactaattacttattaattttgcagtatttgttcaacacttcctcagtcacccagtaatttcattaacacactaataaaataacaataaatatgaagtgattttgcagtatttgttcaacacgttctcagtcactcattaattttataacgtttgtaatataattatcaatcatccagtaattttctttacacgttgagaaagaacaacatatatgcaatgattgtctagttactcagttaatttacagtaatcactcgataactttacataaatcactcagtaagttgacatcatttgttcggtaatttcttaatcacacagtaatttgatttacccattgagaaaataacaacagatatgtagtgattctagttactaaataattttacagtctgcactcagtaattttgcaccatttaagtagaatttcaatcgcccagattgggtagttacataataattttacagtaatcattgattaattttgcagcatttgttcaacacttcctagtcaccgagtaatttcattaacacactaataaaataacaataaatatgcagtaattttgcagtatttggtcatccctttctcaatcactcattaattttataacgtttgtactataattatcaatcatccagtaattttctttacacgttgagaaaagaacaacgtatatgcaatgattgtctagttactcatttaatttacagtgatcactcgataactttacataaatcactaagtaatttgacaacattagttcggtaattccttaatcacacggtaatttgatttacccattgagaaaataacaacatatatgtagtgattatctagttactaaataattttacagtcttcactcagtaattttgcaccatttaagcagcaatttcaatcacccagattgagtagttacatagtaattttacagtaatcactgattaattttgcagcatttgttcaacacttccttagtcacacagtaatttcattaacacgctaataaaatatcaataaatatgcagtaattttgcagtatttgtgcatcgctttctcaatcactcattaattttataacgtttataatatagttatgaatcatccactaattttctttatacgttgataaaaagaacaacatatatgcaatgattgtctagttactcagttaatttacattaatcacttgataactttacataaatcactcagtaatttgacagcatttgttcggtaattccttaatcacacagtaatttcatttacccattgagaaaataacaacagatatgtagtgattatctagttactaaatagttttacagtcttcactcagtaattttgcaccatttaagcagtaattttaatcacccagattgagtagttacatagtaattttatagtaatctctgattaattttgcagcatttgttcaacacttactcagtcacccagtaatttcaataacaccctaataaaataacaataaatatgcagtaattttgcagtatttgttcatcactttctcaatcactcattaattttataagtttgtactataattatcaatcatccagtaattttctttacacgttgagaaaagaacaacatatatgcaatgattgtctagttactcatttaatttacagtaagcactcgataactttacataaatcactcagtaatttgacagcatttgttcggtaattccttaatcacacggtaatttgatttacccatagagaaaataacaacagatatgtagtgattatctagttactaaataattttatagtcttcactcagtaattttgcaccatttaagcagtaatttcaatcacccagattgagtagttacatagtaattttacagtaatcactgattaattttgcagcatttgttcaacacttcctcagtcacctagtaatttcattaacacactaacaaaataacaataaatatgcaataattttgcagtatttgttcaatactttctcaatcacgcattaagtttataacgtttgtactataattatcaatcatctagtaattttctttaaacgtcgagaaaagaacaaaatatatgcaatgattgtctagttactcatttaatttacaataatcactcgataactttacataaatcactcagtaatttgacagcatttgttcggtaattccttaatcaaacagtaatttgatttacccattgagaaaataacaacaaatatgtagtgattatctagttactaaataattttacagtcttcactcttt

SEQ ID NO: 808 - DNA, 4818 bp, Zea mays
tatatttatgcaatttttcttttatttcgatccatgttttaagatactttgttattattctattacaattatatcaatgatatttataacaaaagaattaaatatagaaaaaatttcatcccaattttaattacaatttgatatttttggcatgctgttttaaaccatatgtagtgctattttaaatgattcttggttatgaacaacagtgcatgttttgaggccactcaaaaaacaagtatgggactcatgatatttatcacaatacaatttaaccaaggaaaattacgttacaattttctcattgccaaactgtaaacatgacttgtttaggcatgttatctcataagatatgtggaaagatttaaaagtttcatggttatggacattaatgtaagttcaaagcgcttaaaagccctaaatgacataatgtttagaacggtagtttttccaaaaatgacccaacaagatttatcatcaatgttttcgcaatacactgattgggagtaaagtgtcatgatttcgtgcatgtttttttgaaaagattgtggcatgaacccagctaaaactttgaagcttttcgaagccctaaattatttggtggatttacagaatgatccaacatgttgtttcacacgctccaccaacaactaaaattcaacacactcaataacttgagtatgggacccacataattaaatggccgcatgcccattaaagtttagtgttttaaagaatgagataactttacaagtatttgaattgcaatatgcatatttttcatgataaactatttttcagagttacgacctctattaatgaataaaatagttaatggaagtaaatttatatttccactttcattactcttttctaaatgtcgtactataagacatacttgtttaggcatgttaccttaaaaacatatatagtgctatttgcaaagttcctcaattgtgaacacatcaacccatgtgtatgggactaatgggtattatatttgtacaagtttgcagcatgatatatcgatttctgatgtgcgtcaacttcgaagcattttgaagccctaaatgttgtattgtttagacagatagtttttacagatggacccaacatgttgtttcgcatgcaccatcattaacccatattcaagacaaccataacatgagtatgtgaccctagattgtcgcatgctagcagtagatttggtcatataaaggatgaggttaatctaaaagcgcttgaagcacaacatgtagattttttcaaatcatcaatttactataggcgtgagctatgcaacatgttgtttcacatgcttcatcatcaacctaagtgcaagacaacctatagcatgagtttggggcccaagatattggatgttcgagtgcaacatgtatatttctagagttgagagctatatttatgcatttctgcttttatttcgatccacgttttaagattctttgttattattctgttatagttatatcaatgatatttataacgaaagaattaaatatagaaaaaattcattccagttttaattataatttgctctatgctagactataaacaacaatagtttaggcatgctatcttaaaccatatgtagtgctattttaaatgattcttggttatggacaacaatgcatgttttgaggccactcaaaaaacaattatgtgactcatgatatttatcacaaacaatttaaccaaggaaaattacattacaatttgctcattgccaaatcgtaaacctcacttgtttgggcatgttatctcacaagatatgtggaaaatttaaatgtttcatggttatggacattaatgtaagttcgaagcggttcaaagccctaaatgatgtaatgtttagaatgatagttttcacgaaaaggacccaacaaggtttgtcatgaaagttttcgcaatacactgatttctaagtaaagggtcatgatttcgtgcatgttttctcgaaaagattgtggcatgaaccatgtgaaaactttaaagcttttcaaagccctaaattatgttgtagatttacagaatgatccaacatgttgtttcacactctccaccatcaactaaaattcaacacaatcaataacttgagtatgggacccacataattaggtggtcgcatgtcgattaaagttcaatgttttaaagaatgaggtaactttaaaagtatttgaattgcaatatgcagatttttcaagataaactattttgcagagttacgacctctattaatggaaaaatagttaatggaagaaaatttatatttccactttcattactcttttcaaaaagacatacttgtttaggcgtgttaccttgtaacatatattgtgctatttgcaacgttcctcagttgtgaacacttcaacccaagtttaaggccgatcaaaacatgagtatggactaatgggtattatattcatacagtttgctgcacgatatatcgatttctgatgtgtgtcaacttcgatgcattttgaagcccaaaatgttgtattgtttagacagacagtttttacggatggacccaacgtgttgtttcacatacaccatcattaacccatgttcaagacaaccataacatgagtatgcgaccctagattgtcgcatgttagcactagatttggtcatatgaaggatgaggtgtctctaaaagcgattgaagcacatgtagattttttcagatcatcaatttactataggcatgagctatgcaacatgttgtttcaattgcttcatcatcaacccaagagcaagacaacctatagcatgagtttggggcccaagatattggatgttcgaatgctggcactatagtttgtagatatgaaaatgaggtaactttagaaatgtttaaagtgcaacatgtatattttttagatcggtaatttccagagttgagagctatatttatgcaattctcttttatttcgatccatgttttaagattctttgttattattatattacagttatatcaatgatattaataacaaagaattaaatatagaaaaaaaatcattccaatttgaatttcaatttgctatttgccagactataaacaataatgctttaggcatgctatctttaacttcatctagtgctattttaaatgattcttggttataattaacaatgcatgttttaggccactcataaaaagtatgggactcatgatatttgtcacaaaacaatttaaccaaggaaaattacattacaatttgctcattgccaaaatgtaaacatcacttgttttggcatgttatctcgtaagataagtggaaaattttcaaatgtttcatggttatggacattaatgtaagtcgaaatcggttcaaagccctaaatgatgtaatctttagaatggtagtttttacaaaaaggacccaacaaggtttgtcatcaaacttttcgcaatacactgatttgtgagtaaaagagtcatgattttgtgcatgttttctcgaaaagattgtggcatgaaccatatgaaaactctaaatcttttcgaagccttaaattatgtggtagatttacagaatgatccaacatgttgtttcacacgctccaccatcaactaaaattcaacacaatcaataatttgagtatgggacccacataattagatggtcgcatgccgattaaagtttagtgttttcaagagtgaggtaactttaaaagtatttgaattgcaatatgcagatttttcaagataaactattttgcagagttacgacctctattaatggaaaaatagttaatggaagaaaatttatttccactttcattactcttttctaaatgtcatagtgtaagacatatttgtttaggcatgttacctaaaacatacattgtgctatttgcaacgttcctcagttgtgaacaatcaacccaattttaaggccgatcaaaacatgagtatgggactaatgggtattatattcatacaagtttgttgcatgatatatcgatctgatgtgcgtcaacttcgatgcattttgaagccctaaatgttgtattgtttagacagacagtttttatggatggacccaacgtgttgtttcgcatgcaccatcattaacccatgttcaagacaaccataacataagtatgagaccctagattgtcgcatgctagcaccagatttggtcatatgaaggatgaggtgactctaaaagcgcttgaagcacaacttgtagattttttcagatcatcaatttactataggcgtgagctatgcaacatgttgtttaacatgcttcatcatcaacccaagtgcaagacaactacagcatgagtttggggcccaaattattgatgttcgaatgctggcactatagtttgtagatatgaagaatgagataaatttagaaatgtttaaagtgcaacatgtatatttttagatcgtaattttccagagttgtgagctatatttatgcaattcttcttttatttcgatccatgttttaagattctttgttattattatattacaattatatcaatgatatttataacaaaagaattaatatagaaaaaatttcattccaattttaattacaatttgctctatatcagactaaacaataatagtttagcatgctatcttcaactatatgtaacaccctaaagttcaatcccgtgaaaatgagaaaaattctccaaaggtttttaaatcaaaacacctttccttgagaatattcataatttcaaagttactactcccaaaattaatataatttttttgactaaaataaaagatacctagataaataaattgttcttggagtg

SEQ ID NO: 809 - DNA, 4743 bp, Zea mays
gtccatccgtaaaaactgtctgtctaaacaattcaatatttagggcatcaaaatgcatcgaagttgacgcacatcagaaatcgatatatcatgcattaaacttgcacgaaattaatacccattagtcccatactcatgttttgattggccttaaacttggtttgatgtgttcacaactgaggaacattgcaaataacactatatatgttttaaggtaatatgcctaaacaagtatgtcttacagtacaacatttagaaaagagtaatgaaagtgaaaaaatataatctttgatgacaaatcttgttgggaaatttttgtaaaaacattctttctaaacattacatcatttagggctttgaatggcttcaaacttacattaatgtccataaccataaaacatttgaaatctttccacatatcttatgagataacatgcccaaacaagtgatgtttatagtttggcaatgagcaaattgtaatgtaattttccttgcttaaattgttttgtgataaatgtcatgagtcctatacttgtttcttgagtggtctcaaaacatgcattgttgtccataaccaagaatcatttaaaatagcactacatatggtttaatatagcatgcctaaactagtattgtttatagtctcgcataaagcaaattgtaattaaaattggaatgaaattttttctatatttaattcttttgttataaatatcattgatataactttaatagaataataacaaagtatcttaaaaaaaggaccgaaataaaagtataattgcataaatatagctctcaactccagaaaattactgatctaaaaaatatacatgttgcactttaaacatttccaaagttagctcattcttcatatatagaaactctagtgccaggattcgaacatctaatatcttggcccccaaactcatgctataggttgtcttccaattgggttgatcatgaagcatgtgaaacaacatgttggatagctcacgcaagtaaattgatgatctgaaaaaaaatctacatgttatgcttcaagtgcttctagagtgacctcatccttcatatgaccaaatctagtgctagcatgcgacaatctagggtcgcatactcatgttatggttgtcttgaacatgggttaattatggtgcatgcgaaacaacaagttgggtccatccgtaaaactgtctgtctaaacaatacaatatttagggcatcaaaatgcatcgaagttgacgcacatgagaaatcgatatatcacgcattaaacttgcacaaaattaatacccattagtcccatactcatgttttgatcttccctaaacttggatagatgtgttcacaactaaggaacattgcaaataacactatatatgttttaaggtaacatgcctaaacaagtatatcttatagtacgacatttggaaaagagtaatgaaagtggaaatataatttttcttccattaactatttttccattaatagaggtcgtaactctgcaaaatagtttatcttgaaaaatctacatattacaattcaaatacttttaaagttacctcattctttaagatactgaactttgatcggcatgcgaccatatcattctgtgggtcccatactcatgttttgattgtgttgaattttagtggctggtggagcatgtgaaacaacatgttggatcattctataaatctaccacataatttagggcttcgaaaagatatgcacgaaatcatgaccctttactcccaaatcagtgtattgcgaaaactttgatgacaaatgtttttgggtccttttttgtaaaaattaccgttctaaacattacatcatttagggctttgaaccgcttcaaacttacattaatgtccacaaccatgaaacatttgaaatctttccacatattttatgagataacatgtccaaacaagtgatgtttacagtttcacaatgagcaaattgtaatgtaattttccttggttaagttgttttgtgataaatatcatgagtcccatacttgttttttgagaggcctcaaaacatgcactgttgtccataaccaagaaatatataaaatagcactacatatggtttaagatagcatgcctaaactagtattgtttatagtctcgcatagagcaaattgtaattaaaattggaatgaaatcttttatatatttaattcttttattataaattgatataaatgtaatagaataataacaaagaatcttaaaacatggatcaaaataaaagcagaattgcataaatattgctctcaattccagtaaattaccgatctaaataatatacatgttgcactttaaacatttctaaagttacctcatccttcatacctacaaactctagtgtcagcattcaaacatccaatatcttgggccccaaactcatgcggtaggttgtcttgcacttgggttgatgatgaagcatgtgaaacgacatgttggatcattctgtaaattgatgatatgaaaaaaatttacatgttgtgcttcaagcgcttctagagtcacctcatccttcatatgaccaaatctagtgctagcatgcgacaatctagggtcgcatactcatgttatggttgtcttgaacatgggttaatgtgggtcccatactcaagttattgattgtgttgatttttagttgatggtggagcatgtgaaacaacatgttggatcattctgtaaatctaccatataattttgggcttcgaaaagcttcaaagttttcgcatggttcatgccacaatcttttcgagaaaacatgcatgaaattatcaccctttactcccaaatcagtgcattgcgaaaactttgatgacaaatcttgttgggacatttttgtaaaaactaatgttctaaacattacatcatttagggctttgaaccgcttcaaacttacattaatgtctataaccatgaaacatttgaaatctttccacatattttatgagataacatgcccaaacaagtgatatttatagtttggcaataaaaaattgtaatgtaattttccttgcttaaattgttttgtgataagtatcatgagtccgatacttgtttttgagtggtctcaaaacatgcattgttgtccataaccaagaattatttaaaatagcactacatatggtttaatatagcatgcctaaactagtattatttatagtctgacataaagcaaattgtaattaaaattggaatgaaatttttttctatatttaattcttttgttataaatattattgatataactgcaatagaataataacaaagtatcttaaaacttggatcgaaataaaagcataattgcataaatataactctccactctggaaaattaccgatctaaaaaatatacatgttgcactttaaacatttccaaagttacctcattcttcatatctacaaactctagtgcgagcattcgaacatctaatatcttgggccccaaactcatgctataggttgtcttgcacttgagttgatgatgaagcatgtgaaacaacatgttggaaagctcacgcctatagtaaattgatgatctgaaaaaaatctacatgttatgcttcaagcgcttctagagtgacctcatccttcatatgaccaaatctagtgctagcgagcaacaatctagtgttgcatactcatgttatggttgtcatgaacatgggttaatgatggtgcatacgaaacaacaagttgggtccatctgtaaaaactgtctatccaaacaatacaatatttagggcatcaaaatgcattgaagttgacgcacatcagaaattgatatatcatgcagtaaacttgcactaaattaatacccattagtcccatactcatgttttgatcggccttaaacttggattgatgtattcacaactaaggaacattgcaaatagcactatatatgttttaaggtaacatgcctaaacaagtatgtcttatagtacgacatttggaaaagagtaatgaaagtggaaatataatttttcttccattaactatttttcctttaatagaggtcgtaactttgcaaaatcgtttatcttgaaaaatctgcaaattacaattcaaatacttttaaagttacctcgttttttaaaacaatgaactttaatcggcatggggccatctaattatgtgggtcccacactcaagttttgattgtgttgaattttagttgctagtggagcgtgtgaaacaacatgttggatcattctataaatctaccagataatttagggcttcgaaaagcttcaaagttttcacatggttcatgccacaatcttttcaagaaaacatgcacgaaatcatgaccctttactccaaaatcattgtattgcgaaaactttgatgacaaaccttgttggctcgtttttgtaaaaactttcattctaaacattacatcatttagggctttgaaccccttcaaacttacattaatgtccataaccaaaaaacaattgaaatctttccacatatcttataagataacatgcccaaacaagtaatgtttacagtttggcaaagagcaaatggtaatgtaattttccttggttaaattgttttgtaataaatatcatgagtcccatacttgttttttgagtggcctcaaaacatgcactgttgtccataaccaagaaatatataaaatagcactacatatggtttaagatagcatgcctaaactagtattgtttatagtctcgcatagagg

SEQ ID NO: 810 - DNA, 4724 bp, Zea mays
tcactgattaattttgcagcatttgttcaacacttcttcggtcacccagtaatttcatcaacacacaaataaaataacaataaatataaggtaattttgcagtatttgttcaacactttctaactcactcattaattttataatgtttgtactttaattatcaatcatccagtaattttatttacacgttgagaaaagaacaacatatatgcaatgattgtctacttactcagttaatttacagtaatcactcgataattttacataaatcactcagtaattcgacggtatttgtttggtaattccttaatcacacagtaatttcatttacccattgagtaaataacaacaaatatgtagtgattatcaagttactaaataattttacagtcttcactcagtaatttcaatcacccagattgagtagttacatagtaattttacaataatcactgattaattttgcagtatttgttcaacacttcctcagtcacccagtaatttcattaacacactaataaaataacaataaatatgcagtaattttgcagtatttgttcaacactttctcaatcactcattaattttataacgtttgtactataattatcaatcatccagtaattttctttacacgttgagaaaagaacaacatatttgcaatgattgtctagttactcagtcaatttacagtaatcagtcgataattttacataaatcacttagtaatttgacaacatttattcggtaattccttaatcacacaacaatttcatttaccccttgagaaaataacaacatatatgtagtgatatctagttactaaataattttacagtcttcactcagtaattttgcaccatttattcagtaatttcaatcacccagatttagttagatagtaattttacagtatcactgattaattttgcagcatttgttcaactcttcctcagtcaccaagtaatttcattaagacactaataaaataacaataaatatgcaataattttgttgtatttgttcaacactttctcaaccactcattaattttataacgtttgtactataattatcaatcatccagtaattttctttacacgctgagaaaagaacaacaaatatgcaatggttgtctagttactcagtcaatttacagtaatcactcgataattttacatatatcactcagtaatttgacagcatttgttcagtaattccttaatcacacaataatttcatttaccccttgagaaaataacaacagatatgtagtgattatcaagttactaaataattttataagtcttcactcagtaattttgcaccatttattaagtaatttcaatctcccagatttagttacatagaaattttacattaatcattgattaattttgcagcatttgttcaactcttcctcagtcaccgagtaatttcattaacacactaataaaataacaataaatatgcagtaatttttcagtatttgttcaacactttctcaatcactcattaattttataacgtttgtactataattatcaatcatccagtcattttctttacacgttgagaaaagaacaacatataattttgcaccatttattcattaatttcaatcacccagattgagtagttacatagtgattttacagtaatcactgattaattttgcagcgtttgttcaacacttcctcagtcacccagtaatttcattaacacactaagaaaataacaataaatatgcagtaattttgcagtatttgttcaacactttctcaatcactcattaatttataacgtttgtactataattatcaatcatccagtaattttctttacacattgagaaaagaacaacatatatgcaatgattatccagttactaagttaatttacagtaatcactccataattttacataaatcacttagtaatttgacaacatttgttcggtatttgcttaatcacacagtaatttcatttacccattgcgaaaataacaacagatatctagtgattatttagttactaaataattttatagtctccactcagtaattttgcaccatttattcagtaatttcaatcacccagattgagtagttacatagtaattttacattaatcagtgattaattttgcagcatctgttcaacacttcctcattcacctagtaatttcatttacacgctaagaaaagaacaataaatatgcagtaatgttgtagtatttgttcaacactttcccaatcactcattaactttataacgtttgtactataattatcaatcgtccagtaattttctttacacgttgagaacagaacaacatatatgcaatgattgtctagttactaagttaatttacagtaatcactcgataattttacataaatcactcagtagtttgacatcatttgttctgtaattccttaatcacacagtaatttcatttacccattgagaaaataacaacagatatgtagtgattatctagttactaaataattttacagtctccactcagtaattttgcaccatttattcagtaatttcaatcacccagattgagtagttacttagtaattttacagtaattagtgattaattttgcagcatcttcctgattcacccagtaatttcattaacacactaagaaaagaacaataaatatgcatcaattttgtagtatttgttcaacactttctcaatcacccattaattttataacgtttgtactataattatcaatcatccagtaattttcattacacgttgagaacagaacatcatatatacaatgattgtctagttactaagttattttacagtaatcactcgataattttacataaatcactcagtagtttgacataatttgttcggtaattccttaatcacacagtaatttcatttacccatttagaaaataacaacagatatatagtgattatctagttactaaataattttacagtctccactcagtaattttgcaccatttattcagtaatttcaatcacccagattgagtagttacatagtaactttacagtaatcagtgattaattttacagcatctgttcaacacttcctcattcacccagtaatttcattaacacgctaagaaaagaacaaaaaatatgcagtaattttgcagtatttgttcaacactttctcaatcacccattaattttataacgtttgtactataattatcaatcatccagtaattttctttacacgttgagaacagaacaacatatatgaaatgattgtctagttactaagttaatttactgtaatcactcgataattttacataaatcactaagtagtttgacatcatttgttcgataattccttaatcacacagtaatttcatttacccattgagaaaataacaacagatatgtagtaattatctagttactaaataattttacagtctccactcagtaattttgcaccatttattcagtaatttcaagcacccagattgagtagttacctagtaattttatagtaatcagtgattaattttgcagcatctgttcaacacttcctcattcacccagtaatttcattaacacgctaacaaaagaacaataaatatgcagtaattttgcagtatttgttcaatactttctcaatcacccattaattttataacgtttgtactataattatcaatcatcaagtaattttctttacacgttgagaacaaaacaacatatatgcaatgattgtctagttactaagttaatttacagcaatcactcgataatttaacataaatcactcagtagtttgacatcatttgttcagtaattccttaatcacacagtaatttcatttatccattgagaaaataacaacagatatgtagtgattatctagttactaaataattttacagtatccactcagtaattttacaccatttattcagtaattgcaatcacccagattgagtagttacatagtaattttacagtaattagtgattaattttgcagcatctgttcaacacttcctcattcacccagtaatttcattaacacgctaagaaaagaacaataaatatgcatcaattttgcagtatttgttcaacactttctcaatcacccattaattttataaagtttatactataattatcaatcatccagtaattttcattacacattgagaacagaacaacatatatgcaatgattgtctagttactaagttattttacagtaatcactcgataattttacataaatcactcagtagtttgacatcatttgttcggtaattccttaatcacacagtaatttcatttacccattgagaaaataacaacagatatatagtgattatctagttagtaaataattttacagtctccattcagtaattttgcaccatttattgagtaatttcaatcacctagattgaatagttacatagtaattttacagtaatcagtgattaattttgcagcatctgttcaacacttcctcattcacctagtaatttcattaacacgataagaaaagaacaataaatatgcagtaattttgcagtatttgttcaacactttctcaatcacccattaattttatacgtttttactataattatcaatcacctagtaattttctttacacgttgagaacagaacaacatatatgaaatgattgtctagttactaagttaatttacagcaatc

SEQ ID NO: 811 - DNA, 4649 bp, Zea mays
ttatctagttactaaataattttatagtctccactcagtaattttgcaccatttgttcagtaatttcaatcaccaagattgagtagttatatagtaattttacagtaatcactgattatttttgcatcatttgttcaacacttcctcagttacccagtaatttcattaacacactaagacaataacaataaatatgcagtaattttgcagtatttgttcaccactttctcaatcactcattaattttttaacgtttgtactataattatcaatcatccagtaattttctttacacgttgagaatagaacaacatatatgcaacgatgttctagttactcagttaatttacattaatcactcgataattttacataaatcactcagtaatttgacggcatttgctcggtaattccttaatcacacagtaatttcatttatccattgggaaaataacaacagatatgtagtgattatctagttactaaaaattttacagtctccactcagtaattttgcaccatttgttcagtaatttcaatcacccagattgagtagttacatagtaattttacactaatcactgattaattttgcagcatttgttcaacacttccttagtcatccagtaatttcattaacacactaagaaaataacaataaatatgcagtaattttgcagtatttgttcaacactttctcaatcactcattaattttataacgtttgtactataattatcaatcatccagtaattttcattacacgttgagaaaagaacaacatatatgcaatgattgtctagttactcagttaaatcatagtaatcacttgataatttttcataaatcactcagtaatttgacagcatttgtttggtaattcctaaatcacacagtaatttcatttacgcattgagaaaataacaatagatatgtagtgattatctagctactaaatatatgtacagtctccactcagtaattttgcaccatttattcagtaatttcaatcacccagattgagtagttacatagtaattttacagtaatcactgattaattttgcagcatttgttcaatacttcctcactcatccagtaatttccttagcacactaagaaaataacaataaatatgcagtaattttgcagtatttgttcaacactttctcaatcactcattaattttataacgtttgtactataattatcaatcatccagtaattttctttacacgttaacaaaagaacaacatatatgcaatgattgtctagttactcagttaatttacagtaatcactagataattttacataaatcactcagtaatttgacagcaattgtttggtaattcttaaaccacacagtaatttcatttacccattgagaaaataacaacagatatatagtgattatctagttactaaatatatgtacagtctccactcagtatttttgcaccatttgttcagtaatttcaatcacccagatttagtagttacatagtaattctacagtaatcactgattaatttttcagcatttgttcaacacttccttagtcaccaagtaatttcattaacaaacttaaaataacaataaatatgcagtatttctgcagtatttgttcaacactgtctcaatcacacattaattttataacgtttgtactataattatcaatcatccagtaattttctttacacgttgagaaaagaacaacatatatgcaatgattgtccagttactcatttaatttacagtacaccatttattcagtaatttcaatcacctagattgagtagttacatagtaattttacagtaatcactgattaattttgcagcatttgttcaatgcttcctgagtcaactaataatttcattaacacactaagaaaataacaataaatatgcagtaattttgcagtaattgttcaacactttctcaatcactcattaattttataacgtttgtactataattatcacccagtaattttgtttacacgttgagaaaagaacacatatatgcaatgattgcctagttactaagttaatttacagtaatcactcgataattttacagaaatcactcagtagtttgacatcatttgttctgtaattccttaatcacacagtaatttcatttacccattgagaaaataacaatagatatgtagtgattatctagttactaaataattttgcagtctccactcagtaatattgcatcatttgtttagtaatttcaatcacccagattaagtagtaacatagtaattttacagtaatcactgattaattttgcagcatttgttcaatacttcctcagtcacctagtaatttcattaacacactaagaaaataacaataaatctgcattaattttgcagtatttattcaacactttctcaatcactcattaattttatagcgtttgtactataattatcaatcatcgagtactttacgttgagaacagaacaacatatatgcaatgattgtccagttactcagttaatttacagtaatcactcgataattttacataaatcactcagtactttgacagcatttgtttgataatttcttaatcacacagtattttcatttacccattgagaaaataataacatatatgtagtgattatctagttactaaataattttacagtcttcactctttaattttgcaccatttattcagtaatttcaatcacccagattgagtagttacatagtgattttacagtaatcactgattaattttgcagcatatgttcaacacttcctcagtcaccgagtaatttcattaacacactaagaaaataacaataaatatgcagtaattttgcagtatttgttcaacactgtctcaatcactcattaattttataacgtttgtactataaatatcaatcatccagtaattttctttacacgttgagaaaagaacaacatatatgcaatgattgtctagttactaagttaatttacagtaatcactcgataattttacataaatcactcagtagtttgacatcattggttcggtaattctttagtcacacagtaatttcatttacccattgagaaaataacaacagatatgtagtgattatctagttactaaataattttacagtctccactcagtaatttttcaccatttattcagtaatttcaatcacctagattgagtagttacatagtaattttacagtaatcactgattaattttgcagcatttgttcaacacttcctcagtcatccagtaatttcattaacacactaagaatataacaataaatatgcagtatttttgcagtatttgttcaacactttcttaatcactcattaattttataatcgtttgtactataattatcaatcatccagtaattttctttacacgttgagaatagaacacatatatgcaatgattgtctagttactcagttaatttacagtaatcactcgataattttacataaatcactcagtaatttgacagattttgttcggtaattccttaatcacatagtaatttcatttacccattgataaataacaacagatatgtagtgattatctagttactaaataattttacagtctccactctgtaattttgcacgatttgttcagtaatttcaatcacccagatttagtagttatatagtaattttacagtaatcactgattaattttgcatcatttgttcaacactttcttagttacccagtaatttcattaacacactaagaaaataacaataaatatgcagtaattttgcagtatttgttcaacacttgctcaatcactcattaattttataacgtttgtactataattatcaatcatccagtaattttctttacacgttgagaaaagaacaagatatatgcaatgattgtctagttactccattaatcgacagtaatcacttgataattttacataattcactcagtagtttgacatcatttgttcggtaattccttaagcacacagtaatttcatttatccattgagaaaataacaacagatatgtagtgattatctagttactaaataatgttacagtctccactcagtaattttgcaccatttattcaataatttcaatcacccagattgagttgttacatagtaattttacagtaatcactgattaattttgcagcatttgttcaacacttcctcagtcatccagtaatttcattaacacactaagaaaataacaataaatatgcagtaattttgcagtatttgttcaacactttctcaatcactcattaattttataacggttgtactataattaccaatcatccagtaattttctttacacgttgagaaaagaacaacatatatgcaatgattgtctagttactcagttaatttacagtaatcactcgataattttacataaatcactagtaatttgacagcatttgttcggtaattccttaatcacatagtagtttcatttacccattgagaaaataacaacagatatgtaaggcccaaaatctgtataagaaaaaaaataatagaataaatatatgaagaggtaaaatagtaaattcagatatctcaaattatatctcaaatgtttttaaaaccaataattatattataatag

SEQ ID NO: 812 - DNA, 4597 bp, Zea mays
acagcggggtggatctcgtgggcgtccatagttccgcggcgggtcgacggggcggcgcgatgagatcgcggcggggaaggcgagcctacgtgcgagcggggtggggtggggggtgtgacggcggggtgggggggcgagatttccgctgcgggacgacgcggcggcgcgatgtgcgggagcggaggcgttgtggagcagagggtgggggatccgcgacgcgaatggcagaaccgttcactgtggacgcctacggtacggtcttaagagtagtaaagattgagaaagtgttgaacaaatactgcaaaattgatgcatatttattgttctttcttagcgtgttaatgaaattactgggtgaatgaggaagtgttgaacagatgctgcaaaattaatcactgattactgtaaaattactatgtaactactcatactgggtgattgaaattactgaataaatggtgcaaaactactgagtggagactctaaaaatatttagtaactagataatcactacatatctgttgttattttttcaatgggtaaatgaaattactgtgtgattaaggaattacataacaaatgatgtcaaactactgagtgatttatgtaaaattatcgagtgattactgtaaattaaattagtaactagacaatcattgcatatatgttgttctattctcaacgtgtaaagaaaattactggatgattgataattatagtacaaacgttataaaattaatgggtcattgagaaagtgttgaacaaatactgcaaaattactgcatatttattgttcttttgttagcgtgttaatgaaattactcggtgaatgaggaagtgttgaacagatgctgcaaaattaatcactgattactgtaaaattactaggtaactactcaatctgggtgcttgaaattactgaataaatggtgcaaaattactgagtggagactgtaaaattatttagtaactagataattactacatatctgttgttattttctcaatgggtaaatgaaattactgtgtgattaaggaattaccgaacaaatgatgtcaaactacttagtgatttatgtaaaattatcgagtgattactgtaaattaacttagtaactagacaatcatttcatatatgttgttctgttctcaacgtgtaaagaaattactggatgattgataattatagtacaaacgttataaaattaatgggtgattgagaaagtgttcaacaaatactgcaaaattactacatattttttgttcttttcttagcgtgttaatgaaattactgggtgaatgaggaagtgttgaacagatgctgtaaaattaatcactgattactgtaaaattactatgtaactactcaatctgggtgattgaaattactgaataaatggtgcaaaattactgagtggagactgtaaaattatttagtaactagataatcactatatatctgttgttattgtctcaatgggtaaatgaaattactgtgtgattaaggaattaccgaacaaatgatgtcaaactactgagtgatttatgtaaaattatcgagtgattactgtaaaataacttagtaactagacaatcattgcatatatgctgttctgttctcaacgtgtaatgaaaattactggatgattgataattatagtacaaacgttataaaattaatgggtgattgagaaagtgttgaacaaatactgcaaaattgatgcatatttattgttcttttcttagcgtgttaatgaaattactgggtgaatgaggaagtgttgaacagatgctgcaaaattaatcactaattattgtaaaattactatgtaactactcaatctgggtgattgaaattactgaataaatggtgcaaaattactgagtggatactgtaaaattattcagtaactagataatcactacatatctgttgttattttctcaatggataaatgaaattactgtgtgattaaggaattactgaacaaatgatgtcaaactactgagtgatttatgttaaattatcgagtgattactgtaaattaaattagtaactagacaatcattgcatatatgttgttctgttctcaacgtgtaaagaaaattactggatgattgataattatagtacaaacgttataaaattaatgggtgattgagaaagtgttgaacaaatactgcaaaattactgcatatttattgttcttttcttagcgtgttaatgaaattactaggtgaatgaggaagtgttgaacagatgctgtaaaattaatcagtgattactctaaaattactatgtaactactcaatctgggtgattgaaattactgaataaatggtgcaaaattactgagtggagactgtaaattattttgtaactagatattcactacatttatgttgttattctctcaatgggtaaatgaaattactgtgtgattaaggaattaccgaacaaatgatgtcaaactactgagtgatttatgtaaaattatcgagtgattactgtaaattaacttagtaactagacaatcatttcatatatgttgttctgttctcaacgtgtaaagaaaattactggatgattgataattatagtacaaacgttataaaattaatgggtgattgagaaagtgttgaacaaatactgcaaaattactgtatatttattgttcttttcttagcgtgttaatgaaattactgggtgaatgaggaagtgttgaacagatgctgcaaaattaatcactgattactgtaaaaattactatgtaactactcaatctgggtgattgaaattactgaataaatggtgcaaaattactgagtggagactgtaaaattatttagtaactagataatcactatatatctgttgttattttctcaatgggtaaatgaaattactgtgtgattaaggaattaccgaacaaatgatgtcaaactactgagtgatttatgtaaaattatcgagtgattactgtaaaataacttagtaactagacaatcattgcatatatgttgttctgttctcaacgtgtaatgaaaattactggatgattgataattatagtacaaatgttataaaattaatgggtgattgagaaagtgttgaacaaatactgcaaaattgatgcatatttattgttcttttcttagcgtgttaatgaaattactgggtgaatgagcaagtgtcgaacagatgctgcaaaattaatcactgattactgtaaattacatgtaactactcatactgggtgattgaaattactgaataaatggtgcaaaattactgagtggagactgtaaaaatatttagtaactagataatcactatatatctgttgttattttctcaatgggtaaatgaaattattgtgtgattaaggaatttccgaacaaatgctatcaaattactgagtgatatatgtaaaattatcgagtgattactgtaaattgactgagtaactagacaaccattgcatatttgttgttcttttctcaacgtgtaaagaaaattactggatgattgataattatagtacaaacgttataaaattaatgagtggttgagaaagtgttgaacaaatacaacaaaattactgcatatttattgttattttattagtgtcttaatgaaattacttggtgaccgaggaagagttgaacaaatgctgcaaaattaatcagtgatactgtaaaattactatataattaaatctgggtgattgaaattactaaataaatggtgcaaaattactgagtgaagactgtaaaattatttagtaactagataatcgctacatatatgttgttattttctcaaggggtaaatgaaattgccgtgtgattaaggaattaccgaataaatgctgtcaaattactgagtgatttatgtaaaattatcgagattactgtaaattgactgagtaactagacaatcattgcaaatatgttgttcttttctcaacgtgtaaagaaaattactcgatgattgataattatagtacaaacgttataaattaatgagtgattgagaaagtgttgaacaaatactgcaaaattactgcatatttattgttattttattagtgtgttaatgaaattactggtgactgaggaagtgttgaacaaatactgcaaaattaatcagtgattactgtaaattactatgtaactactcaatctgggtgattgaaattactgagtgaagactgtaaaattatttagtaacttgataatcactacatctgttgttttactcaatgggtaaatgaaattactgtgtgattaaggaattaccaaacaaataccgtcgaattactgagatttatgtaaaattatcgagtgattactgtaaattaactgagtaagtagacaatcattgcatataagttgttcttttctcaacgtgtaaataaaattactggatgattgataattatagtacaaacgttataaaattaatgactgagttagaaagtgttgaacaaatactgcaaattaccttatatttattgttattttatttgtgtgttaatgaaattactgggtggccgaggaagtgttgaacaaatgctgcaaaattaatcagtga

SEQ ID NO: 813 - DNA, 4580 bp, Zea mays
tgaaaagaacaacataaatgcaatgattgtctaatactaagttaatttatagtaatcactcgataattttacataaatcactcagtaatttgactacatttgttcggtaattctttaatcacacagtaatttcatttacccattgagaaaataacaacagatatgtagtgattatctagttactaaataattttacagtcttcactctgtaattttgcaccatttattcagtaatttcaatcacccagattgagtagttacatagtaattttacagtaatgactgattaattttgcggcatttgttcaacacttcctcattcactcagtaatttcattagcacactaataaaataacaataaatatacactaattttacagtatttgttcaacactttctcaatcactcattaattttataacatttgtactataattatcaatcatccagtaattttctttacacgttgagaaaagaacaacatatatgcaatgattatccagttactgagttaatttacagtaatcgctcgataatttcacataaattactcagtaatttgacagcatctgttcggtaattccttaatcacatagtaatttcatttaaccattgagaaaataacaacagatatgtagtgattatctagttactaaataattttacagtttcactcagtaattttgcaccatttattcagtaatttcaatcacccaattgagtagttacatagtaattttacagtaatcactgattaattttgcaggatttgttcaacacttcctgagtcacccagtaatttcattaacacactaataaaataacaataaatatgcagtaattttgcagtatttgttcaacactatctcaatcactcattaattttataacgtttgtactataattatcaatcatctagtaattttctatacacgttgagaaaagaacaacatatatgcagtgattgtctaactactaagttaatttacagtaatcactcgataattttacataaatcactcagtatttgacaacatttgttcggtaattccttggtcacacagtaatttcatttacccattgagaaaataataacatatatgtagtgattatctagttactaaataattttacagtcttcactcagtaatttgcaccatttattcagtaatttcaatcacccagattaagtagttacatagtgattttacagtaaccactgattaattttgcagcatttgttcaactcttcctcaatcacctagtaattttattaacacacaaagaaaataacaataaatatgcagtaattttgcagtatttgttcaacactttctcaatcactcattaattttataacgtttgtactataattatcaatcatccagtaattttctttacacgttgagaaaagaacaacatatatgctatgattatccggttactgagttaatttacagtaatcgctcgataatttcacataaattactcagtaatttgacagcatctgttcggtaattccttaatcacatagtaatttcatttacccattgagaaaataacaacagatatgtagtgattatctagttactaaataattttacagtcttcactcagtaattttgcaccatttattcagtaatttcaatcacccagattgagaagttacatagtaattttacagtaatcactgattaattttgcaggatttgttcaacacttcctgagtcacccagtaatttcattaacacactaataaaataacaataaatatgcagtaatttgcagtatttgttcaacactatcccaatcactcattaattttataacgtttgtactataattatcaatcatctagtaattttctatacacgttgagaaaagaacaacatatatgcaatgattgtctaactactaagttaatttacagtaatcactcgataattttacataaatcactcagtatattgacaacatttgttcggtaattccttaatcacacagtaatttcatttacccattgagaaaataataacatatatgtagtgattatctagttactaaataattttacagtcttcactcagtaatttgcaccatttattcagtaatttcaatcacccagattaagtagttacatagtgattttacagtaaccactgattaattttgcagcatttgttcaactcttcctcaatcaaccagtaattttattaacacacaaagaaaataacaataaatatgcagtaattttgcagtatttgttcaacactttctcaatcactcattaattttataacgtttgtactataattatcaatcatccagtaattttctttacacgttaagaaaagaacaacatatatgcaatgattatctagttactcagttaatttatagtattcactcgataattttacataaataactcagtaatttgacaacattagttcggtaatttcttaatcacacaataatttcatttacccattgagcaaataacaacagatatctagtgattatctagttactaaatatatttacagcctccactcagtaattttgcaccatttattcagtaatttcaatcacccagattgagtagttacatagtaattctacagtaatcactgataaattttgcagcattggttcaacacttcctcagtcacccagtaatttcattaacacactaagaaaataacaataaatatgcagtaattttgcagtatttgttcaacactgtctcaataactcattaattttataacgtttgtactataattatcaatcatccagtaattttcttacacgttgagaaaagaacaacatatatgcaatgattgtccagttactctgttaatttacagtaatcactcgataattttacataaatcactctgtaatttgacagcatttgttcggtaattccttaatcacacagaaatttcatttacccattgagaaaataacaacagatatgtagtgattatctagttactaaataattttacagtctccactcagtaattttgcaccatttgttcagtaatttcaatcacctaggttgagtagttacatagtaattttacagtaatcacttattaattttgcatcatttgttcaacacttcctcagtcacccagtaatttcattaacacactaataaaatagcaataaatatgcaataattttgcagtatttgttccacactttctcaatcactcattaattttgtaacgtttgtactataatgatcaatcatcctgtaattttctttacacgttgagaacagaacaacatatatgcaatggttgtctagtaactatgttattttacactaatcactcgataattttacataaatcactcagtactttgacatcatttgttcgataattccttaagcacacagtaatttcatttacccattgagaaaataacaacatatatgtagtgattatctagttactaaataattttacagtccactcagtaattttgcaccatttgttcagtaatttcagtcacccagattaagtagttacatagtaattttacagtaatcactgattaattttgcagcatttgttcaacacttcctcagtcatccagtaatttcattaacacactaagaatataacaataaatatgcagtaattttttctgtatttgttcaacactttctcaatcactcattaatttaattatgtttgtactataattatcaatcatcgagtaatttttttacatgttgagaaaagaacacatatatgcaatgattgtatagttactcagttgatttacagtaatcactcgataatttacataaatcacttagtagtttgacagcatttgttcggtaattccttaatcacacagtaatttcatttacccattgataaataacaatagatatgtagtgattatccagttactcaataattttacagtctccactcagtaattttgcaccatctgttcaataatttcaatcacccagattgagtagttacatagtaattttacagtaatcactgattaatttgctgcatttgttcaacacttcctcagtcacccagtaatttcattaacacactaataaaataacaataaatatgcagtaattttgcggtatttgttccacactttctcaatcactcattaattttataacgtttgtactataattatcaatcatcctgtaattttctttacacgttgagaacagaacaacatatatgcaatgattgtctagttactaagttaatttacagtaatcactcgataatttcacataaatcacttagtagtttgacatcatttgttaggtaattccttgagcacacagtaatttcatttacccattgagaaaataataacagatatgtagtgattatctagttactaaataattttacattcgccactcagtaattttgcaccatttattcagtaatttcaatcacccagattgagtagttacatagtaattttacagtaatcactgattaattttgcagcatttgttcaacacttcctcagtcatccagtaatttcattaacacactaagaaaat

SEQ ID NO: 814 - DNA, 4531 bp, Zea mays
atggatctacaacttttctatatggatctacaacttttctatatggatcatcaaacatacagcacgacgaaaacagtgggtgcagcccgaaacagcaactaataaatttcagctcctatttacttcaaaaattgccatgttctagagacctgaattattctaacactttaccatttgttagagttaaattaatcaaatgaggactaacaaagagacttacaaatttttatccatgtcattccgtgcactagaattaccacacatgtttaacaaatgcattcaccacaatactcagaccgggtatatatgtatatcgatgcgctcttcacacactagtttgcattttaacttagacaccacatgagcactactacttttcatccgcgaccataaccatatgtatttaggctacaacaagaaaatcatcgtgaccacgagcttaaccacatccatctaacaattcggctaactagagtaatgacatagcccgctaaataacatacacgtcggcttgcctattattatcgcaatccgagacacaacatacactaaaacatttttataaacacacatattcacaagtatttttgcacaccgaccaaatcatacgaatcgtaaaccactaatctccaactcgcaaccaccatgcgcttacttcccaaatcatgaacacgtacatgtttatcatatgatcaaaacatttcaataattattctaaagcaaactaactccattacactacttgtatcacgaacctacttgatttacttgaagtgtctactcgaaatcgtgagcacaatcatacactatatgtgaagcataattttacgaacgcataatacgcattgtatcgacttataaacatagagcaagcgatgactactttggcatgtcaccacctctctaattaagccaagacaatttctacctacaacgaccgaacattcatgtcgagcacaccttattttaccctgtctcgcatacaaccatgttgtggcgtgcactcgagacacttcgatcatcgtagcgtaaccactaatatatgaactccgacactcatgccttaacaatacatcccccacgcaaactagcattttctaaactactcgtcacatcaacaaatataacccctatataatcacgaatcccatcatattgcataggatttgcacttcaatctcggcttaactgcacgcctcatactcgtctattccaaaactcttcgtctaaccaatacactacactctgcatatgtaggatccaattaacacactcgacgtatacacttaagagactgtttttcatacaacctataaaatcaatctagccttctcatcacacaacacacctccttccctatttcgaatgcaaccgcatttcagcatgcatccgaaaaatacttcagacaactctacgcaaccactattatgatacttcggcacgcacacacatacgtgtccccacattatgcacatgacatcaacagcacaagtgactccaacaggaccaacatactcctcaatcgcatcgactaccacaatcaccgatcacatgtataaaacaaatacacttttcatgtaaacacctatcgatgcattccccacaacataacctgcattttaagattaatcctcacatcaaaccacacatccaatacattcctaccgaaaacataaaaacatacgagttcttttctacttcattttcttctctacacgctttcattcatataaatatatggaaaaattcctggtatgccatccgattttatactcattccttgtgtgccactgagtggcatataggtatatttttttgtgtctatgacatgtggggccagtggcatacaaggaacgagtatattttccagtggcatacagggaattggccctaaatatattttcacacacatattcacgccatcgactgaatcgtaaataaaacaaaatcacaattttctctaaagcaaacaacttggccaaaacccgagtggagttacgcatgcgtccacggtttaggtgcttcaccgaatcatgtgttgcgcgaggcgcagcggcaacatcttgctgcgattaataacacctagtggttcaaacatttttatcaagcacttgagatccaaaaaacaatgggatactagcgaggggctcaccaaggatctcgacgacaacgcgcaagcgctgcgtagatcgacggcgtgaggaccgacctggcgagagcgacgcagcggagggcgtcgctgctgctgcttgctgcggcattacgtcgagcacgccgagggcgcgacgcagaggggatccatggccgctgctgcaagtgcgggggcacagaccagtggaggagcacgtgaggaggacatcggcgagcgcagtccaggcactgcttgagctcggaccagagaaggtcccgcgccatggctgagggcgcgtggggcagggagctcgcaggggggagccggctggagacccacgcagggagcacggggctgagcgccatgggagaaggtgcctgcgccgactatgtggggaggagaggggtcaccatggggagagcacctgctcgagctggggacgccggttgctggtgtccctggtcggcatcctgggctccacggcttggaaatacaggaagatggtggctgctggttgagggagatggcggggaggtgaggccaagtgcgtagcccaggggaggtgcagcagaggtggaaaattccatgttccaaggagctctacaggggaaggctagaggtagaagaaggtcgggctgcatgctgcaggtgctccttcgttcgaatgaaaagaaatggagcacttgtctcgtaagtcgtaaacaccattgatgcattccccacaacataacctgcattttaagattaatcctcacagcaaaccacacatccaatacattcctaccaaaaacataaaaacatccgagttctttttacttcattttcttctctacacgctttcattcatacaaatatattttcacacacatattcacgccatcgactgaatcgtaaataaacaaaatcacaattttctctaaagcgaacaacctggccgaaacccgagtggagttgcgcatgcatccacggtttagctgcttcacccaatcatgtgtcgcgcgaggcgcagcggcaacatcttgctgcgattaacaacaacatcttgctgcgattaacaacacctagtggttcaaacatttttatcaagcacttgagatctaaaaaacaatgggatactagcgaggggctcacaaggatctcgacgacaacgcgcaagcgctgcgcagatcgacggcgtgaggcccgacctggcgagagcgacgcagtggagggcgtcgctgctgctgcttgctgcggcattacgtcgagcatgccgaaggcgcgacgcagagggaatccatggccgctgctgcaagtgcgggggcgcggaccggtggaggagcacgtgaggaggagctcggcgagcgcagtccaggcgctgcttgagctcggaccagagaaggtcccgcaccatggctgagggcgcgtggggcagggagctggcagggggagccggctggagacccacgcagggagcgcggggctgagcgccatgggagaaggtgcctgcgccgactatgtgggaggagaggggtcgccatggggagagcacctgctcgagctggggacgccggttgctggtgtccctggtcggcatcctgggctccacggcttggaaatacagggagatggtggctgctggttgagggagatggcggggaggtgaggccaagtgcgtagccagggaaggtgcagtagaggtggaaaattccatgttccaaggagctctactggggaaggctagaggtagaagaaggtcgggctgcatactgcaggtgctccttcgttcgaatgaaaagaaatggagcaaggcaatgcatggagcttcaaaggcgaggctggctgtgcggcgagtggctcgcaccgcacattgggcagcgtggcggcggctgtccgttggccatgcccaacggtggccaacccgcgcaagatacgcagaggccaaagcctgcgctcgtaggctgctacacgagggtttctgttcctttcgcctttctatttgtttttttctcacttacatgacgtaggataggcattaataaaaaataataattagattaaggtttaaaatcttatactaaattattgatgtgatcgtactaaatggctcgcaatagcgaaacgacaaacacgattaatctagcagagattctagatgacgttgcctaaaaattttctcacgttccctttttaaaatggtttgactcaatttgaccatagtttcaaattagttcctcgtaatttgaattaacaataaataatatgagttgttccgtttttttcgcttttgctcgtgccgacaaatgtgaaaattgtgtgctgtcatgaacatacgctcatttcatattcaaattaagattttcgaattaaggttctctctcttaataaaaacaacttctgaaattaagatttttcatttta

SEQ ID NO: 815 - DNA, 4510 bp, Zea mays
ttttcttccattaactatttttccattaatagaggtcgtaactctgcaaaatagtttaacttgaaaaatctgcatatagcaattcaaatacttttaatgttatctcactctttaaaacactgaactttaatcggcatgcgaccatctaattatgtgggtcccatactcaagttattcattttgttgaattttagttgatggtggagcgtgtgaaacaacatgttggatcgttctgtaaatctaccatataatttagggcttcaaaaagcttcaaagttttagcagggttcatgccacaatcttttcgagaaaacatgcacgaaatcatgaccctttactcccaaatcagtgtactgtgaaaactttgatgacaaaccttgttgggtcctttttgtaaaaactaccgttctaaacattacctcatttagggatttgaacagcttcaaacttacattaatgtccataaccatgaaacatttgaaaatttcccacatatcttatgagattacatgcttaaacaagtgatgtttacagtttggcaatgagcaaattgtaatgtaatttttcctaggttaaattgttttgtgataaatattatgagtcccatacttgttttttgagtggcctcaaaacatgcattgttgtccataaccaagaatcatttaaaatagaactacatatggtttaagatagcatgcctaaactagtattgtttatagtctcgcatcgagaaaattgtacttaaaattggaataaaatttttctatatttaattcttttgttgtaaatatcattgatataactgtaatagaataataacaaagaatcttaaaacatggatcgaaataaaagcagaattgcataaatatagctctcaactccgagaagttaccaatctaaaaaatatacatgttgcactttaaacatttctaaagttatctcattcttcatatctacaaactctagtgccagcattcgaacatccaatatcttaggccccaaagtcatgctataggttgtcttgcacttaggatgatgatgaagcatgtgaaacaacatgttggatagctcatgcatatagtaaattgaggatacgaaaaaaaatatgcatgttatatttcaagcgcttatagagtcacctcatccttcatatgaccaaacctagtgctagcatgcgacaatctagggtcgcatactcatattatggttgtcttgaacatgggttaatgatggtgcatgcgaaacaagttgggtctatccgtaaaaactgtctgtctaaacaatacaatatttagggcttcaaaatgcatcgaagttgacacatatcagaaatcgatatatcatgcagcaaacttgtacgaaattaatacccattagtcccatactcatgttttgatcggccttaaacttgggttgatgtgttcacaactgaggaagattgcacataacactatatatgttttaaggtaagaggcctaaagaagtatgtcttacagtacgacatttagaaaagagtaatgaaagtgcaaatataaattttcttccattaactattttccattaatagaggtcgcaactctgcaaaatagtttatcctgaaaaatctgcatattgcaattcaaatacttttaaagttatctcattatttagaacacttaactttaatcggcatgcgaccatctaactatgtgggtcccacaatcacgttattgattgttttcaatattagttgatgatggagcgtgtgaaacaacatgttggatcattctgtaaatctatcacataatttagggcttcaaaaagcttcaaagttttcgcatgattcatgccacaatcttttcgagaaaacatgcacgaaatcatgaccatttactcccaaatcagtgtattgcaaaaactttgatgacaaaccttgttgggtgcttttttgtaaaaactaccattctaaacattacatcatttagggctttgaaccgcttcaaacttacattaatgtttataaccgtgaaacatttcaaatctttccacatatctgataagataacttgcccaaacaagtgatgtttacagtttgacaatgtgcaaattgtaatgtaattttccttggttaaattattttgtgataaatatcatgagtcccatacttgttttttgagtggcctcaaaacatgcaatattgtccataaccaacaatcatttaaatagcactacatatattttaacataacatgcctaaagtagtaatgtttatagtctggcataaaccaaattgtacttacaattggaatgaaaattttctatatttaattcttctattaaaaatatcattggtataactataacataataataacaaagtatcttaaaacatggatcgaaataaaagcagaattgcataaatgtagctctcaactccggaaaattacagatctaaaaaaatatacatgttggactttaaacatttataaagttacctcattcttcatatctacaaactctagtgcctgcattcgaacaaccaatatcttgggccccaaattcatgctataggttgtcttgcacttgggttgatgatgaagcctgtgaaacaacatgttgggtaactcacgcctatagtaaattgatgatccgaaaaaaatctacatgttatgcatcaagcgcttctagagtccccttgtccttcatatgaccaaatctagtgctagcatgcgacaatctagggtcgcatactcatgttatggttgtcttgaaaatgggttaattatggtgcacgtgaaacaacaagttgggtccatccgtaaaaagtatctgtctaaataatacaatatttagggcttcaaaatgcatcggagttgacgcacatcagaaatcgatatatcatgcagtaaacttgcaagaaattaatacccattagtcccatactcaagttttgatcggccttaaacttgggttgatgtgttgaacactgaggaacattgcaaatagcactatatatgtttttaaggtaacatgcattaacaagtatgtcttacagtacgacatttagaaaagagtaatgaaagtgaaaatataatttttcttccattaactatttttccgttaatagaggtcgtaattctgcaaaatagtttatcttgaaaaatctgcatattgcaattcaaatacttttaaacttacctcattctttaaaacactgaagtttaatcatcatgcgaccatctaattatgtgggtcccatactaaagttacttattgtgttgaattttagttgatggtgaaccgtgtgaaacaacatgttggatcattctataaatctaccacataatttagggcttcgaaaagcttcaaagttttcgcatggttcatgccacaatcttttcgagaaaatatgcacgaaatcatgagcctttactcccaaatcagtgcatgtgaaacaagttgggtccatccgtaaaaactgtctgtctaaacaatacaatatttagggcttcaaaatgcatcgaagttgacacacatcagaaatcaatatatcatgcaacaaacttgtatgaaattaatacccattagtcccatactcatgttttgatcggccttaaacttgggttgttgtgttcacaactgaggaacattgcacattgcactatatatgttttaaggtaacatgtctaaagaagtatgtcttacagtacgacaattagaaaagagtaatgaaagtgcaaatataatttttctttcattaactattttccattaatagaggtcgtaactctggaaaatagtttatcttgaaaaatcttcatattgcaattcaaatacttttaaagttatctcattatttaaaacactgaactttaatcggcatgcaaccatctaactatgtgggtcccacaaacacgttattggttgttttcaatattagttgatagtggagagtgtgaaacaatatgttggatcattctgtaaatctaccacataatttagggcttcgaaaagcttcaaagctttcgcatgattcatgccacaagcttttcgagaaaacatgcatgaaatcatgaccctttactcccaaatcagtgtattgcaaaaactttgatgacaaaccttgttgggtgctttttgtaaacactaccattctaaacattacatcatttagggctttgaactgcttcaaacttacattaatgtttataaccatgaaacatttgaactctttccacatatttgattagataacatgcccaaacaagtgatgtttacagtttggcaatgtgcaaattgtaatataattttccttggttaaattgttttatgataaatatcatgagtcccatacttgttttttgagtggcctcaaaacatgcaatattgtccataaccaagaatcatttaaaatagcactacatatattttaacataacatgcctaaactagtctagcataaagcaaattgtacttacaattggaatgaaaatttttctatatttaattcttctgttaaaaatatcattgg

SEQ ID NO: 816 - DNA, 4387 bp, Zea mays
taacatactctagtaactccagccttgtcgtaggatgtgaggcacgtaatcggactacaagttgtactccgggcccgtggccagcttcactgctttaatatggtcctgattcagtggacaatagtatgaatgagatgcttctaacgatgtcaagataactcatataacgctagtgcattctgcctctgcataggaaaaaaaacaacgctgagaggtgacacgctgaatgggccatcagtgtcgttcattgcagaaccgctgtttgtctcccgtaagtgacggaaacgagggggattgacttcagtatcatgcatattcctaccaccttttcggttttgggaaatactgagcgcattgtgtggcggtgagacccgttttccattgggtgaagtagtcttgacatggttgttagagaatttggttcttgtaggatatctctggcatctactcattgacaccactgacagcaagcttgtatgatttgcaaggttgtactgttgcaatagctttcgaagcagatggatgggagttcacactccgatgtttggacggtctggatggttttgcccttgagaaatttggcagtttgagcagagaactgcacaaaaaatacttgcttattacttaattaaatgcagaagcaaatatatatactaagcatactcaaggagcgaaatatgtaataagcaagcctgcaaaaatcaaaaggtggacaaggttcaggaggggctgatcttcgctcctgtacatttgctttttgtcgatcgttctccttttcttgttgagaattctctttgttcacagtatttatttcttgagacagcttgacttcttacaattgcatatcctctcttgtgacgagctgaagctggagtattattaggcttaaggtttagtcacattaaatatcgtttcctcgtcaatcataggcttaagctggttgccttcagtaccatcaccttttgctatgacattgcaaatccaagacttgagcctaggaaggaacaatttataacatggaaataaagatgccccagttagtgtgcagaaaggagagatgaaaaatgccttgatacagacaacagcgctagcaccaaaaacaagcaatggccctgccttgaggaatgaggaatgattggtgctagcgcataggcttcaagtagcttatgtgctagcacaacctgtgcctagctcctttcatcggacagtacttgctagagaaaagttccagcaatgtaacatttcatcagtaacatcagcagctagatcactgacaaatattaagtgatcagaaggtacttctgaccgcttttcacccatgtgatatgatgctcagttcaacttagatacctggtcagtgtttggcatcacatgatcataaaaatcctgaagagccttttctgctaatgcatgagaaaagaactcaacaaatccatacccctctaactgtcatgtttgcctattgcagataacttttattgtaatcacctacaaaaatataagatagcaaaatataataagattacaagtcaaaaagttttggaagcacaaacacacataaacagaaagaagaaatagtaagtgatgcttgattagcattaacctcatatctatctgattcctattagctaatactcctagctagtaaaaggatacatacaagtcgctttgtccatatatttttgtgcatgttgcttctcttgatttatcaccaccggcaccccgctacatagcagggtcagtggtggctctcgcgtagcatggaagttcactcacaactctaccagtaaactgagcatgctaaaccgttaatgaaaaaccaacaaacatgagattcagcatggaagctcactcacaattctaccactaaactgagcatgctaaactgttaatgaaaaacaaacaacatgagattcagcatggaagctcactcacaactctaccagtaaactgagcatgctaaactgttaatgaaaaacaaacaacatgagattcagcatggaagctcactcacaactctaccagtaaactgagcatgctaaactgttaatgaaaaacaaacaacatgagattcgcagataacatcagcaatcagcaacggataaatgtaaaagtacagtgtccatacctattgtaattgtaataaaacaaagacaaagaaaggagcaaggatcaataaaacttacatgctgaaatagccctgccacttggcatcatgcacacagggacaaaaaacgaaaaaaaaacatgttagatttagtctccaatcaggcacatgaacagactactgatatgttaatattcatacaagttaagggatataactttaaaatacaatgttgtaacttctagtgttatttctgattctctccctagattgcaattgagtatctccataatcatcacgacaatctgcataccgataaccaacatctttttcttgaggaaagtcccatttaaatctcagatttcttgatgaattacactcattgcacaagaatgagcttagttcaatcaaacatgctaagatacacagaaaactaccaaaatttaacaaaactctatccacatgtactgaaatgtaagctcccaaattcaaaatatgtacttctagcttcacatcaaatgcaagagctctagatccatacatttcaagaccaagtcatcaaaacgagaaggaagtcacactgaagcacttccatacaagactgtaggatggactcggccactgcgaaatcgagcagtcgcagcccgacagcggccatgagccgcaccttggtgttgtgcccctggccgtcgaggatggatccccgtcaacgtgagccacccacgcagggaggaaagcgactctagaacaagagagctaagaagtggttggaatttttgtttctgttatttcatatctctaacgcttatagattgttccatttatatcctactggccataggtctacaaactccagctaaattacaaccaggacacagctggatacagctcagaactaatactaagcacttattgactcagttggaagcacaaacacacataaacagaaagaagaaatagtaagtggtgcttgattagcattaacctcatatgtatctgattcctattagctaatacacctagctagtaaaaaggatacatacaagtcgctttgtccatatatttttgtgcatgttgcttctcttgatttatcaccaccggcaccccgctacatagcagggtcagtggtggctctcgcgtagcatggaagctcactcacaactctaccagtaaactgagcatgctaaactgttaatgaaaaacaaacaacatgagattcagcatggaagctcactcacaactctaccagtaaactaagcatgccaaactgttaatgaaaaacaaacaacatgagattcgcagataacatcagcaatcagcaacggataaatgtaatagtacagtgtccatacctattgtaattgtagtaaaacaaagacaaagaaaggagccaggatcaataaaacttacatgctgaaatagccctgccacttggcatcatgcacacagggacaaaaaacgaaaaaacatgttagattcagtctccaatcaggcacatgaatagactactaatatgttaatattcatacaagttaagggatataactttaaaatacaatgttgtaacttctagtgttatttctgattctctccctagattgcaattgagtatctccataatcatcacgacaatctgcataccaataaccaacatctttttcttgaggaaagtcccatttaaatctcagatttcttgatgaattacactcattgcacaagaatgagcttagttcaatcaaacatgctaagatacacagaaaactaccaaaatttaacaaaactctatccacatgtactgaaatgtaagctcccaaattcataatatgtacttctagcttcacatcaaatgcaagagctctagatccatacatttcaagaccaagtcatcaaaacaagaaggaagtcacactgaagcacttccctacaagactgtaggatggactcggccactgcgaaatcgagcaatcgcagcccgacagtggccatgagctgcaccccgcaccttggtgttgtgcccctggccgtcgaggatggatccccgtcgacatgagccacccacgcagggaggaaagtgactccagaacaagagagctaagaagtggttggaatttctgtttctgttatttcatatctctaacgcttacagattgttccatttatatcctactggccataggtctacaaactccagctagattacaactaggacacagctggatacagctcagaactaatactaagcacttactgactcgggtgtcactatagatcaccacacct

SEQ ID NO: 817 - DNA, 4290 bp, Zea mays
aacaaaagaattaaatatagaaaaaatttcattccaattttaattacaatttgctctatgcgagactataaataatactagtttaggcatgctatcttaaaccatatgtagtgctattttatatatttcttggttatggacaacaatgcatgttttgaggccactcaaaaaacaagtatgggactcatgatatttactacaaaacaatttaaccaatgaaaattacattacaatttgctctttgccaaattgtaaacattacttgtttgggcatgttatctcataagatatgtggagaaatttcaaatgtttcatggttatggacattaatgtaagtttgaagacgttcaaggccctaaatgatgtaatgtttagaatgaaagtttttacaaaaacgacccaacaaggtttgtcatcaaagtttttgcaatacaatgatttgggagtaaatggtcatgatttcgtgcatgttttcttgaaaagattgtggcatgaaccatgcaaaaactttgaagctttttgaagccctaaattatgtggtagatttatagaatgatccaaaatgttgtttcacacgctccaccagcaactaaaattcaacacaatcaaaacttgagtgtgggacccacataattagatggtcacatgccgattaaagttcagtattttgaagaatggggtaactttaaaagtatttgaattgtaatatgcagttttttcaagataaatgattttgcagagttacgacctatattaaaggaaaaatagttaatggaagaaaaattatatttccacttttattactcttttccaaatgtcgtactgtaagacatacttgtttaggcatgttaccttaaaacatagacaacctatcgcatgagtttgaggcccaagatattggatgttcgaatgctggcactagagtttgtaattttctggaattgagagcaatatttatgcaattctgcttttattttgatccatgttttaagattctttgttattattctattacatttatatcaatttataataaaagaattaaatatagaaaaaatttcattccaattttaattacaatttgctctatgcgagactataaacaatactagtttaggcatgctatcttaaacaatatgtagtgctattttatatatttcttggttatggacaacagtgcatgttttgaggccactcaaaaaacaagtatgggactcatgatatttattacaaaacaatttaaccaaggaaaattatataacaatttgctctttgccaaactgtaaacatcacttgtttgggcatgttatctcataagatatgtggaaagatttcaaatgtttcatggttatggacattaatgtaagtttgaagcggttcaaagccctaaatgatgtaatgtttagaatggtagtttttacaaaacgacccaacaaggtttctcatcaaagttttcgcaatacactgatttgggagtgaagggtcatgatttcgtgcatgttttctcgaaaaggttatgtcatgaaccatgcgaaaactttgaaactttttgaagccctaaattatgtggtagatttatagaatgatccaacatgttgtttcacatgctccaccagcaactaaaattcaacacaatcaaaacatgagtatgggacccacataattaaatggtcgcatgtcgattaaagttcagtgttttaaagaaagatgtaattttaaaagtatttgaattgcaatatgcaaatttttcaagatcaactattttgcagagttacgacctctattaatggaaaatagttaatggaagaaaaattatatttccacttccattactcttttctaaatgtcgtattataatacatacttgtttaggcatgttaccttaaaacatatataatgctatttgcaatgttccttagttgtgaacacatcaatccaagtttagggcacatcaaaacattagtatgggactaatgggtattaattttgtgcaagtttaatgcatgatatatcgatttctgatgtgcgtcaacttcgaagcattttgatgccctaaatattgtattgtttagaaagacagcttttgcggatggacccaacttgttgttttgcatgcaccataattaatccatgtacaaggcaaccataacatgagtatgcgaccctagattgtcgcatgctagcactagatttggtcatatgaaagatgaggtcactctagaagcgattgaagcataacatgtagattattttcagatcatcaatttattatttgcgtgagctatccaacatgttgtttcacatgcttgatcatcaacccaactgcaagacaacttatagcatgagtttggggcccaagatattagatgttcgaatgctggcactagagtttgtagatatgaagaatgaggtaactttggaaatgtttaaagtgcaacatgtatattttttggatcggtaattttccggagttgagagctatatttatgcaatcatgcttttatttcggtccatgttttaagatactttgttattattctattacagttataccaatgatatttataacaaaagaatgaaatatcgaaaaaatttcatttcaattttaattacaatttgctttatgcgagactataaacaatactagtttaggcatgctatgttaaaccatatgtagtgctattttaaatgattcttggttatggacaacaatgcatattttgagaccactcaaaaaacaagtatgggactcatgacatttatcacaaaacaatttaagcaaggaaaattacattacaatttgctcattgccaaactataaacatcacttgtttgggcatgttatctcataagatatgtggaaagatttcaaatgttttatggctatggacattaatgtaagtttgaagacgttcaaagccctaaatgatgtaatgtttagaacggtagtttttacaaaaatgtcccaacaagatttgtcatcaaagttttcgcaatgcactgatttgggagtaaagggtcatgatttcgtgcatgttttctcgaaaagattgtggcatgaaccatgcgaaaactttgaagcttttcaaagccctaaattatgtggtagatttatagaatgatccaacatgtttcatcaatctactataggcatgagctatccaacatgttgttttacatgcgtcatcatcaaacctagtgcaagacaaactatagcttgagtttggggcccaagatattagatgtttgaatgctggcactatgaagaatgaggtaactatagaaatgtttaaagtgcaacatgtatattttttagatcagtaattttccggagttgacaactatatttatgtaattctgcttttattctattacagttatatcaatgatatttataacaaaataattaaatatagaaaaaaatttattccaattttaattacaatttgctatatgccagaccataaacaatactagtttaggcatgctatcttaatccatatgtagtgttattttaattgattcttggttatagacaataatgcatgttttgaggctactcaaaaaacaagtatgggagatatttatcacaaaacaacttaaccaaggaagattacattacaatttgctcattgccaaactataaacatcacttgtttggacttgttatctcataaaatatgtaaaaatatttcaaatgtttcatggttatgaatattaatgtaagtttgaagcggttcaaagccataaatgatgtaatgtttagaacggtagtttttacaaaaaggacccaaaaaggtttgtcatgaaagttttcgcaatacactgatttgggagtaaaggttcatgattccgtgcatgttttctcgataaagattgtggcatgaaccatgcgaaaactttgaagcttttcgaagcactaaattatgtggtagatttatagaatgatccaacatgctgtttcacacgctccaccatcaactaaaatttaacacaatcaataacttgagtatgggacccacataattagatggccgcatgacgattaaagttcaatgttttaaagaatgaggtaactttaaaagtatttgaattgcaatatgtagatttttcaagataaactattttgcagaattacgacctctattaacggaaaaatagttaatggaagaaaatttatattttcactttcattactcttttctaaatgtcgtactgtaagacatacttatttaggcatgttaccttaaaacatatatagtgctatttgcaatgttcctcagttgtaaa

SEQ ID NO: 818 - DNA, 4234 bp, Zea mays
ccaaacaagtgatgtttacagtttggcaatgagcaaattttaatgtaattttcctaggttaaattgttttatgataattgttttttgagtggcctcaaaacatgcaatattgtccataaccaagagtcatttaaaatagcagtacatatggtttaacataacatgcctaaactagttttgtttatagtctggcatagagcaaattgtacttaaaattggaatgaaattttttctatatttaattcttttgttactaatatcattggtataattgtaacaaaataataacaaagtattttaaaacatggatcaaaataaaagcacaattgcataaatatagctctcaactccggaaaattacagatctaaaaaatatacatgttgcactttaaacatttctaaagttacctcgttctccatatctaccaactctagtgcctgcattcgaacatctaatatcttgggccccaatctcatgctataagttatcttgcacttaggttgatgatgaaggaggtgaaacaacatgttggatagctcacgcctatagtaaattgatgatctgaaaaatatctatattttatgcttcaagcgcttctagagtcccctcgtcctttatacgattaaatccagtgctagcatgcgacaatctagggtcgcatactcatgttatggttgtcttgaaaatgggttaatgatggtgcacgcaaaacaacaagctgggtccatccataaaaactatctgtctaaacaatacaatattagggctttaaaatgcatggaagttgatgcacattagaaataaatatatcatgtagtaaacttgcacgaaattaatacacattagtcccatactcaagttttgatcggccttaaacttgagttgatgtgttcacaactgaggaacattgcaaataacactatatatgttttaaggtaacatgcataaataagtatgtcttacaatacgtcatttagaaaagagtaatgaaagtgaaaatataatttttcttccattaactatttttccgttaaaagaggtcgtaattctgcaaaatagtttatcttgaaaaatctgcatattgcaattcgaatacttttaaagttacctcattctttaaaacattgaactttaatcgtcatgcgaccatctaattatgtgggtcccatactcaagttattgattgtgttaaattttagtttatggtggagcgtgtgaaacaacatgttggttcattctataaatctaccacataatttagtgcttcgaaaagcttcaaagtttttgcatggttcatcccacaatcttttcgagaaaacatgcacgaaatcatgaccctttactcccaaatcagtgtattgcgaaaactttgatgacaaacctttttgggtcctttttgtaaaaattaccattctaaacattacatcatttagggcaatgaaccgcttcaaactgacattaatgtccacaaccatgacacaatttaaatctttccacatattttatgaggtaacatgtccaaacaggtgatgtttacagtttggcaatgagcaaattgtaatgtatttttccttggttaatttgttttgtgataaatatcatgagtcccatacttgttttttgagtggcctcaaaacattcattattgtctataaccgagaatcatttaaaatagcactacatatcgtttaagatagcatgcctaaagtagtattgtttagagtctggcataatgcaaattgttattaaattggaataaatttttttctgtgtttaattcttttgttataaatatcattgatataactgtaatagaataataacaaagtatcttaaaacatggatcgaaataaaagtagaattacattaatatagctgtcaactccggaaaattaccaatctaaaaaatatacatgttgcactataaacatttctaaagttacctcattcttcatatctacaaactctagtgccagcattcgaacatctaatatcttgggccccaaactcatgctataggttgtcttacacttaggttgatgatgaagcatgtaaaacaacatgttggatagctcacgcctatagtaaattgatgatctgaaaaagatctacaagttatgcttcaagctcttctagagtcaccgtatcattcatatgactaaatctagtgctagcatgcgacaatctagggtcacatactcatgttatggttgtcttgaacatgggttaatgatggtgcatgcgaaacaacaagttgggtccatccgtaaaaactgtctgtctaaacaattcaatatttagggcatcaaaatgcatcgaagttgacgcacatcagaaatcgatatatcatgcagtaaacttccacgaaattaatgcccattagtcccatacttatgttttgatcggccttaaacttggtttgatgtgttcacaactgaggaacattgcaaataacattatatatgtgttaaggtaacatgcctaaacaagtatgtcttacagtacgacatttagaaaagagtaatgaaagtgaaaatataatctttcttccattaattatttttccgttaatagaggtcgtaactctacaaaatagtttatcttgaaaaatctgcatattgcaattcaaatacttttaaagttacctcattctttgaaacattgaactttaatcggcatgcgaccatctaattatgtgggtcccttactcaagttattgattctgttgaattttaggtgatggaggagcgtatgaaacatgttggataattctgtaaatctaccacataatttagggctttgaaaagcttcaaagttttcgcatggttcatgccaaaatctttttgagaaaacaagcacaaaatcatgaccctttactcccaaatcagtgcattgcgaaaactttgatgacaaatcttgttgggacatttttgtaaaaactaccgttctaaacattacatcatttagggctttgaacggcttcaaacttacattaatgtccataaccatgaaacatttgaaatctttcaacatatcttatgagataacatgcccaaacaattaatgtttacagtttggaaatgaaaaaattgtaatgtaattttccttggttaaatagttttgtgataaatatcatgagtcccatacttgttttttgagtggcctcaaaatatgcgttgttgtccataaccaagaaccattaaaaatagtgctacatatggtttaagatagcatgcctaaactattattgtttatagtctagcatagagcaaattgtaattaaatttggaatgaaattttttctatacttaattcttttgttataaatatcattgatataactgtaatagaataataacaaggaatcttaaaacatggatcgaaataaaagcagaattgcataaatatggctctcaactccggaaaattatcgatctaaaaaatatacatgttgcactttaaacatttctaaagttacctcattcttcatatctacacacgatagtgccagcattcaaacatccaatatctcgggccccaaactcattctataggttgtcttgcacttgggttgatgatgaagcatgtgaaacatgttgcatagctcacgactatagtaaattgatgatctgaaaaaaaatctacatgttgtgcttcaagcgcttttagagtcaccatccttcatatgaccaaatctagtgctagcatgtgacaatctagggtcgcatactcatgatatggttgtcttaaatatgggctaatgatggtgcatgcgaaaaaaacaagttgggcccatccataaaaaatgtctgtctaaacaatacaacatttagcgcttcaaaatgcatcgaagttgacgcacatctgaaatcgatatatcatgcagtaaacttgtaagaatataatacccattagtcccatactcatgttttgatcggccttaaacttgggttgatgtgttcacaaatgaggaacaatgtaaatagcactatatatgtttttaatgtaacatgcctaaacaagtacgtcttataggacgacatttagaaaagagtaatgaaagtggaaatataatttttcttccattagctatttttccatcaatagaggtcgtaactctgcaaaatagtttatcttgaaaaatctgcatatagcaattcaaatacttttaaagttatctcagtctttaaaacactgaactttaatcggcatgcgaccatctaattatgtggg

SEQ ID NO: 819 - DNA, 4214 bp, Zea mays
aagaatcttaaaacatggatcgaaataaaagcagaattgtagaaatatagctctcaactccggaaacttaacgatctaaaaatatacatgttgcactttaaacatttctaaagttacatcattcttcatatctacaaactatagtggcagcattcgaacatccaatatcttgggcctcaaactcatcctataggttgtcttgcacttaggttaacatgttgcatagctcacacctatagtaaattgatgatccgaaaaatctacatattgtgcttcaagcgcttttagagtcacctcatcctttatatgaccaaatctactgcaagcatgcgacaatctagggtcgcatactcatgttatggttgtcttgaacatgtgttaatgatggtgcatgcgaaacaacacgttggttccatctataaaaactgtctgtctaaacaatacaacatttagggcttcaaaatgcttcgaagttgacgcacatcagaaatcgatatatcatgcagcaaacttgtacgaattaatacccattagtcctatactcatgttttgatcggccttaaacttgggttgatgtgttcacaactgaggaacattgcaaatagcactatatatgtttttaaggtaacatgccttaacaagtatgtcttttagaaaagagtaattaaagtggaaatataaattttcttccattaactatttttccattaatgaaggccgtaactctgcaaaatactttatcttgaaaaatttgcatattgcaattcaaatacttttaaagttacctcattctttaaaacactgaactttaatcggcatgcgagcatctaattatgtgggtcccatactcaagttattgattatgttgaattttagttgttggtggagcgtgtgaaacaacatgttggatcattatgtaaatctaccaaataatttagggcttcgaaaagcttcaaagttttcgcatggttcatgccacaatcttttcgaaaaaacatgcacagaatcatgacagtttactcccaaatcagtgtattccaaaaacattgatgacaaatcttgttgggtcatttttgtaaaaactaccattctaaacattatgtcatttagggctttgaaccgcttcaaacttacattaatgtccataaccatgaaacatttgaaatctttccacatatcttatgacataacatgcctcaacaattaatgtttgcagtttggcaatgagtggactcaaaatatgcattgttgttcataatcaagaattatttaaaatagcactacatatggtttaaaatagcatgcctaaactaatattgtttatagtctcgcatagagcaaattgtaattaaaattggaatgattattttttctatatttaattcttttgttgtaaatatcattgatataactgaaatagaataataacaaagtatcttaaaacatggatcaaaataaatgcataattgcataaatatagctctcaacagtggaaaattaccgatctgaaaaatatacatgttgcactttaaacatttctaaagttacctcattcttcatatctacaaactctagtgccagcattcgaatatccaatatcttgggccccaaactcatgctataggttgtgttgcacttgggttgatgatgaagcatgtgaaacaacatgttggatagctcacgtctatagtgaagtgggtgatctgaaaaaatctacatgttatgcttcaagcgcttctagagtcacatcatccttcatatgaccaaatctagtgctagcatgctacaatctaaggtcgcatactcatgttatggttgtcttgaacattggttaatgatggtgcatgcgaaacaataagttgggtccatctgtaaaactgtctatctaaacaatacaacatttagggcttcaaaatgcatcgaagttgacgcacatcaaaaatcgatatatcatgcagtaaacttatatgaaattaatacccattagtctcatactcatgttttgattggctttaaacttaggttgatgtgttcacaactgaggaactttgcaaatagcacaatatatgttttaaggtaacatgcctaaacaagtttgtcttatagtacgacatttagaaaagagtaatggaagtggaaatataaattttcttccattaactatttttccattaatagaggtcataactctgcaaaataatatatcttgaaaaatctgcatattgcaattcaaatacttttaaagttacctcattcttgaaaacactcaactttaatcggcatgcgaccatctaaatatgtgtgtcccatactcaagttattgattgtgttgaattttagttgatggtggagcgtgtgaaacaacatgttggatcattctgtaaatctaccacataatttagggcatcaaaaagcttcagagtttttgtatggttcatgccacaatcttttcgagaaaacatgcacgaaatcatgaaccttttactcacaaatcagtgtattgcaaaaacattgatgaaaaaccttgttgggtcctttttgtaaaaactaccgttctaaatattacatcatttagggctttgaagcgattcaaacttacattaatgtccataaccatgaaacatttgaaaattttcaacgtatcttatgagataacatgccaaaagaagagatatttacagtttggcaatgagcaaattgtaatgtaattttccctggataaattgttttgtgataaatatcatgtgtcccatagtttttttagtgtcctcaaaacctgcattgttgtccataaccaggaataaaataacactacatatagtttaagatagcatgcctaaactatttttgtttatagtccgatataaaagcaaattgtaattaaatatggaatgaattttttctatatttaattattttgttataaatatcattgatataactgtaatagaataataacaaagaatcttaaaatatggatcgaaataaaagcagaattgtataaatatagctctcaactctggaaaattaccgatcgaaaaaatatatgtgttgcactttaaacatttctaaagttacctcattcttcatatctacaaactatagtgctagcattcgaacacccaatatcttggtccccaaactcatgctataggttgttttgcacttgggttgatgatgaagcatgtgaaagaacatgttgcatagctcacgcctatagtaaattgatgatctgaaaaaaatctacatgttgtgcttcaagagcttttagagtcacctcatccttcatatgaccaaatctagtgctagcatgcgacaatccagggtcgcatactcatgttatggttgtcttgaacatgggtaaatgatggtgtatgcgaaacaacacattgggtccatgcgtaaaaactttctgtctaaacaatacaacattatatttagggcttcaaaatgcatcgaagttgatgcacatcagaaatcgatatatcatgtagcaaacttgttcgaatataatacccattagtcccaaactcatgttttgatcggccttgaacttgggttgaagggttcacaactgaggaacgttgcaaataacacaatacatgtttcaaggtaacatgactaaacaagtatgtcttacagtatgacatttagaaaagagtaatgaatgtggaaatataaattttcttccattaacttttttccattgacagaggtcgtaactctgcaaaatagtttatcttgaaaaatctgcatattgcaaatcaaatacttttaaagttacctttttctttaaaacattgaactttaatcggcatgcgaccatctaattatgtgggtcccatactcaagttattgattgtgttgaattttagttgatggcggagcatgtgaaacaacatgttgtatcattctgtaaatctaccacataatttagggcatcaaaaagcttcaaagttttcgcatgtttcatgccacaatcttttcgagaaaacatgcacaaaataatgaccctttactcacaaatcagtgtattgcgaaaacattgatgacaaaccttgttggctcatttttgtaaaaactaccattctaaacattacatcatttagggctttgaactgcttcaaacttacattaatttccataaccatgaaacatttgaaaattttctacatatcttatgagataacatgcccaaacaagtgatgtttatg

SEQ ID NO: 820 - DNA, 4188 bp, Zea mays
cccacataattagatggtcgcatgccgattaaagttcagtgttttaaagagtgagataactttaaaagtatttgaattgctatatgcagatttttaaagataaactattttgcagagttacaacctctattaatggaaaaatagctaatggaagaaaaattatatttccactttcattactcttttctaaatgtcgtcctataagacatacttctttgggcatgttacattaaaaacatatatagtgctatttacaatgttcctcacatcaacccaagtttaaggccgatcaaaacatgagtatgggactaatgggtattatattccgtacaagtttactgcatgatatatcgatttcagatgtgcgtcaacttcgatgcattttgaagcgctaaatgttgtattgtttagacagacattttttacggatgggcccaacgtgttgtttcgcatgcaccatcattagcccatattcaagacaaccatatcatgagtatgcgaccctagattgtcacatgctagcactagatttagtcatatgaaggatggtgactctaaaagcgcttgaagcacaacatgtagatttttttcagatcatcaatttactatagtcgtgagctatgcaacatgttgcacatgcttcatcatcaacccaagtgcaagacaacctatagaatgagtttgggtcccgagatattggatgtttgaatgctggcactaaagtttgtagatttgaagaatgaggtaactttagaaatgtttaaagtgcaacatgtatattttttagatcgataattttccggagttgagagccatatttatgcaattctgcttttatttcgatccatgttttaagattccttgttattattctattacagttatatcaatgatatttataacaaaagaattaagtatagaaaaaatttcattccaaatttaattacaatttgctctatgctagactataaacaataatagtttaggcatgctatcttaaaccatatgtagcgctatttttaatgattcttggttatggacaacaatgcatattttgaggccactcaaaaaacaagtatgggactcatgatatttatcacaaaacaatttaaccaaggaaaattacattacaattttttcatttccaaactgtaaacattacttgtttgggcatgttatctcataagatatgtggaaagatttcaaatgtttcatggttatggacattaatgtaagtttgaagccgttcaaagccctaaatgatgtaatgtttacaacggtagtttttacaaaaatgtcccaacaagatttgtcatcaaagttttcgcaatgcactgatttgggagtaaagggtcatgatttcgtgcatgttttctcaaaaagattgtggcatgaaccatgcgaaaactttgaagcttttcgaagccctaaattatgtggtagatttacagaatgatccaacatgtttcatacgctcctccatcacctaaaattcaacacaatcaataacttgagtaagggacccacataattagatggtcgcatgccgattaaagttcaatgtttcaaagaatgaggtaactttaaaagtatttgaattgcaatatgcagatttttcaagataaactattttgcagagttatgacctatattaacggaaaaatagttaatggaagaaagattatattttcactttcattactcttttctaaatgccgtactgtaagacatacttgtttaggcatgttaccttaaaacatatatagtgttatttgcaatgttcctcagttgtgaacacatcaaaccaagtttaaggccgatcaaaacataagtatgggactaatgggtttaatttcgtggaagtttactgcatgatatatcgatttctgatgtgtgtcaacttgatgcattttgatgccctaaatattgaattgtttagacagacagtttttacggatggacccacttgttgtttcgcatgcaccatcattaacccatgttcaagacaaccataacatgagtatgtgaccctagattgtcgcatgcttgcactagatttagtcatatgaatgatacggtgactctagaagcgcttgaagcataacttgtagatctttttcagatcatcaatttactataggcgtgagctatccaacatgttgttttacatgcttcatcatcaacctaagtgtatgacaacctatagcatgagtttggggcccaagatattagatgttcgaatgctggcactagagtttgtagatatgaagaatgaggtaactttagaaatgtttatagtgcaacatgtatattttttagattggtaatttttcggagttgacagctatattaatgtaattctgcttttatttcgatccagagattttgtatagttatatcaatgatatttataacaaagaattaaatacagaaaaaatttattctaatttaattacaatttgcattatgctagactctaaacaatactagtttaggcatgctatcttaaaccatatgtagtgctgttttaaatgattcttggttatagacaataattcatgttttgagtccactcaaaaaacaagtatgggactcatgatatttatcacaaaacaaattaaccaagaaaatacattacaatttgctcattgccaaactgtaaacatcacttgtttggacatgttacctcataaaatatgtggaaagatttcaattgtttcatggttgtggacattaatgtcagtttgaagcggtttaaagccctaaatgatgtaatgtttagaatggtaatttttacaaaaaggacccaaaaaggtttgtcatcaaagttttcgcaatacattgatttgggagtaaagggtcatgatttcgtgcatgttttgtcgaaaagattgtgggatgaaccatgcaaaaactttgaagcttttcgaagcactaaatgtggtagatttatagaatgaaccaacatgttgtttcacacgctccaccataaactaaaatttaacacaatcaataacttgagtatgggaccacataattagatggtcgcatgacgattaaagttcaatgttttaaagaatgaggtaactttaaaagtattcgaattgcaatatgcagatttttcaagataaactattttgcagaattacgacctcttttaacggaaaaatagttaatggaagaaaatttatttttactttcattactcttttctaaatgacgtattgtaagacatacttatttatgcatgttaccttaaaatatatagtgttatttgcaatgttcctcagttgtgaacacatcaacccaagtttaaggctgatcaaaacttgagtatgggactaatgtgtattaatttcgtgcaagtttactacatgatatatcgatttctgatgtgcatcaacttccatgcattttaaagccctaatattgtattgtttagacagatagtttttatggatggacccagcttgttgttttgcgtgcaccatcattaacccattttcaagacaaccataacatgagtatgcgaccctagattgtcgcatgctagcactagatttaatcgtataaaggacgagtggactctagaagcgcttgaagcataacatatagatttttttcagatcatcaatttactataggtgtgagctatccaacatgttgtttcacatgcttcatcatcaaccgaagtgcaagacaacttatagcatgagattggggcccaagatatagatgttcgaatgcaggcactagagttggtagatatggagaacgaggtaactttagaaatgtttaaagtgcaacatatatattttttagatctataattttccggagttgagaggtatatttatgcaattgtgattttattttgatccatgttttaaaatactttgttattattctattacagttataccaatgatattagtaacaaaagaattaaatatagaaaaaaatttcattccaattttaagtacaatttgctctatgccagactataaacaaaactagtttaggcatgttatgttaaaccatatgtagtgctattttaaatgactcttggttatggacaatattgcatgttttgatgccactcaaaaaacaattatcataaaacaatttaaccttggaaaattacattacaatttgctcattgccaaactgtaaacatcacttgtttgg

SEQ ID NO: 821 - DNA, 3999 bp, Zea mays
gtatattttttagatctgtaattttccagagttgagagctatatttatgcaattctgcttttatttcgatccatgttttaagattctttgttattattctattacagttatatcaatgatatttataacaaaataattaaatatagaaaaaatcattccaattttaatttcaatttgcattatgccagaccataaacaataatagtttaggcatgctatcttatactttatgtagtgctattttaaatgattcttggttatggtcaacaatgcatgttttgaggccaatcaaaaaacaagtatgggactcgtgaaatttatcataaaacaatttaaccaaggaaaattacattacaatttgctcattgccaaaatgtaaacacatcacttgttttggcatgttatctcataagataagtggaaaattttgaaatgtttcatggatatggacattaatgtaagtttgaatcagttcaaagccctaaatgatgtaatgtttagaatggtagtttttacaaaaggatccaacaaggtttgtcatcaaagttttcgtaatacactgatttgtgagtaaaaagagtcatgatttcgtgcatgttttctcgaaaagattgtggcatgaaccatacgaaaacactaaagcatttcaaaaccctaaattatgtggtagatttacgaaatgatccaacacgttgtttcacacactccactatcaactataattcaacacaatcaataacttgagtatgggacccacataattagatggtcgcatgccgattaaagttgagtgttttcaagaatgaggtaacttcaaaagtatttgaattgcaatatgcagatttttcaagataaactattttgcagagttacgacctatattaatggaaaatagttaatggaagaaaatttatatttctactttcattactcttttctaaatgtcgtactgtaagacatacttgtttaggcatgttaccttaaaacatatattgtgctatttgcaacgttcctcggttgtgaacagatcaacccaagtttaaggccgattaaaacatgagtatgggactaatgggtattatattcgtacagtttgttgcatgatatatcgatttttgatgtgcgtcaactttgatgcattttgaagcccaaaatgttgtattgtttaaacagacaggttttacggatcgacccaatgtgttgtttcgcatgtaccatcattaacccatgttcaagacaaccataacatgagtatgagaccctagattgttgcatgctagcactagatttggtcatatgaaggatgaggtgactctaaaagcgcttgaagcacaacatgtaggtttttttcagatcatcaatttactataggcgtgagttatgcaacatgttgtttcacatgcttcatcatcaacccaagtgcaagacaacctatagcatgagtttggggaccaagttattggatgttcgaatgctggcactatagtttgtagatatgaagaatgaggtaactttagaaatgtttaaagtgcaacatgtatatttttagatcggtaattttccagagttcagagctatatttatgcaattcttcttttattttgatccatgttttaagattctttgttattattctattacggttatatcaatgatatttataacaaaagaattaaatatagaaaaaaatttcattccaattttaattacaattttctctatattagactataaacaataatagtttaggcaagctatcttaaaccatatgtagtactattttaaatgattcatggttatggacaacaatgcatgttttgacgctactcaaaaaacaagtatgggactcataatatttatcactaaacaatttaacctaggaaaaattacgttacaatttgctcattgccaaactgtaaatatcacttgttttggcatgttatctcataagatacatggaaaatattcaaatgtttcatggttatggacattaatgtcagtttgaatcagttcaaagccctaaatggcttaatgtttagaacggtagtttttacaaaaaggacccaacaaggtttgtcatcaaagttttcgcaatacactaatttgtgagttgaagggtcatgatttcgttcatgttttctcgaaaagattgtggcattaaccatacaaaaactctgaagcttttcgaagccctaaattatgtggtagatttaaagaatgatccaacatgttgtttcacacgctccaccatcaactaaaattcaacacaatcaataacttgagtatgggaccacatatttagatggtcgcatgccgattaaagttcagtgttttaaagaatgatgtaactttaaaagtatttgaattgcaatatgcagatttttctagataaactattttgcagagttacgacctctattaatggaaaaataattaatggaagaaaatttatatatccactttcattactcttttctaaatgtcatcctgtaagacatacttgtttaggcatgttaccttaaaaacatatatagtgctatttacaatgttcctcagttgtgaacacatcaacccaagtttaaggtcgatcaaaacatgagtatgggactaatgggtattatattcgtacaagtttactgcatgatatatcgatttcagatgagcgtcaacttcgacgcattttgaagcgctaaatgttgtattgtttacacatacatttttttacggatggacccaacgtgttgtttcacatgcaccatcattaacccatgttcaagacaaccatatcatgagtatgtgaccctagattgtcacatgctagcactagatttggtcatatgaaggatggtgactctaaaagcgcttgaagcacaacatgtagattttttcagatcatcaatttactatagtcgttagctatgcaacatgttgtttcacatgcttcatcatcaacccaaatgcaagacaacctatatcatgagtttggggcccaagacattggatgtttcaatgctggcactatagtttgtagatataaagaatgaggtaactttagaaatatttaaagtgcaacatgtatattttttagatcggtaattttccggagttgagagccatatttatgaaattctgcttttatttcgatccatgttttaagattcctttttattattctattacagttatatcaatgatatttataacaaaagaattaagtatagaaaaaaattcattccaattttaattacaattggctctatgctagactataaacaataataatttaggcatgctatcttaaaccatatgtagcgctatttttaatgattcttggttatgaacaacaatgcatattttgaggccactcataaaacaagtatgggactcatgatatttatcacaaaacaatttaaccaaggaaaattacattacaattttttcattgccaaaccataaacatcacttgtttgggcatgttatctcaaatgtttcatggttatggacataaatgtaagtttgaagcggttcaaagccctaaataatgtaatgtttagaacggtagtttttacaaaaatgactcaacaagttttgtcataaaagtttttgcaatactctgatttgtgagtaaagggtcattatttcgtgcatgttttctcgaaaagattgtggcatgaaccatgcgaaaactttgaagctttttgaagccctaaattatgtggtagatttacagaatgatccaacatgttgtttcacatgctccaccatcaactaaaattcaacacaatcaataacttgagtttgggacccacataattagatggtcgcatgtcgattcaatttcagtgtttttaagaatgaggtaactttaaagtatttgaattgcaatatgcagattttcaagataaactattttgcagagttacgacctctattaatggaaaaataattaaaggaagaaaatttatacttccactttcattactcttttctaaatgtcgt

SEQ ID NO: 822 - DNA, 3971 bp, Zea mays
gtcatactataagacaaacttatttaggcatgttaccttaaaacacatattgtgctatttgcaacgttcctcaattgtgaacacatcaacccaagtttaaggccaatcaaaacatgagtatgtgactaatgggtattaatttcatataagtttattgtatgatatatcgattttttatgtgcgtcaacttcgatgcattttgaaaccctaaatgttgtattgtttagacagacagttttatggatggacccaacttcttgtttcgcatgcaccatcattaaccaatattcaagacaaccataacatgagtatgcgaccctagattgcagcatgctatcaatagatttggccaaatgaaggatgaggtgactctagaagcgcttgaagcataacatgtagatttttttcagatcatcactttactatagacgtgagctatccaacattttgtttcacatgcttcatcatcaccccaagtgcaagacaacctatagcatgagtttcgggcacatgatattggatattctaatgctggcactagagtttgtacatatgaaaaatgaggtaactttagaaatgtttaaagtgcaacatgtatattttttagatcggtaattttccagagttgagagcaatatttatgcagttctgcttttatttcgttctatgatttaagatactttgttattattctattacaattatatcaatgatatttataacaaaagaattaaatatagaaaaaaattcattccaattttaattacaatttgctctatgccagactataaacatattagtttaggcacactattttaaaccatatgtagtgttatttaaaaaaattcttggttatgaacaaaaatgcatgttttgaggccactcaaaaaacaagtatgggactcatgatatttatcacaaaacaatttaaccaaggaaaattacattacaatttgctcattgctaaactgcaaacatcacttgtttagacatgttatctcataagatatgtggaaagatatcaaatgtttcatggttatgaacattaatgtaagtttgaagcggttcatagccctaaatgacgtaatgtttagaacgatagtttttacaaaaatgacccaacaagatttgtcattaatgttttcgcaatacactgatttgggagtaaagtgtcatgatttcgtgcatgtttttttccaaaagattgtggcatgaaccatgcgaaaactttgaagcttttcgaagccctaaattatttggtagatttactgaatgatccaacatgttgtttgacacgctccaccaataactaaaattcaacacactcaataacttgagtataggacccacataattagagggttccataaagattaaagttcagtgttttaaagaattaggtaactttaaaagtatttgaattgcaatatgcagatttttcaagataaaatattttgcagagttacagcctctattaatggaaaaatagttaatgaaagaaaatttatatttccactttcattaatcttttctaaatgtcatcatgtaagacatactttttaggcatgttaccttaaaaacatatatagtgctatttgcaatgttcctcagttgtgaacacatcaacccaagtttaaggctgatcaaaacatgagtatgggactaatgggtattatattcgtacaagtttgctgcatgatatatcaatttctgatgtgtgtcaacttcgatgcattttgaagccctaaatgttgtattgtttagatcaaaacatgagtatgggactaatggctattatattcgcacaagtttgctacatgatatatcgatttctgatgtgcgtcaacttcgaagcattttgaagccctaaatgttgtattgtttacacagacagtttttatagatggcccaacgtgttgtttcgcatgcaccatcgttaacccatgttcaagacaaccataacatgagtatgcgaccctagattgtcgcattctagcagtagatttggtcatataaaggatgaggtgactctaagagcgcttgaagaataacatgtagattttttcagatcatcaatttactataggcgtgagctatgcaacatgttgtttcacatgcttcatcatcaacctaagtgcaagacaacctatagcttgagtttggggcccatgatattgtatgttcgaatgctgccactatattttgtagatatgaagaatgaggtaactttagaaatgtttaaagtgcaacatgtatattttttagatcggtaattttccggagttgagagctatatttatgcaattatgcttttatttccatccatgttttaagattctttgatattattctattacagttatatcaatgatatttatataaaagaattaaatatacaaaaattctcattccaattttatgctagactacaaacaataatagtttaggcatgctatcttaaactatatgtagtgctattttaaatgattcttggttatggacaacaatgcatgttttgaggccactcaaaaaacaattatgtgattcatgatatttttcacaaaacaatttaaccaaggaaaattacattacaatttgcttattgccaaaatgtaaacatcacttgtttgggcatgttatctcataagatatgtggaaaacttttaaatgtttcatggttatggacattaatgtaagtttgaagcggttcaaagccctaaatgatgtaatgtttagaactgtagtatttacaaaaggacccaacaaggtttgtcatgaaagttttcgcaatacacagatttgtgagtaaagcgtcatgattttgtgcatgttttctcgaaaacattgtggcatgaaccttgcgaaaactttgaagcttttcaaagccctaaattatggggtagatttacagaatgatccaacatgttgtttcacacgctccaccatcaactaaaattcaacacaatcaataacttgagtacgggacccacataattagatggtagcatgccgattaaagttcagtgttttaaagaatgaggtatctttaaaagtatttgaattgcaatatgcagatttttcaagataaactattttgcagagttacgacctctattaatggaaaattagttaatagaagaaaatttatatttccactttcatttgtcttttctaaaagacatacttgtttaggcatgttaccttaaaacatatattgtgctatttgcaatgtttctcagttgtgaacacatcaacccatgtttaaggccgagcaaaaacatgagtatgggactaatgggtattatattcgtacaatttactacatgatatatcgatttctgatgtgcgtcaactttgatgcattttgaagccctaaatgttgtattatttagacagtcattttttatggatggacccaacgtgttgtttcgcatgcaccatcattgacccatgttcaagacaaccatatcatcagtatgcgaccttaggttgtcacatgctagcactagatttggtcatatgaaggatgaggtgactttaaaagtacttgaagcacaacatgtagatttttttcagatcatcaatttaccaacaacatgttgtttctcatgcttcatcatcaacccaagtgcaacacaacctatagcatgagtttggggcccaagatattggatgatggaatgttgttggtagatttatagaatgatccaacatgtacatcacttgtttgggaatgttgtctcataagatatgtgaaaaaatttcaaaagtttcatggttatggacattaatgtaagtttgaagtggttcaaagccctaaatgatgtaatgtttagaacggtagttgttacaaaaatgacccaacaaattttgtcatgatgcaagagaatggtaattcacaatgtataaacatgatgcaagagaaaagtaaacattcacaacatgattaattcatctaaccaaaaaataca

SEQ ID NO: 823 - DNA, 3949 bp, Zea mays
agagttatgacctctattaatggaaaaatagttaatggaagaaaatttatatttgcactttcattactcttttctaaatgtcgtactgtaagacatacttctttaggcatgttaccttaaaaacatatatagtgttattggcaatgttcctcagttgtgaacacatcaacccaagtttaagagcaatcaaaacatgagtatgggactaatgattattaatttcatataagtttactgcatgatatattgatttctggtgtgcgtcaacttcgatgtattttgaagccctaaatgttgtattgtttagatagatagtttttatggatggacccaacttattgtttttcatgcaccatcattaaccaatgttcaagacaaccataacatgagtatgcgaccctagattgcagcatgcttgcactagatttggtcatatgaaggatgaggtaactctagaagcgcttgaagcataacttgtagattttattcagatcatcactttaatatagacgtgagctatccaacatgttgtttcacatgcttcatcatcaacccaagtgcaagacaacctatagcatgagtttggggcccaagatattggatgttcgaatgctggcactagagtttgtttgatatgaagaatgaggtaacttcagaaatgtttaaagtgcaacatgtatatttttaagaccggtaattttccatagttgacagctatatttatgcaatttttcttttatttcgatccatgttttaagatactttgttattattctattacaattatgtcaatgatatttattacaaaagaattaaatatagaaaaaaatttcattccaattttaattacaatttgctttatgcgagactataaataacattagtttcggcatgctgttttaaaccatttgtagtgctattttgaatgattcttggttatgaacaacagtgcatgttttgaggccactcaaaaaacaagtatgggactcatgatatttatcacaatacaatttaaccaaggaaaattacattacaatttttttattgccaaactgtaaacatcacttgtttaggcatgttatctcataagatatgtggaaagatttaaatgtttcattgttatggacattaatgtaagttcatagcggttcaaagcccttaatgacgtaatgtttggaacagtagtttttacaaaaatgacccaacaagatttgtcatcaatgttttcgcaatacactgattgggagtaaagtgtcatgattttgtgcatgttttttcgaaaagattgtggcgtgaaccctgcaaaaactttgtagcttttcgaagccctaaattatttggtagatttacagaatgatccaacatgttgtctcacacgctccaccaacaactaaaattcaacacactcaataacttcagtatgggacccacataattagatggtcgcatgccgattaaagtttagtgttttaaaggatgaggtaactttagaagtatttgaattgcaatatgcagatttttcaagataaactattttgtagagttacgatgtctattaatggaaaaatagttaatggaagaaaatttatatttatactttcattactcttttctaaatgtcgtactataagacatacttgtttaagcatgttaccttaaaacatatatagtgctatttgcaatgttcctcagttgtgaatacatcaacccaagtttaaggccgatcaaaacatatgtatgggacaaatgggtattatatttgtacaagtttgttgcatgatatatcgatttctgatgtgcgtcaacttcgaagcattttgaagccctaaatgttgtattgtttaaacagacagtttttatagatggacccaacgtgttgttttgcatgcaccatcattaaccgatgttcaagacaaccataacatgagtatgcgaccctagattgtcgcatgctagcagtagatttggtcatataaaggatgaggtgactctaaaagcgcttgaagcacaacatgtagattttttttcaaatcatcaatttactacaggcatgagctatgcaacatgttgtttcacatgcttcatcatcaacctaagtgcaggacaacctatagcatgagtttggggcccaagatattggatgttcgaatgctgccactatagtttgtagatatgaagaatgaggtaactttagaaatgtttaaagtgcaacatgtatattttttagatcggtaattttccggagttgagagctatatttatgcaattatgcttttattttgatccatgttttacgattctttgttattattctattaaagttatatcaatgatatttataacgaaagaattaatatagaaaatttttcattccaattttaattacaattttctctatgctagactataaacaacaatagtttaggcatgctatcttaaaccatatgtagtgctatttgaaatgattcttggttatggacaacaatgcatgttttgaggccactcaaaaaacaattatgtgactcatgacatttatcacaaaacaatttaaccaaggaaaattacattacaatttgcttattgccaaactgtaaacatcacttgtttgggcatgttatctcataagatatgtggaaaatttttaaatgtttcatggttatggacattaatgtaagtttgaagcggttcaaagccctaaatgatgtaatgtttagaatggtagttttcacaaaaaggacccaacaaggtttgtcataaaagttttcgcaatacaatgatttgtgagtaaagggtcatgatttcgtgcatgttttctcgaaaagattgtggcatgaaccatgcaaaaactttgaagcttttcaaagccctaaattatgtggtagatttatagaatgatctaacatgtttcacatgctccaccatcaactaaaattcaacacaatcaataacttgagtatgggacccacataattagatggccacatgtcgattaaagttcaatgttttaaagaatgaggtaactttaaaagtatttgaattgcaatatgcagatttttcaagataaactattttgcaaagttacgacatctattaatggaaaaatttatatttccactttcattactcttttctaaaagacatacttgtttaggcatgttaccatgtaacatatattgtgctatttgcaacgttccttagttgtgaacacttcaacccaagtttaagaccgatcaaaacatgagtatgggtctaatgggtattatattcgtacaagtttgctgcatgatatatcgatttctgatgtgcgccaactttgatgcattttgaagccctagatgttgtattgtttagacagacagtttttacggacggacccaatgtgttgtttcacatataccatcattaacccatgttcaagacaaccataacatgagtatgcaaccctagattgtcgcatgttagcactagatttgttcatatgaaggatgatgtgactctaaaagcgattgaagcacaacatgtagattttttcagatcttcaatttaatataggcgtgagctatgaaacatgttgtttcaattgcttcatcatcaacccaattgcaagacaacctatagcatgagtttggggcccaagatattggatgttccaatgctggcactagagtttgtagatatgaagaatgaggtaactttagaaatgtttaaagtgcaacatgtatattttttagatcagtaattttccggagttgagagctatatttatgcaattctgcttttatttcgatccatgttttaagattctatgttattattctattacagttatatcagtgatatttataacaaaagaattaaatatagcaaaattttcattccatttaagtacaatttgctctatgctagattataaacaataatagtttaggcatgttatcttaaaccatat

SEQ ID NO: 824 - DNA, 3949 bp, Zea mays
tttaatcactgattactgtaaaattactatgtaactactcaatctgggtgattgaaattactgaataaatgtccaaaattattgagtggagattgtaaaattatttagtaactagataatcactacatatctgttgttattttctcaatgggtaaatgaaattactgtgtgattaaggaattaccgaacaaatgatgtcaaactactgagtgatttatgtaaaattatcgagtgattacagtaaattaacttagtaactagacaatcattgcatatatgttgttctgttctcaacgtgtaaagaaaattactggatgattgataattatagtacaaacgttataaaattaatgagtgattgagaaagtgttgaacaaatactgcaaaatactacatatttattgttcttttcttagcgtgttaatgaacttactggtgaatgaggaagtgttgaacaaatgctgcaaaattaatcactgattactgtaaaattactatgtaactactcaatctgggtgattgaaattactaaataaatggtgcaaaattactgagtggagactgtaaaataatttagtaactagataatcactacatatctgttgttattttctcaatgggtaaatgaaattactgtgtgattaaggaattaccgaacaaatgatgtcaaactactgagtgatttatgtaaaattatcgagtgattacagtaaattaacttagtaactagacaatcattgcatatatgttgttctgttctcaacgtgtaaagaaaattagtggatgattgataattatagtacaaacgttataaaattaatgagtgatgattgagaaagtgttgaacaaatactacaaaattaattgcatatttattattactttattagcgtgttaatgaaataactaggtgactgaggaagtgttgaacaaatgctgtaaaattaaccaatgattactgtaaaattactatgtaactactcaatctaggtgattgaaattactgaataaatggtgcaaaatcactgagcggagactataaaattatttagtaactaaataatcactacatatctattgttattttcgcaatgggtaaatgaaattactgtatgattaaggaattactgaacaatgctgtcaaattactaagtgatttatgtaaaattatggagtgattactgtaaattaacttagtaattggataatcattgcatatatgttgttcttttctcaacgatgattgataattatagtacaaacgttataaaattaatgagtgattgagaaagtgttgaacaaatactgcaaaattactgcatatttattgttattttcttagcgtgttaatgtaattactgggtgactgaggaagtgttgaacaaacgctgcaaaattaattattgattactataaaatcactatgtaactactcaatctgggtgattgaaattactcaataaatggtgcaaaaattactgagtggagactgtaaaattatttagtaactagataatcactacatatctgttgttattttctcaatggctaaatggaattactgtgtgattaaggaattaccgaacaaatgatgtcaaactactgagtgatttatgtaaaattatcgagtgattactgtaaattaacttagtaactagacaatcattgcatatttgttgttctcttctcaacgtgtaaagaaaattacttgatgattgataattatagtacaaacgttataaaattaatgggtgattgagaaagtgttgaacaaatactacaaaattactgcatatttattgttcttttgttagcgtgttaatgaaattactgggtgaatgagtaagtgttgaatagatgttgcaaaattaatcactgattactgtaaaattactatgtaactactcaatctgggtgattgaaattactgaataattggtgcaaaattactgagcggagactgtaaaattatttagtaactagataatcactacatatctgttgttactttctcaatgggtaaatgaaattactttgtgattaaggaattaccgaacaaatgatgtcaaactactgagtgatttatgtaaaattatcgagtgattactataaattaacttagtaactagacaatcattgcatatattgttctgttctcaaagtgtaaagaaaattactggatgattgataattatagtacaaacgtttaaaattaatgagattgagaaagtgttgaacaaatactgcaaaattactgcatatttattgttcttttcttagcgtgttaatgaaattactgtgtgaatgaggaagtgttgaacagatgctgcaaaattaatcattgattattgtaaaattactatgtaactactcaatctgggtgattgaaattactgaataaatggtgcaaaattactgagtggagactgtaaaattatttagtaactagataatcactacatatttgttgttattttctcaatgtgtaaatgaaattactgtgtgcttaaggaattaccgaacaaatgatatcaaactactgagtgatttatgtaaaattatcgagtgattactgtaaattaacttagtaactagacaatcattgcatatatgttggtctgttctcaacgtgtaaagaaaattactggatgattgataattatagtacaaacgttataaaattaatgagtgattgagaaagtgctgaacaaatactgcaaaattactgcatatttattgttcttttcttagcgtgttgatgaaattactgggtgaatgaggaagtgttgaacacatgctgcaaaattaattactgattactgttaaattactatgtaactacttaatctaggtgattgaaattactgaataaatggtgcaaaattactgggtggagactttaaaattatttagtaactagataatcactacatatctgttgttattttctcaatgggtaaatgaaattactgtgtgattaaggaattaccgaacaaatgatgtcaaactactaagtgatttatgtaaaattatcgagtgattactttaaattaacttagtatctagacaatcattgcatatatgttgttctattctcaatgtgtaaagaaaattactggatgattgataattatagtacatacgttataaaattattgggtgattgagaaagtgttgaacaaatactgcaaaattactgcatatttactgttcttttcttagcgtgttaatgaaattactgggtgaatgaggaagtgttgaacacatgctgcaaaattaatcactgattactgtaaaattactatgtaactactcaatctgggtgattgaaattactgaataaatgctgcaaaattactgagtggagactataaaattatttagtaactagataatcactacatatctgttgttattttctcaatgggtaaatgaaattactgtgtgattaaggaattaccgaacaaatgatgtcaaactactgagtgattgatgtaaaattatggagtgattactgtaaattaacttagtaactagacaatcattgcatatatgatgttctattctcaacgtgtaaagaaaattactagatgattgataattatagtacaaacgttataaaattattgagtgattgagaaagtgttgaacaaatactgcaaaattactgcatatttattgttcttttcttagcgtgttaatgaatttactgggtgaatgaggaagtgttgaacagatgctgcaaaattaatcactgattactgtaaaattactatgtaactactcaatctgggtgattgaaattactgaataaatggtgcaaaattactgagtggagactataaaattatttagtaactagataatcactacatatctgttgttattttctcaatgggtaaatgaaattactgtgtgattaaggaattaccgaacaaataatgtcaaa

SEQ ID NO: 825 - DNA, 3772 bp, Zea mays
tctgcttttatttagatccatgttttaagatactttgttattattctattacagttatatcaatgatatttataacaaaagaattaaatatagaaaatgtttcatcgaattttaattacaatttgctttgtgccagacaataaacaatactagtttaggcacgctatattaaaccagatgttaaatgattcttggttatggacaacaatgcaagttttgagaccactcaaaaaacaagtatgggactcttgatatttatcacaaaacaatttaagcaaggaaaattacattacaatttttcattgccaaacaatacatatcacttgtttggacatgttatctcataaactatgtggaaagatttcaaatgtttcatggttatggacattaatgtatgtttgaagcggttcaaaaccctaaatgatgtaatgtttagaatggtagtttttacaaaaatgtcccaacaagatttatcatcaaaattttcgcactgcactgattttggagtaaagggtcatgattttgtgcatgttttctcaaaaagattgtggcatgaaccatgtgaaaactttgaagcttttcgaagccctaaattatgtggtagatttagagaatgatccaacatgttgtttcatatgctccaccatcaactaaaattcaacagaatcaataacttgagtatgggacccacattaacccatgttcaatacaaccataacatgagtatgtgaacctagattgtcgcatgctagcacaagatttggtcatatgaaggatggggtgactctagaagcacttgaagcacaacatgtagattttttcagatcatcaatttactataggcgtgagctatccaacatgaattttcacatgcttcatcatcaacccaagtgcaagacaacctatagcatgagtttggagcccaagatattggatgttcgaatcatcgcgctagagtttgtaggtatgaagaatgaggtaactttagaaatgtttaaagtgcaacatgtatattttttagatcggtaattttctggaattgagagttatatttatgcaattctgcttttattttgatccatgttttaagattctttgttattattctattacatttatatcaatttctaacaaaagaactaaatatagaaaaaatttcattccaattctaattacaatttgctctatgcgagactataaataataatagtttaggcatgctatcttaaaccatatgtagtgttattttatatatttcttggttatggacaacagtgcatgttttgaggccactcaaaaaacaagtatgggactcatgatatttattacaaaataatttaaccaaggaaaattacattacaatttgctctttgccaaactgtaaacatcacttgtttgggcatgttatctcataagatatgtggaaagatttcaaatgtttcatggttatggacattaatgtaagtttgaagcggttcaaggccctaaataatgtaatgtttagaatggtagtttttacaaaacgacccaaaaaggtttgtcctcaaagttttcgcaatacactgatttgtgagtaaagggtcatgatttcgtgtatgttttctctaaaagattgtggcatgaaccatgcgataactttgaagctttttgaagccctaaattatgtggtagatttatagaatgattcaacatgttgtttcacacgctccaccagcaactaaaattcaacacaatcaaaacttgagtatgggacccacataattagatggtcgcatgccgattaaagtttagtgttttaaagaatgaggtaaatttaaaagtatttgaattgcaatatgcagatttttcaagataatctattttgcaaagttatgacctctattagtggaaaaatagttaatggaagaaaatttatatttccactttcattactcttttctaaatgtcgtactctaagacatacttgtttcggcatgttaccttaaaaacataaatagtgctatttgcaatggtcctcagttgtgaacacagcaacccaagtttaagaccgatcaaatcatatgtatgggactaatgggtattatattcgtacaagtttgttgcatgatatatcgatttctgatgtgcgtcaacttcgattcattttgaagcccgaaatattgtattgtttagacagacaatttttacggatggacccaacttgttgtttcgcatgcaccaacattaacccatgttcaagacaaccataacatgagtatgcgaccctagattgtcgcatgctagcactagatttggtcatatgaaggacgaggtgactatagaagcgcttgaagcataacatgtagatttttttcgaatcatcaatatttactataggtgtgagttacccaacatgttgtttcacatgcttcatcatcaacccaagtgcaagacaacctatagcatgagtttggggcccaagatattggatgttcgaatgcaggcactagagtttgtagatacgaagaatgaggtaactttagaaatgtttaaactccaacatgtatattttttagatctgtaattttccggagttgagagctatatttatgcaattctgcttttattttgatccatgttttaagatactttgttattattctattacagttacaccaatgatatttttaacagaagaattaaatatagaaaaattttcattccaattgtaagtacaatttgctttatgctagactataaacaatactagtttaggcatgttatgttaaaatatatgtaatgctattttaaatgattcttggttatggacaatattgcatgttttgaggccactcaaaaaacaggtatgggacacatgatatttatcacaaaacaatttaaccaaggaaaattacattacaatttgcacattgccaaactgtaaacatcacttgtttgggcatgttatctcatcagatatgtggaaagatttcaaatgtttcatggttataaacattaatgtaagtttgaagcggttcaaagccctaaatgatgtaatgtttagaacggtagtgtttacaaaaagcacccaacaaggtttgtcatcaaagttttcgcaatacactgatttgggagtaaagggtcatgatttcatgcatgttttctcgaaaagattgtggcataaatcatgtgaaagctttgaagcttttcgaagccctaaattatgtggtagatttacagaatgatccaacatgttgtttcacactctccaccatcaactaatattaaaaacaatcaataacgtgattgtgggacccacatagttagatggtcgcatgccgattaaagttcagtgttttaaataatgagataacttcaaaagtatttgaattgcaatatgaagatttttcaagataaactattttgcatagttacgacatctattaatggaaaatagttaatggaacaaaatttatatttgcactttcattactcttttctaaatgttgtattgtaagacatacttctttaggcatgttaccttaaaacatatatagtgctatgtgcaatgttcctcagttgtgaacacaacaacccatgtttaaggccgatgaaaacatgagtatgggactaatgggtattaatttcgtacaagtttgctgcatgatatatcaatttctgatgtgtgtcaacttcgatgcatttggaagccctaaatattgtattgtttaaataaacagtttttacagatagacccaacttgtttcgcatgcactgatttaggagtaaaggg

SEQ ID NO: 826 - DNA, 3746 bp, Zea mays
ccatatgtagtgctattttaaatgattcctggttatggataacaatgcatgttttgaggccactcaaaaaacaagtatgggactcatgctatttatcacaaaacaatttaaccaaggaaaattacattacaattttctcattgccaaactgtaaatatcacttgttttggcatgttatctcataagatacgtgaaaatttttcaaatgttacatggttgtggacattaatgtaagtatgaatcggttcaaagccctaaatgatgtaatgtttagaacggtagttttttaaaaaaaggacccaacaaggtttatcatcaaagatttcgcaatacactgatttgtgagtacaagggtcatgaaccatacgaaaactctgaagctttgcgatgccctaaattatgtggtcgatttacaaaatgagacaatatgttgtttcacacgctacatcaactaaaattcaacacaatcaataacttgagtatgggacccacataattagatggttgcatgccgattaaagttcagcgttttcaagaatgaggtaactttaaaagtatttgaattgcaatatgcagattttacaagataaactattttgcagagttacgacctctattaatggaagaaaatttatatttccactttcattactcttttataaatgtcgtactataagacaaacttatttaggtatgttaccttaaaacacatattgtgctatttgcaacgttcctcggttgtgaacacatcaacccaagtttaaggccaatcaaaacatgagtatgggactaatgggtattaatttcatataagtttattgtatgatatatcgattttttatgtgcgtcaacttcgatgcattttgaaaccctaaatgttgtattgcttagacagacagttttacggatggacccaacttattgtttcgcatgcaccatcattaaccaatattcaagaaaactataacatgagtatgcgaccctagattgcagcatgctagcacttggtttggtcatatgaaggatgaggtgactctagaagcgcttgaagcataatatgtagattttttcagatcatcactttactataaacgtgagctatccaacattttgtttcacatgcttcatcatcaccccaagtgcaagacaacctatagcatgagtttggggcacatgatattggatattcgaatgctggcactagagtttgtagatatgaaaaatgaggtaactttagaaatgtttaaagtgcaaaatgtatatttttagatatgtaattttccgtagttgagatccatatttatgcaattctgcttttatttcgatctatgttttaagatactttgttattattctatgacaattatatcaatgatatttaacacaaaataattaaatatagaaaaaattcattcaaattttaattacaatttgctttatgccagactataaacaatattagtttaggcatgctattttaaaccatatgtagtgttattttaaataattttttgttatgaacaaaaatgcatgttttgaggccactcaataaataagtatgggactcatgatatttatcacaaaacaatttaaccaaggaaaattacattacaatttgctcattgtcaaactgcaaacatcacttgtttaggcatgttatctcataagatatgtggaaagatatcaaatgtttcctggttatgaacattaatgtaagtttgaagcagttcaaagccctatatgacaaaatgtttagaacggtagtttttacaaaaatgacccaacaagatttgtcatcaatgttttcgcaatacactgatttgggagtaaagtgtcatgatttcgtgcatgttttttcgaaaagattgtggcatgaaccatgcgaaaactttgaagcttttcgaagccctaaattatttggtagattcatagaatgatccaacatgtttgacacgctccaccaacaactaaaattcaacacactcaataacttgagtataggacccacataattagagggtcgcataccaattaaagtttagtgttttaaagaattaggtaactttaaaagtatttgaattgcaatatgcagatttttcaagataaactattttgcagagttacagcctctattaatggaaaaatagttaatgaaagaaaatttatatttccactttcattactcttttctaaatgtcgtcctttaagacatacttgtttaggcatgttaccttaaaaaatatatagtgctaattgcaatgttcctcagttgtgaacacatcaacccaagtttaaggaagatcaaaacatgagtaagggactaacgggtattatattcgcacaagtttgctacatgatatatcgatttctgttgtgcgtcaacttcgaagcatttttaagccctaaatgttgtattgtttagacagatagtttttatagatggcccaacgtgttgtttcgcatggaccatcgttaacccatgttcaagacaaccataacatgagtatgtgaccctagattgtcgcattctagttgtagattcggtcatataaaggatgaggtgactctaagagcgcttgaagaacaacatgtagatttttttcagatcatcaatttactataggcgtgagctatgcaacatgttgtttcacatgcttcatcatcaacctaagtgaaagacaacctatagcttgagtttggggcccatgatattgtatgttcgaatgcagccactatagtttgtagatatgaagaatgaggtaactttagaaatgtttaaagtgaaccatgtataatttttagatcggtaattttccgaagttgagagctatatttatgcaattatgcttttatttcgatccatgttttaagattctttgatattattctattccagttatatcaatgatatttataacaaaagaattaaatatagaaaaattctgattccaaatttagttacaatttgctctatgctagactataaacaataatattttaggcatgctattttaaactatatgtagtgctattttaaatgattcttggttatggacaactatgcatgttttgacgccactcaaaaaacaattatgtgactcatgatatttttcacaaaacaatttaaccaaggaaaattacattacaatttgcttattgccaaaatgtaaacatcacttgtttgggcatgttatctcataagatatgtggaaaacttttaaatgtttcatggttatggacatcaatgtaagtttgaagcggttcaaagccctaaatgatgtaatgtttagaactgtagtttctacaaaaggacccaacaagatttgttatgaaagctttcgcaatacactgatttgtgagtaaagcgccatgattttgtgcatgttttctcgaaaagattctggcatgaaccatgcgaaaactttgaagcttttcaaagccctaaattatggggtagatttatagaatgatccaacatgttgtttcacacgctccaccatcaactaaaattcaacacaatcaataacttgagtacgggacccacataattagatggtcgcatgccgattaaacttcagtgttttaaagaatgaggtaacattaaaagtatttgaattgcaatatgcagatttttcaagataaactattttgcagagttacgacctctattaatggaaaattagttaatagaagaaaatttatatttccactttcatttgtcttttctaaaagacatacttgtttag

SEQ ID NO: 827 - DNA, 3553 bp, Zea mays
aacctatagaatgagtttgggtctcgagatattggatgttttgaatgctggcactatcgtttgtagatttgaagaatgaggtaactttagaaatgtttaaagtgcaacatgtatattttttagatcgataattttccggagttgagagccaaatttatgcaattctgcttttatttcgatccatgttttaagattccttgttattattctattacagttatatcaatgatatttataacaaagaattaagtatagaaaaatttcattccaaatttaattacaatttgctctatgatagactataaacaataatagtttagtcatgctatcttaaaccatatgtagcgctatttttaatgattcttggttatggacaacaatgcatattttgagggccactcaaaaaacaagtatgggactcatgatatttatcacaaacaatttaaccaaggaaaattacattacaattttttcatttccaaactgtaaacattaattgtttgggcatgttatctcataagatatgtggaaaaatttcaaatgtttcatggttatggacattaatgtaagtttgaagccgtcaaagccctaaatgatgtaatgtttacaacggtagtttttacaaaaatgtcccaacaagatttgtcatcaaagttttcgcaatgcactgatttgggagtaaagggtcatgattttgcgcatgttttctcaaaaagattttggcatgaaccatgcgaaaactttgaagcttttcgaagccctaaattatgtggtagatttacagaattatccaacatgtttcatacgctcctccatcacctaaaattcaacacaatcaataacttgagtaagggacccacataattagatggtcgcatgccgattaaagttcaatgtttcaaagaatgaggtaactttaaaagtatttgaattgcaatatgcagatttttcaagataaactattttgcagagttacgacctatattaacggaaaaatagttaatggaagaaagattatattttcactttcattactcttttctaaatgccgtattgtaagacatacttgtttaggcatgttaccttaaaacatatatagtgttatttgcaatgttcctcagttgtgaacacatcaaaccaagtttaaggccgatcaaaacataagtatgggactaatgggtattaatttcgtggaagtttaccacatgatatatcgatttctgatgtgcgtcaactttgatgcatttttgatgccctaaatattgaattgtttagacagacagtttttacggatggacccaacttgttgtttcgcatgcaccatcattaacccatgttcaagacaaccataacatgagtatgtgacccaagattgtcgcatgctagcactagatttagtcatatgaatgatacggtgactctagaagcgcttgaagcataacttgtagatctttttcagatcatcaatttactataggcgtgagcaatccaacatgttgttttacatgcttcatcatcaacctaagtgtaagacaaccaatagcatgagtttggggcccaagatattagatgttcgaatgctggcactagagtttgtagatatgaagaatgaggtaactttagaaatgtttatagtgcaacatgtatattttttagattggtaattttccagagttgacagctatattaatgtaattctgcttttatttcgatccatgttttaagatactttgttattattctattacagttatatcaatgatatttataacaaaagaattaaatacagaaaaaaatttattccaatttaattacaatttgcattatgccagactctaaacaatactactttaggcatgctatcttaaaccatatgtagtgctattttaaatgattctcggttatagacaataattcatgttttgaggccactcaaaaaacaagtatgggactcatgatatttatcacaaaacaaattaaccaagaaaaaatacattacaatttgctcatagccaaactgtaaacatcacttgtttggacatgttacctcataaaatatgtggaaagatttcaattgtgtcatggttgtggacattaatgtcagtttgaagcggttcaaagccctaaatgatgtaatgtttaaaatggtaatttttacaaaaaggacccaaaaaggtttgtcatcaaagttttcgcaatacattgatttgggagtaaagggtcatgatttcgtgcatgttttgtcgaaaagattgtgggatgaaccatgcaaaaactttgaagctttccgaagcactaaattatgtggtagatttatagaatgaaccaacatgttgtttcacacgctccaccataaactaaaatttaacacaatcaataacttgagtatgggacccataattagatggtcgcatgacgattaaagttcaatgttttaaagaatgaggtaactttaaaagtattcgaattgcaatatgcagatttttcaagataaactattttgcagaattacgacctcttttaacagaaaaatagttaatggaagaaaaattatatttttactttcattactcttttctaaatgacgtactataagacatacttatttatgcatgttaccttaaaacatatatagtgttatttgcaatgttcctcagttgtgaacacatcaacccaagtttaaggccgatcaaaacttgagtatgggactaatgtgtattaatttcgtacaagtttactacatgatatattgatctctgatgtgcgtcaacttccatgcattttaaagccctaatattgtattgtttagacagatagtttttatggatggtcccagcttgttgttttgcgtgcaccatcattaacccattttcaagacaaccataacatgagtatgcgaccctagattgtcgcatgctagcactagatttaatcgtataaaggacgaggggactctagaagcgcttgaagcataacatatagatttttttcagatcatcaatttactataggcgtgagctatccaacatgtttttcacatacttcatcatcaacccaagtgcaagacaacttatagcatgagattggggcccaagatattagatgttcgaatgcaggcactagagttggtagatatggagaacgaggtaagtttagaaatgtttaaagtgcaacatgtatattttttagatctgtaattttccggagttgagagctatatttatgcaattgtgcttttattttgatccatgttttaaatactttgttattattctgttacaattataccaatgatattagtaacaaaagaattaaatatagaaaaaatttcattccaattttaagtacaatttgctctatgccagactataaacaaaactagtttaggcatgttatgttaaaccatatgtactgctattttaaatgactcttggttatggacaatattgcatgttttgaggccactcaaaaaacaattatcataaaacaatttaacctaggaaaattacattacaatttgctcattgccaaactgtaaacatcacttgtttgg

SEQ ID NO: 828 - DNA, 3455 bp, Zea mays
agagaataagaatccccactaccgagtgatacaaagagaataactgaataattcagttatgactacggaacagaaataattatgtgcattagaattgagctaagtgacgaacatggaataactgagtcggcacatcgcaataactaaggtattataacataataactaagggatcagaaccgaacaactgagtgccgacaccagaataactgagtctgcacacaataataactgagtgggcacattccaataactgaggtatgatgataactgagggatcggaggagaataactgagttagcccacaagaaaactaaggtattggaacggaataactgagttctgtcatcataataactgagtgcgtccattagaagaactgagttgttggaacggaataactgagtaatgaacagataataactgagtagtgaacatggaataactgagtgtgcacaacagaataactgagtaatgaacaatagcataactgagttacttgaacgcaataactgactgtgaatagagaataactgagtaataaacaccgcataactgagtgcgtacattacaataactgaggtatgatacaggataactgagggattggagtagaataactgagggatcagaaccgaacaactgagtgccgacaccagaataactgagtctgcacaccgcccaagaataactgaggtattggaacggaattactgagttctggcaccagaataactgagtgcgtccattagaagaacggagttgttggaacggaataactgagtcatgaacatataataactgagtaggcacattacaataactgaggtatgacacaggataactgagggattggagtagaataattgagttctgtcactcaaataactgagtgcgtcgtctagaataactgagtaatgaacgcacaataactgagtaacgtacagagaataactgagtgttgaacatggaataactgagggcgcgcattagaataactgagttaggaacatggaataactgcggtattatataataactaagggtttagaataactgagttaggaacatggaatactgaggtattataacggaataactgagggattggagtagaactgagttggcccacaagaattgaggcatgagcagagaataactgagttccgtcactagaataactgagtgatgaacacagaataaccgagtactgaaccgagaataactgagaaatgaacatggaataactaagtgcacccactagaataactgcgtgctgactccagaataactgagacatgaacatggaataactgagtgcgcccactagaataactgagtcatgagcagagaataactgaggtattaggacggagtgctgacaccagaataaccgagtccgcacaatagaataactgagctactgaaagaaataactgagtactgaacatgtaataactgagtgcgcacattacaataactgaggtattataacggaataactaagagatcgtagtagaatgactgagttggcccataagaataactgaggtattagtccagaataactgagtacgtccattagaataactgagttgttggaatgaaataactgagtaatgaaaacacaataactgagtaaataactgagtggcgaacatggaataactgagttaatagaacgcaataactgactgtgaatagagaatacggagtccccactaccgagtgattacaaagagaataactgagtaatgagcagagaataagtgagtaggcacacgagaataactgagttatcacaccagaataactatgtgcgcccattagaataattgagttccgacaaaagaataactgagtgacgaacatggaataactgagtcggcacatctcaataactgaggtattataacataataactgagggatcagaaccgaacaactgagtgccgacaccagaataactgagtctgcacaataataactaagtgggcacattccaataactgaggtatgatgataactgaggcatcggaggagaataactgagttagcccacaagaataactaaggtattggaacggaataactgagttctgtcaccataataactgagtgcgtgcattagaagaactgagttgttggaacggaataactgactaatgaacagataataactgagtagtgaacaatagaataactgagtgtgcacaacagaataactgagtaatgagcaataacataactgagttacttgaacgtaataactgaatgtgaatagagaataacggagtaataaacaccgcataactgagtgggcacattacaataactgaggtatgatacaggataactgagggattggagtagaataactgagggatcagaaccgaacaactgagtgccgacaccagaataactgagtctgcacaccataatcactgagttagcccacaagaataactgaggtattggaaaggaattactgagttctggcaccagaataactgagtgcgtccattagaagaactgagttgttggaacggaataactgagtcatgaacatataataactgagtaggcacattacaataactgaggtatgacacgggataactgagggatcaaagtagaataactgagttctgtcactcgaataactgagtgatgaacatggaataactcaaggcgcgcattagaataactgagtaccgacatagaataactgagttaggaacatggaataactgcggtattataacataataactgagggtttagaataactgaggtattataacagaataactgagggattggagtagaataactgagttggcccacaagaactgaggcacgagcagagaatagctgagtttcgtcaccagaataactgagtgatgaacacagaataaccgagtactgaaccgagaataactgagaaatgaacatggaataactaagtgcgcccactagaataactgagtgctgactccagaataactgagtcggaaaagtagaataactgaggtattagaacggaataactgagtaattagtagaataacttagttattagaacagaataactgagtgtgcacattagaataactgaggtagtagaacgtaataactgagttccgtcaccagaataactgagtactgacaccagaataactaagttattagaatggaataactgagtaatgagtagagaataactgagtgtgcacattagaataactgaggtagtagaaggtgaacgacacggattagatcctagggcaaggtgaacggcacagattagatctcgcataccctttcggctaggaaaggtctgggccgtagatcatcaaacggagggcccgtgctaaatctgttgtgtggatgatttcgggccattgatctttgatcctagggcagtgaacgcatattggattataaccttcccc

SEQ ID NO: 829 - DNA, 3339 bp, Zea mays
cccacataattagatggtcgcatgccgattaaagttcagtgttttaaagagtgagataactttaaaattatttgaattgctatatgcagatttttcaagatgaactattttgcagagttacgacctctattaatggaaaaatagctaatggaagaaaaattatatttccactttcattactcttttctaaatgtcgtcctgtaagacatacttgtttaggcatgttaccttaaaaacatatatagtgctatttacaatgttcctcatttgtgaacacatcaacccaagtttaaggccgatcaaaacatgagtatgggactaatgggtattatattcatacaagtttactgcatgatatatcgatttcagatgtgcgtcaacttcgatgcattttgaagcgctcaatgttgtattatttggacagacattttatacggatgggcccaacgtgttgtttcgcatgcaccatcattagcccatattcaagacaaccatatcatgagtatgcgacactagattgtcacatgctagcactagatttggtcatattaaggatggtgactctaaaagcgcttgaagcacaacatgtagatttttttttcagatcatcaatttactatagtcgtgagctatgcaacatgttgtttcacatgcttcatcatcaacccaagtgcaagacaacctatggcatgagtttggggcccaagatatttgatgtttgaatgctgacactatagtttgtagatatgaagaatgaggtaactttagaaatgtttaaagtgcaacatgtatattttttagatcggtaattttctagagttgagagccatatttatgcaattctacttttatttcgatccatgttttaatattccttgttattattctattacagttttatcaaagatatttataacaaaagaattaagtatagaaaattttcattccaattttaattacaatttgctctatgctagactataaacaataatagtttaggcatgctatcttaaaccatatgtagcgctatttttaatgattcttggttatggacaacaatgcatattttgaggccactcaaaaaacaagtatgggactcatgacatttatcacaaaacaatttaaccaaggaaaattaaattacaagtttttcattgccaaactgtaaacactacttgtttgggcatgttatctcataagatatgtggaaagatttcaaatgtttcatggttatggacattaatgtaagtttgaagtcgttcaatgccataaatgatgtaatgtttacaacggtagtttttacaaaaatgtcccaacaagatttgtcatcaaagtttttcacaatgcactgatttgggagtaaagggtcatgatttcgtgcatgttttctcgaaaagattgtggcatgaaccatgcgaaaactttgaagcttttcgaagccctaaattatgtggtagatttacagaatgatccaacatgtttcatacgctcctccatcacctaaaattcaacacaatcaataacttgagtaagggacccacataattagatcgtcgcatgccgattaaagttcaatgttttaaagaatgaggtaactttaaaagtatttgaattgcaatatgcagatttttctagataaactatttggcagagttatgacctctattaacggaaaaatagttaatggaagaaagattatatagtgttaccataaaacactatatagtaaaacattatatagagttacgacctctatttttaaagaaagatttttctaaatgcggtactgtaagacataattgtttaggcatgttacgttaaaacatatatagtgttatttgcaatgttcctcagttgtgaacacatcaaaccatgtttaaggccgatcaaaacatgagtatggactaatggttatcaatttcatggaagtttactgcatgatatattgatttctgatgtgcgtcaacttcgatgcattttgatgccctaaatattgaattgtttagagagacagtttttacggatggatccaacttgttgtttcgcatgcaccatcattaacccatgttcaagacaaccataacatgagtatgcgaccctagattgtcgcatgctagcactagatttagtcatataaatgataaggtgaatctagaagcgcttgaagcataacatgtaggtctttttcagatcatcaatttactataggcgtgagctatccaacatgttgttttacatgcttcatcgtcaacctaagtgcaaaacaacctatagcatgagtttggggcccaagatattagattttcgaatgctggcactagagtttgtagatatgaagaatgaggtaactttagaaatgtttatagtgcaacatgtatatttttaaatcggtaatttccggagttgacaactatatttatctaattctgctttttttcgatccatgttttaagatacttttattttattctattacaattatatcaatgatatttataacaaaacaattaaatatagaaaacaaatttattccaattttaattacaatttgctttatgcgagactataaaataatggtttaggcatgctatcttaaaccatatgtagtgctattttaaatgattatcggttatagacaataatgcatgttttgaggccactcaaaaaacaagtatgggactcatgatatttatcacaagacaacttaaccaaggaaaattacattacaatttgctcattgccaaactataaacatcacttgtttggacatgttatctcataaaatatgtggaaagatttcaaatgtttcatggttgtggacattaatgtatgtttgaagcggttcaaagccctaaatgatgtaatgtttagaacgataattcttacaaaaaggacccaaaaaggtttgtcatcaaagttttcgcaatacactgatttgggagtaaaggtcatgatttcgtgcatgttttctcgaaaagattatgggatgaaccatgcaaaaactttgaagcttttcgaagcactaaattatgtggtagatttatagaatgatccaacatgttgtttcacatgctccaccgtcaactaaaatttgacacaatcaataacttgagtatgggacccacataatttgatggtcgcatgacgattaaagttcaatgttttaaagaatgaggtaactttaaaagtatttgaattgcaatatgcagatttttcaagataaactattttgcagaattacgacctcttttaacggaaaaatagttaaaggaagaaaaattatttttcactttcattactcttttctaaatgacgtactgtaagacatacttatttagg

SEQ ID NO: 830 - DNA, 3276 bp, Zea mays
aattcataaaacatattcacgttcttgcttctatagcacaaatgtttgcatctagatctttcactctttttgttgtagtttacatatgtttcatcaggttttgtttctgtttgccaaatgccggcgagatgtgatccatcgtttcagttttataagcacgaatttgtacttcttgcatggcagactagacattaattagtcttctctagtgtaccctatagtaataatgagcgtataacattagctataaatagcgttagagtacttccggtagtactattccggtcaccattggcactactccagacctaagtagagttaggatctaccttgacagcatcatatttgtcatgttaagctctacatgtctcaacacttctcatgcccaaactgatgaaaaggtacagtgcaaaaggagccaacagcacattattggtggtgattaaaggtgtcagcagaaagccagcagcacattggtggtgtagagcagcagaagtatagtagaatgagttcaccctttccattgtatttatacacctcgagaaggtgctcaaagacagacagacagacccttgactggaggagtgatacattcattttgctgaagaaatgtggttatggcgcctgaccttatgtcgtcagtgccagggccctacactagtacactcctactgcaattttaatttcacccataaatttatattttccccatacatatctcaataccaaacatgaataatctgggatagagatgtatggagaaaaacaaacttatattctataatgaaaaacaaacttatacctttagtactttaaaacaccaatttcctgtgtggtacgttttctcttaacgagctattacactacagataggttctaaaatgagaagtgtgattttcaacgtatttgtccatgaatttcgaaagttacattattccatccactcttttcgtgtgcagcataacgacattgtgctacaatgtttacgacctgctaaataacaataatagcataaatagttgattatgttagtcgtccagctaatcaagtcggtgaccccgccgctacaaactgcatgcagaagcagcgatacttcacgatgcttcctaatctaagttgataatggatacaaaacatgtggtttagacaaatattgcacaaaggagtggcctctgctagtgctagcagtgctattggggttttattgtgaggcaccgatgccttttttttgtgagaatggtacaaaccagagtattgactacattgatgttgtcgacctacctgtcatttagtaatcctagtcgacagaactaccagtgccaaaagaaaatgaatggcaacactcaacatcctcttattgtagctttttaatcacttggtgctgatgtaaggtaagagtttaggacaaattttttgacttttgaaccctatgtagaataatcaacggtcaatcatgaatctgtgagattaaaaaaaaatacacatatataatacaagcactagtacactgtacactatagctatatgcatctaacgaacatgcacctagtgtgtcgcgctagcagtttgcgacgatttgtttcctctaagacaccgatagactcattgatttgtttattagatttccaacaagctgcacaccaagagtaaggaatcagcacaccaagagtttatccgacccaaaactttacaataaccagaataagcattgattcatgcatttcatcaaacacttggtggacgatgtgctacaactttcctttccaatcaaaccctaggatctttctctccaccataattgcacacatatacacataacatcacataagcattgataggatctttttttttttttttgagacacttgaatggtacaaaccagataatagactacattaatgttgtcgacctacctatttgttacttatcctagtcgacacaatgaccactgacaaaataaaataaatgacgacatcctcaagtacatgagtaaaatgagcaacaatacaaacaaacacggtacaggagaaatcactaaacatgaaaacatactacataacaacagccgtccgattagtttctacggcccagattagatggacgtgggtcatgaatcgttacgcgggtgcagccattgttttggattaaaattccgatggccccgagacatccctgccccgatccaaccgaggccatcggattggcatccagcggtcacattttaatacgacgaaatgctacgcgccgcatgatctcagtcgttcatcacttttcctacggcgctggttccatcacctacctctcgtatcgaacacggaagcgcgagcagtccgcgtggcagagctcgccgatgagcgacgtgcatgacgccgatcaggccgaagccgaaccctatggatgactcgctctacgcgtcaaggactcacaagcgcgaaagagacgtgtcacacgtcggggtcggtccacgatgtggagcggaggtgcggcgggggcgagaggtgctcgggctgatccgcgagcttgatacttcacacacacgaaccacgcacgctgccgaacgcccaccacccaaccttggccaccaatgaacggtgtaggcaggcatggggcaccggcggtggacggcagacttctttctcggtcacaggaagggatggctggctcaacaggggcgaggatgcatgtgtcggtactttacttatgccccggccgtggctaggatctcggagcgcctccacgttcaacgacggtttcgcgttctgttgcgccggcgcgagaggatagggctgatgagctggccctacacgtcagcgtccgggatcaacacacgcgtgcgcgtgcgggctgaccagcggggaccaccacacatcgacccaggcgagagctcctcctgtgctctgacgcagctgaggctgaggagtgggcctaggtcgccggcgtcgaggcgcgcgtggatgtagtgcgccacgcgattcgggtggagtgggtcggccagtgggaaacgaccgatgcggcgttttaggttttgcttttccttttctgttttatttttaaatctcaaattttaattcaaaatttgttgtgaatttcacacttggatcaaatgctcaaatcaagataccagcatgaagaagtatttttattattttatatatattctttctagttatcaagaaatttattaacttgtatgtgtatatatttatatatgcatgtgtcacatagaaagaaaaattcccataaacatcaaatactcaactcctttgtttactatga

SEQ ID NO: 831 - DNA, 3220 bp, Zea mays
tcaatctgggtgattgaaattacagaataaatgctgcaaaactactgagtggagaatgtaaaattatttagtaactagataatcattacatatctgttgttattttctcaatgggtaaatgaaattactgtgtgattaaggaataaccgaacaaatgctatttatgtaaagatatcgagtgattactgtaatgtaaattaactgagtaactagacaatcatagcatatatgttgttctttactcaacgtgtaaagaaaattactggatgattgataattagagtacaaacgttataaaatgaatgagtgatcgagaaagtattgaacaaatactgcaaaattactgcatatttactgttcttttcttagtgtgttaatgaaatactcggtgactaaggaagtgttgaacaaatgctgcaaaattaatatgtgattactgtaaaattactatgtaattactcaatctgggtgattgaaattactgaataaatattgcaaaattactcagtggagattgtaaaattatttagtaactagataatcactacatatctgttgttaatttctcaatgggtaaatgaaattactgtgtgattaaggaattaccgaacaaatgccatcaaattactgagtgatttatgtaaaattatcgagtgattactgtaaattaactgagtaacaagacaatcattgcatatatgttgttctttcctcaacgtgtaaagaaaattactggatgattgataattatagtacaaacgttataaaattaatgagtgattgagaaagtgttgaacaaatactgcaaaattactgtatatttattgttcttttcttagtgtgttaataaaattactgtgtgactgaggaagtgttaaacaaatgctgcaaaattaatcagtgattactgtaaaattactatgtaactactcaatctaggtgattgaaattactggacatatggtgcaaaattactgagtggagactataaatttatttagtaactagataatcactacatatttgttgttttttctcaatgggtaaatgaaattactgtgtgattaaggaattaccgaacaaatgttgccaaattactgagtgatttatgtaaaattatcgagtgattactgtaaattaactgagcaactagacaatcattgcatatatgttgttcttttctcaacgagtaatgaaaattactggatgattgataattgtagatcaaacgttataaaattattgagtaattgcgaaagtgttgaacaaatactgcaaaattactgcatatttactgttcttttcttagtgtgttaatgaaattactgggtgactgagaaagtgttgaacaaatgctgcaaaataaatcagtgattactgtaaaattactatttaactactcaatctcggtgattgaaattactgaataaatggtgcaaaactattgtgtggagactgtaaaattatttagtaactaactaatcactacatatctattgttattttctcaatcggtaaatgaaattactgtgtgattaaggaattaccgaacaaattttatcaaattactaagtgatttatgtaaaattatcaattaactgagtaactcgacaatcattgcatatatgttgttctttactcaacgtgtaaagaaaattattggatgattgataattatattacaaacgttataaaattaatgagtgattgagaaagtattgaaaaatactgcaaaatttctgcataattaatgttcttttcttagtgtgttaatgaaattactgggtgacttaggaagtgttgaacaaatgctacaaaattaatcagtgattactgtaaaattactatgtaattacttaatctaggtggttggaattactgaataaatgttgcaaaattactaagtggagactgtaaaattatgtagtaactagataatcactacatatttgttattattttctcaatgggtaaatgaaattaatgtgtgattaaggaattatcgaacaaatgttgtcaaattacagagtgctttaggtaaaattatcgagtgattactgtaaattaactaaggaactgtacagtcattgcatatatgttgttcttttctcaatgtgtaaagaaaattactggatgattgataattatagtacaaacgttataaaattaatgagtgattgagaaaatgttgaacaaatactgcaaaattactgcatatttattgttattatcttagtgtgttaaagaaattactgggtgactgaggaagtgttgaacaaatgctgcaaaattaatcagtgattactgtaaattactatgtaactactcaatctgggtgattgaaattactaaataaatggtgcaaaattattgagtggagactgtaaaattatttagtaactagataatcactacatatctgttgttattttctaaatgggtaaatgaaattactatgtgattaaggaattaccgaacaaatgttgtcaaattactcagtgatttttgtaaaattatcgagtgattactataaattaactaagtaactagacaatcattgcatatatgtgttcttttctcaacgtgtaaagaaaattactggatgattgacaattatagtacaaacgttataaaattaatgagtgattgagaaagtgttgaacaaatactgcaaaattactgcatatttattgttattttcttagtgtgttaatgaaattactgggtgactgaggaagtgttgaacaaatgctgcaaaattaatcagggattactgtaaaattactatgtaactactcaattggttgattgaaattactaaataaatggtgcaaaattacttagtggagactgtaaaattatttagtaactacataatcactacatatctgttgttattttctcaatgggtaaatgaaattactgtgtggttaaagaattacagaacaaatgctgtcaaattactgagtgatttatataaaattatcgagtgattactgtaaattaacttagtaactggataatcattgcatatatgttgttcttttctcaacgtgtaaagaaaattactggatgatcgataattatagtacaaacgttataaaattaatgagtgattgagaaagtgttgtacaattactgcatatttattgttattttcttagtgtcttaatgaaattactgggtgactgaggaagtgttgaacaaatcctgcaaaatt

SEQ ID NO: 832 - DNA, 3192 bp, Zea mays
ttcactccaagaacaatttagtttatctaggtatcttttttttagtcaaaaaatttatattaatattgggagtagtaactttgaaattatgaatattctcaaggaaaggtgttttgatttaaaaacccctggagaattttcctcattttcacaggattgaactttagggtgttacatatagttgaagatagcatgcctaaactattattgtttatagtgtgatatggagcaaattgtaattaaaattggaatgcaaatttttctatatttaattcttttgttataaatgtcattgatataactgtaatagaataatcacaaagaattttaaaacatggatcaaaataaaagaagaattgcataaatatagctctcaactctagaaaattaccgatctaaaaaatatacatgttgcactttaaacatttctaaatttacctcattcttcatatctacaaactataatgccagcattcgaacatccaataatttgggttgatgatgaagcatgtgaaacaacatgttgcatagctcacgcctatagtaaattgatgataaaaaaaatctacatgtgcttcaaacgcttttagagtcacctcatccttcatatgaccaaatcttctgctagcatgcgacaatctagggtctcatactcatgttatggttgtcttgaacatgggttaatgatggtgcatgcgaaacaacacgttgggtccatccgtataaactgtctgtctaaacaatacaacatttagggcttcaaaatgcatcaaagttggcgcacatcagaaatcgatatatcatgcaacaaacttgtacgaatataatacccattagtccgatactcatgttttgattggccttaaattgggttgatgtgttcacaactgaggaacgttgcaagtagcacaatatatgttttaaggaaacatgcttaaacaagtatgtcttacagtacgacatttagaaaagaataatgaaagtggaaatataaattttcttccattaactatttttccattaatagaggtcgtaactctacaaaatagtttatcttgaaaaatctgcatattgcaattctaatacttttaaagttatctcattcttgaaaacactgaactttaatcgtcatgcgaccatctaattatgtgggtcccatactcaagttattgattgtgttgaattttagttgatggtggagctgtgaaacaacatgttggatcattctgtaaatctatcacataatttaaggcttcgaaaagcttcaaagttttcgtatggttcatgccacaatcttttcgagaaaacatgcacgaaatcatgactcttttactcacaaatcagtgtattgcgaaaactttgatgacaaaccttgttgggtcctttttgtaaaaactaccattctaaacattacatcatttagggctttgaaccgattcagacttacattaatgtccataaccatgaaacatttgaaaattttccacttatcttacgagataacatgccaaagaagtgatgtttacattctggcaatgagcaaattgtaatgtaattttccttggttaaattgttttgtgataactatcatgagtcccatacttttttagtggcctcaaaacatgcattgttaaccataacaaagaatcatgaaaatagcactacataaagttaaaaaaatagcatgcctaaaccattattgtttatagtctggcatagagcaaattgaaattaaaattggaatgaatttttttctatatttaattcttttgttataaatatcattgatctaactgtaaagaataataacaaagaatcttaaaacatggatcaaaataaaagcagaattgcaaaaatatagctctcaactctggaaattaccgatctaaaaaatatacatgttgcactttaaacatttctaaagttacctcattcttcatatctacaaactatagtgccagcattcgaacatccaatatcttgggccctaaactcatgctataggttgtcttgcacttgggttgatgatgaagcaattgaaacaacatgttgcatagctcacgcttatagtaaattgatgatctgaaaaaatctacatgttgtgcttcaatcgcttttagagtcacctcatccttcatatgaccaaaactagtgctaacatgcgacaatctagggtcgcatactcatgttatggttgtcttgaacatgggttaatgatggtgtatgtgaaacaacacgttgggtccacccgtaaaaactatctgtctaataaacaatacaacatttagggcttcaaaatgcatcaaagttgacgcacattagaaatcgatatatcatgcagataacttgtacaaatataatacccattagtcccatactcatgatcggccttagacttgtgttgaagtcttcacaactgaggaacgttgcaaatagcacaatatatgttacaaggtaacatgcctaaacaagtatgtcttttaaaaaagagtaatgaaagcggaaatataaattttcttccattaactattttccattaatagagatcgtaactctgcaaaatagtttatcttgaaaaatctgcatattgcaattcaaatacttttaaagttacctcattctttaaaacactgaactttaatcggcatgcgaccatctaattatgtgggtcccatactcaagatattgattgtgttgaattttagttgatggtggagcatttgaaacaacatgttcgatcattcagtaaatctaccacataatttagggctttgaaaagcttcaaagttttcgcaaggttcatgccacaatcctttcgagaaaacatgcaggaaatcatgaccctttactcacaaatcagtgtattgcgaaaactttcatcacaaagcttgttgggtcctttttacgaaaactaccgttctaaacattacatcatttagggctttgaaccgcttcaaacatacattaatgtccataaccatgaaacatttaataattttccacatattttatgagataacatgcccaaacaagtgatgtttacagtttggcaatgagcaaattgtaatgtaattttccttggttaaattgttgtgtgataaatatcatgagtcacataattgttttttgagtggcctcaaaacatgcactgttgtccataaccaagaatcatttaaaataacactacatatg

SEQ ID NO: 833 - DNA, 3180 bp, Zea mays
taggtgtagtttagtttaactgatccaaatgaggcccaactatatgaactttgagacatatggttagcaggttactggggtcttattgggtgagaaacatcttaggctggtcaattttttatgtgtgtaaaacctcaatcatgtcacatccactcgtaagaagactcggttgtattcctgttaatagaaatggttgtttcctctctaaaaatatgttgactaacttggtctctatagacaagttttgtgacttcgtgggcaatttactctagcaggccccaaaagtcaaacaacaagttacgtacttctccataagaatgtagcaatcaataacatgcatgtttgtcaaactgacaactaagacccaattgcagcaagagcgcgtgacagttcctaacccatgagacccaatttgcagtagaaaagcatgcataagattttgttgacacctagaggagacggttcctacattgttcgactccagtgcacctaattgggcctataaataaaccaacaatacaccttaaggtagaaaattaagttgggtaaatgatcgcatgtaaatgcgacattaattttcaggcctgctccgacggtgtaaacaagcgaaactatatttttcagacttgctaaccacctgacacaaagttgatatagttaggcctcatttggatcagctaaactcgactacaactaactcttgcgttttagtcttttgttgatcgtcatttttattagtttcaagatcttcgtgcttaacaaaagagaacaaatttcccagcgcatcctcaagaaatagcatactatctttggcatttatcgccactacaagtcatctaccaatttcaacacctttatttgtgctcccacttgcagctcctcaacattatgcaaaagcttttgagctgcatcagtagcccgctttacctgtaagttcttcctcttaatggtcccaccgtaacattcttccattgtcttaagctgtttccacacataattctttttcgtttgttatgctgaaatttcattttgcttctctcatcttaggatctagtaagctttctttagtttttaatctcttccctaatctcttctccaattttttgggatccgaattgtcaatactaatatatgaaataaagtttagtgccaacaattcggatcaccaaaaaagtgaggaagatattaggtaagagataagaaaactaaagtaagcttccaagatcatgagattagaggacaatgaaaattcagcacaacaggcaaaaaagaattttgtgtggaactagcttaagacaatggaagaagattacactgggaccattaagaggaagaaaatagaggtaaagcaggctactaaagccgctaatttttttttgcataatgttgatgagttgcaattgggtgcccaaaagaaggatgatgaaattgttagactacaaatagtggcgacaaatgccaaaaagaggatgttgtttcttgaggatgagctgcaaaaattgttgcctttggtcaaggataaagatcttgaaactttataaaaataaaatcaaccagagactaaaatgcaagatttagttgctattcaggttaactaatccaaacgaggcctaactatatgaataggtggttagcaggttaccaggttcttattgggtgagaaacttttgatgccggtggattttgctatgtgggtaaaccctaaataatgtcacatccactcttctcaagactaaacacaagagttaggtgcagattagtttaactgtggcctatataaaataatgtggactaacttgttctctatagacaattttctagtgatctcgtgggccaaaagttagacgaaaagttacctacttctccacgagaaagttgcaactaataacatgcatgttcgtcaaactgaccactcagacccaattgcagcaagatttggcacacggacgaactgcaaacataatgaacagtcaggactcacaaaatcaataggattgtgctattgctctctctctctcactcaccgagaagtcatgtacacaactctctatcttgtgagtatcaggagcatcgtcttgctagctttctcctaccagagcaccacactttctcatagcactagatggcacatcattgatggatccctaaatacagcgctagcacccattaaataaatagaagtagaagacaacatgcctagaaactacacccctcgtctcgtctggggcacatgatgcacgcgtcttaccatgagaagcggtcactactgcaggccaaccatacgtgtctctccaaacataggccgcactagagcgtgttcttcaactagtggacgcaagactcgcactaaatacaggcatggtctgcatggacaaggcgccagcccgcacgcctcctccgttgctccatgcatatggggcgcgtcctttggctctgcgatccacctgaaccgctccactttttcatgtactcatcattaaactccagcaggtttcatatgaactcatgcatagtactagtatatggaatggcactccggtcgaaatccaggactgatggtctgatgtgctgcacgcatgttaggtaggcttcacacatcagtcgtgcttgcttgtccgtggagctaacttgctagcctttccctttctggtgttcttgcacctagctacaacagatcacgagagcttgcaagcccgttgtacgtgctagaggccataggctctccctagctccatctgaaaaaggctgcagcaggaaatgacttttgatcgagccgctactaatggtgcttcatctctaaggctctctattgatccatatccatgtttggtactagtatggcgcggtcgtcagcaccacatacaacactgttcggtcctagtgcaatgatggcaccttgatcgtctttctacgtctccgtcaaaaatgaactaataataatatgcaagaaaaacaaactttatatatggtcggttgtacttacttaaagctaatagttaatgtaataaataaagcaacaaattcaaaaaagggattacattatttgagtatttagttcgtgaataagttggtccccatcaagtcggccttgaacttgttatcaatgacgattgtctaaacgataatggacgccaacatggtcgagtatgtcattttatttcacggaatttattaggggac

SEQ ID NO: 834 - DNA, 3167 bp, Zea mays
gtcccctaataaattccgtgaaataatgacatactcgaccacgttggagtccattatcgtttagacagtcatcattgataacaagatcaaggccgacttgatggggaccaacttattcacgaactaaatactaaaataatgtaatcccttttttgaatttgttgctttatttattacattaactattagctttaagtaagtacgaccgaccgtatataaagtttgtttttcttgaatattattattagttcatttttgacggagacgtagaaagacgatcaaggtgccatcattgcactaggaccgaacagcgttgtgtgtagtgctgacgaccgcgccgtactagcaccaaacatggatatggatcaatagagagcctaagagatgaagcaccagcagtagcggctcgagcaaaagtcatttcctgctacagcctttttcagatggagctagggagagcatctggcctctagcacgtacaacgggcttgaaagctctcgtgatctgatgtagctaggtgcaagaacaccagaaagagaaaggctagcaagctagctccacgaacaagtaagcacgactgatgtgtgaagcctacctaacatgcgtgcatcacatcagaccatagtcctagatttcgaccggagtgccatgccatatacaagtactatgcatgagtttatatgaaacctactggagtttaacgatgagtacatgaaaaagtggaacggttcaggtggatcacagagccaaaggacgcgccccatatgcatggaacaacggaggaggagtgcgggctagcgccttatgcatgcagaccatacctacatttagtgcgagtcttgcgtccactagttgaagaacgcgctctagtgcggcctatgtttggagacacacgtacggttggcctgcagtagtgaccgcttctcatggtaagacgcgtgcatcatgtggcacagacgagacgagaggtgtagtttctaggcatgtcgtcgtctacttctatttatttaatgggtgctagcgttatatgtagggatccatcaatgatgtgccatctagtgctatgagaaagtgtggtgctctggtaggagaaagctagcaaaacgatgctctgatactcacaagatagagagttgtgtacatgtcttctcggtgagtgagagagagagagcaatagcacaagcctattgattttgtgaatcctgactgttcatttatgtttgcagttcgtccgtgtgccaaatcttgctgcaattgggtcagagtggtcagtttgaccaacatgcatgttattaattgcaactttctcgtggagaagtaggtaactttcatctaacttttggcccacgagatcactaaaaaattgtctatagagaacaagttagtccacattattttatataggccacaattaaactaatctgcacctaactcttgtgtttagtcttgagaagagtggatgtgacatgattcagggtttacccacatagcaaaatacacgacatcaaaagtttctcacctaataagaacctagtaacctgctaaccacctattcatatagttaggcctcgttggattagttaatctgaacagcaactaaatcttgcattttagtctctggttgattttatttttataaagtttcaagatctttatcattgaccaaagacaacaatttttgcagctcatcctcaagaaacaacatcctctttttggcatttgtcaccactatttgtagtctaacaatttcatcatccttcttttgagcacccaattgcaactcatcaacattatgcaaaaactttttagcgacttcagtagcctgctttacctctattttcttcctcttaatggtcccagtgtaatcttcttccattgtcttaagctggttccacacaaaattctttttttcctgttgtgctaaattttcactatcctctaatctcatgatcttggaagcatactttagttttcttatctcttacctaatatcttcctcacttttttggtgatccaaattgttgggactaaactttatttcatatattagtattgacaattcggatcccaaaaaattggagaagagattagggaagagattaaaaactaaagaaagcttactagatcctaagatgagagaaaagcacaataaaatttcagcataacaaacgaaaaagaattatgtgtggaaacagcttaagacaatggaagaatgttacgatgggaccattaagagaaagaacttacaggtaaagcgggctactgaagcagctcaaaagcttttgcataatattgaggagctacaagtgggagcacaaataaaggtgttgaaattgttaggtgacatgtagtggcgataaatgccaaagatagtatgctatttcttgaggatgcgctgggaaatttgtcctcttttgttaagcatgaagatcttgaaactaataaaaatgaagatcaacaaaagactaaaacgcaagagttagatgtagtcgagtttagctgatccaaatgaggcctaactatattaactttgtgtcaggtggttagtaggtctgaaaaatatagtttcgcttgtttacaccgtcggagcaggcctgaaaattaatgtcgcatttacatgcgatcatatacccaacttaattttctcccttaaggtgtattgttggtttatttataggcccaattaggtgcattggagtcgaacaatgtaggaccgtctcctctaggtgtcaacaaaatcttatgcatgcttttctactgcaaattgggtctcgtggtgtcacgcgctcttgctgcaattgggtcttagttgtcagtttgacaaacatgcatgttattgattgctacattcttatggagaagtaggtaacttgttgtttgactttggggcctgctagagtaaattgcccacgaggtcactaaacttgtctatagagaccaagttagtcaacttatttttagagaggaaacaaccatttctattaataggaatacaaccgagtcttcttacgagtggatgtgacatgattgaggttttacacacgtaaaaaatttgaccagcctaagatgtttctcacccaataagacccagtaacctgctaaccatatgtcagaaagttcatatagttgggcctcatttggatcagttaaactaaattgcacctaac

SEQ ID NO: 835 - DNA, 3140 bp, Zea mays
gtcccctaataaattctgtgaaataaaatgacatactcgaccacgttggagtccattatcgtttagacagtcgtcattgataacaagatcaaggccgacttgatgtggaccaacttattcatgaactaaatactcaaataatgtaatcacttttttgaatttgttgctttatttattacattaactattagctttaagtaagtacgaccgaccgtatataaagtttgtttttcttgaatattattattatttcatttttgacggagacgtagaaagaagatcatggttccatcaatgcactaggaccgaacatggatatggatcaatagaaagcctaagagatgaagcaccagcagtagcggctcgatcaaaagtcatttcctgctgcaacctttttcagatggagctagggagagcctctggcctctagcatgtacaacgggcttgaaagctctcgtgatttgctgtagctaggtgcaagaacaccagaaagggaaaggctagcaagctagctccacgaacaagcaagcacgactgatgtgtgaagcctacctaacatgcgtgcagcacatcagaccatcagtcctagatttcgaccggagtgccatgccatatactagtactatgcatgagtttatatgaaacctgctggagtttaacgatgagtacatgaaaaagtggagtggttcaggtggatcgcagagccaaaggacgcgccccatatatgcatcgagcaacgaaggaggcgtgcgggctggcgccttgtgcatgtagaccatgcctgcatttagtgcgaggcttgcgtccactagttgaagaacgtgctctagtgcggcctatgtttggagatacacgtacggttggcctgcagtagtgaccgcttctcatggtaagacacgtgcatcatgtggcccagacgagacgagaggtgttgtttctaggcatgtcgtcgtctacttctatttattaaatgggtgctagcgctatatgtagggatccatcaatgatgtgccatctagtgctatgagaaagtgtggtgctctggtaggagaaagctagcaatacgatgctcctgatactcacaagatagagagttgtgtacatgtcttctcggtgagtgagagagagagagcaatagcacaagcctattgattttgtgagtcctgactgttcatttatgtttgtagtttgtccgtgtgccaaatattgctgcaattgggtctgtgtggtcagtttgaccaacatgcatgttatcaattgcaactttctcgtggagaagtaggtaacttttcgtctaacctttggcccacgagatcactaaaaaattgtctatagagaacaagttagtccacattattttacataggccacagttaaacaaatctgcacctaactcttgtgtttagtcttgagaagagtggatgtgacatgattcagggtttacccacatagaaaaatccaccggcatcaaaagtttctcacccaataagaacctagtaacctgctaatcacctattcatgtagttaggcctcgtttggattagttaatctggacaacaactaaatcttgcattttagtctctggttgattttatttttataaagtttcaagatctttatccttgaccaaagacaacaatttttgcagctcatcctcaagaaacaatatcctctttttggcatttatcgccactatttgtagtatagcaatttcatcatccttcttttgggcacccaattgcaactcatcaacattatgcaaaaactttttagcggcttcagtagcctgctttacctctattttcttcctcttaatggtccaagtgtaatcttcttccattgtcttaagctggttccacacaaaatccttttttgcctgttgtgctgaattttcactgtcctctaatctcatgatcttggaagcttactttagttttcttatctcttacctaatatcttcctcacttttttggtgatccgaattgttgggactaaactttacttcatgtattattattgacaattcggatcccaaaaaattggagaagagattagggaagagattaaaaactaaagaaagcttactagatcctaagatgagaaaagcacaatgaaatttcagcataacaaacgaaaaagaattatgtgtggaaatagctaaagacaatggaagaatgttacggtgggaccattaagaggaagaacttacaggtaaagcgggctactgaagcagctcaaaagctttagcataatgttgaggagctgcaagtgggagcacaaataaatgtgttgaaattgttagatgacatgtagtggcgataaatgccaaagatagtatgctatttcttgacgatgcgctgggaaatttgttctcttttgttaagcatgaagatcttgaaactaataaaaatgaagatcaacaaaagactaaaacacaagagttagctgtagttgagattagctgatccaaatgaggcctaactatatcaactttgtgtcaggtggttaacaggtctgaaaaatatagtttcgcttgtttacaccgtcggagtaggcctgaaaattaatgtcgcatttacatgcgatcatatacccaacttaattttctcccttaaggtgtattgttggtttatttatgggcccaattaggtgcactggagttgaacaatgtaggaaccgtctcctctaggtgtcaacaaaatcttatgcatgcttttctactgcaaactgggtctcgtgggttaggaactgtcatgcgctcttgctggaattgggtcttagttgtcagtttgacaaacatgcatgttattgattcctacattcttatggagaagtaggtaacttgttgtttgacttttggggcctgctagagtaaattgcccacgaggtcactaaacttgtctatagagaccaagttagtcaacatatttttagagaggaaacaaccatttctattaacaggaatacaaccgagtcttcttacgagtggatgtgacatgattgaggttttactcacgtaaaaaattgaccagcctaagatgcttctcacccaataagaccccagtaacctgctaaccatatgtcacaaagttcatatagttgggcctcatttggatcagttaaactaaactgcacctaac

SEQ ID NO: 836 - DNA, 3085 bp, Zea mays
tgtaacaccccaggtgtttatattccgctcgacaacgagtataaatttaagcacgtaatatcagtgaataaaacagatgctaaaatttaatcatcttcgtctatcgcgattttaatatcgcatctgtttcgtttgtcgcgagtgcgacatcgtttttattttatctattcgggctcttcctaaatgttcgtgatattcggaacatagttgttccgaaaatcggtgcgtccggtgatgatttaaaattcatcgctcgcgcgaatacgaattcggaagctcgacctccttttacgctttttatcccgggcaaattaatttagaactcgacgaaggaagttttcggaacaaattatcaatgccaaaatccgtttaattcggtccgttgcttctcgcctcgatttaaaaaggtgaattaacggtacgaattcatccagcttccgcgtatgcgccaaatcaaatcttgaccaattgttttacaccctgatctaactgcccggatagcgaacggatttttgtttggtttcagattaatttaatacaatctaaactatcacgataacgttcaaatatgagccattaaaaatttatcaggtttaaatcaaattaaaccgtgtcacaattactgtatacatcgtatacatcgctaagacaattgggatccataatatctgtgatttttcggttaaataaattaaaaagaaaaagaaaaatatcttctaatcctatccgttcgccgcccatacccctgatctttttccatccgccgcccctggtctattttctccgccgcgcacggtccttatatcctgcgcgcgatactctcttgcttcttcctcctcgcgtcttcctccctggctgctggcgctcgaccgctcggccctgccccgacgccggccatcttctgctcggctcccagccccaacgcccagccacttcttctctccataccatggcgcctggctaattctccctgccgcgacaagctcctgctccagctcgccggagctctctgctcgtcgcgaccccccccccccccctctgctctctctccaatgcccagctcgccatggccgccgtcaagctccctggagcctcctcgccgcgtgccctgccgtcgagttcccctgcgcgcggagcttttccctccctgctccatctccctcctcgccgcgctcggatctcatcaccgccgtcctcaagatcggcgcctcctctgctccctccagtgttaacaactacggtctacgtgggaacggagtaagaaggaaatcagagagagcagaggtaggagaacaacagatgtaatttctagagaataattgtttgctcagtttttcgatacaaggatcttgactgcgcgcgtacttattcagcgccacagcccaacacagacacacgcaacctttacacgctattctgggccaagacgaaacgggctgtaggccttcggatgcgttacatttgctcgacctcttgcacactgatattttgcacgacagaaactatcgccggactctgaaaagtatcttcgtcagctacttgctcgtcttcgtccagcttccttgttgagacagtgacagtggctcatggttcagatggcgggctgctgacatccagcgtgcagaagctcccagccgagcctctctccagccatggccgcgtctcccgtgctccggctcgctgtcaggccggttttccccatctccctgcttgctccctttaccatgcgccatctcctctgctcggattttacttggccgcgcctgctccggctcatctgcgcggccgcacctagttccctgcgtacgcgccgccgtcgagttctgcgcgtcccgagctcctcttccgcttcctggcgctcgccccgctcgcggagctcccaaccgctctgctcgtcgaccgcgccccccccccccccctggccagagccctctcttccctctccctggctcttctctgcgtgctgtggtgctccagcttgccccagttgcgacgcaatccacccctcggatcgttgacgtcgtgcttcgcatcccgcctattcgataaaacacccaaacccatagagtgtcgacgcactgctgccatacgcggctatctccgtcacttccatcagctcgtcagacctgcagctctatatacgtcaccctctcgtatcgtcatcgagcccgaaccccgaatcccggacgttaggcaaaaataagcgaggtccgtgtgcatcgcttatcaagtgctcggtcgaagactttaatcgaaggtggtcgtcgtttcgtgcgtcatcaagaaatcccaagagtcgggtgaacacggagctagcagcgtgatgttcaccaagtattcgacacaagggctgaaccagaatccttgccgtgttcggggatagcgcgtcaaatttaatcgagggtaagccgatccatatttccgttagcttaattattgaattagttcggtgaatgcgatgtgattattttcacgattttggagtagtcgcgttgggaaggtttgagatattaattatgtgatgtacggtaaattagtgaatgaagtttaaatttagtatgttaaagtgtctaaacaataatattattagtattacttatgacgaattataatcgtttgataaaattaatagtatgctatatatgatagcttagagtggtatgtaatttaatccagtcgcgtggtctaaaaagtaatgtgattttattcttgttctagatttaaattccttagaccactgagcttaggatttaattaattaactgataagttgtgtttaggctaatcgtgattaatgtgtatagttggttgttcgagatgtttgcattagattcagttaatctagaaaggcgtaatcattgcgtagtcgtatatcgataactagtgtttccatatgaaacggtacaacgcctcgccgctaggtgtttatttcgccatcgcgtagcactatttaggttcgtaatattcctgtctatatgcattcatgtgcataatgcatttcattcatgtacgttaattaatcacgtgatgcggagaaaaagagccaagtcgaccccaagcgcaggctactccgcatagtaaagcg

SEQ ID NO: 837 - DNA, 3003 bp, Zea mays
ctcaaaaacaagtatgggactcatgatatttatcacaaaacaatttaaccaaggaaaattacattacaatttgctcattgctaaactgcaaaacatcacttgtttagacatgttatctcataagatatgtggaaagatatcaaatgtttcatggttatgaacattaatgtaagtttgaagcggttcatagccctaaatgacgtaatgtttagaacgatagtttttacaaaaatgacccaacaagatttgtcattaatgttttcgcaatacactgatttgggagtaaagtgtcatgatttcgtgcattttttttccaaaagattgtggcatgaaccatgcgaaaactttgaagcttttcgaagccctaaattatttggtagatttactgaatgatccaacatgttgtttgacacgctccaccaataactaaaattcaacacactcaataacttgagtataggacccacataattagagggttccataaagattaaagttcagtgttttaaagaattaggtaactttaaaagtatttgaattgcaatatgcagatttttcaagataaaatattttgcagagttacagcctctattaatggaaaaatagttaatgaaagaaaatttatatttccactttcattaatcttttctaaatgtcatcatgtaagacatacttgtttaggcatgttaccttaaaaacatatatagtgctatttgcaatgttcctcagttgtgaacacatcaacccaagtttaaggctgatcaaaacatgagtatgggactaatgggtattatattcgtacaagtttgctgcatgatatatcaatttctgatgtgtgtcaacttcgatgcattttgaagccctaaatgttgtattgtttagatcaaaacatgagtatgggactaatggctattatattcgcacaagtttgctacatgatatatcgatttctgatgtgcgtcaacttcgaagcattttgaagccctaaatgttgtattgtttacacagacagtttttatagatggcccaacgtgttgtttcgcatgcaccatcgttaacccatgttcaagacaaccataacatgagtatgcgaccctagattgtcgcattctagcagtagatttggtcatataaaggatgaggtgactctaagagcgcttgaagaataacatgtagattttttcagatcatcaatttactataggcgtgagctatgcaacatgttgtttcacatgcttcatcatcaacctaagtgcaagacaacctatagcttgagtttggggccatgatattgtatgttcgaatgctgccactatatttgtagatatgaagaatgaggtaactttagaaatgtttaaagtgcaacatgtatattttttagatcggtaattttccggagttgagagctatatttatgcaattatgcttttatttccatccatgttttaagattctttgatattattctattacagttatatcaatgatatttataacaaaagaattaaatatacaaaaattctcattccaattttatgctagactacaaacaataatagtttaggcatgctatcttaaactatatgtagtgctattttaaatgattcttggttatggacaacaatgcatgttttgaggccactcaaaaaacaattatgtgattcatgatatttttcacaaaacaatttaaccaaggaaaattacattacaatttgcttattgccaaaatgtaaacatcacttgtttgggcatgttatctcataagatatgtggaaaactttaaatgtttcatggttatggacattaatgtaagtttgaagcggttcaaagccctaaatgatgtatgtttagaactgtagtatttacaaaaggacccaacaaggtttgtcatgaaagttttcgcaatacacagatttgtgagtaagcgtcatgattttgtgcatgttttctcgaaaacattgtggcatgaaccttgcgaaaactttgaagcttttcaaagccctaaattatggggtagatttacagaatgatccaacatgttgtttcacacgctccaccatcaactaaaattcaacacaatcaataacttgagtacgggacccacataattagatggtagcatgccgattaaagttcagtgttttaaagaatgaggtatctttaaaagtatttgaattgcaatatgcagatttttcaagataaactattttgcagagttacgacctctattaatggaaaattagttaataaagaaaatttatatttccactttcatttgtcttttctaaaagacatacttgtttaggcatgttaccttaaaacatatattgtgctatttgcaatgtttctcagttgtgaacacatcaacccatgtttaaggccgagcaaaacatgagtatgggactaatgggtattatattcgtacaatttactacatgatatatcgatttctgatgtgcgtcaactttgatgcattttgaagccctaaatgttgtattatttagacagtcattttttatggatggacccaacgtgttgtttcgcatgcaccatcattgacccatgttcaagacaaccatatcatcagtatgcgaccttaggttgtcacatgctagcactagatttggtcatatgaaggatgaggtgactttaaaagtacttgaagcacaacatgtagatttttttcagatcatcaattaccaacaacatgttgtttctcatgcttcatcatcaacccaagtgcaacacaacctatagcatgagtttggggcccaagatattggatgatggaatgttgttggtagatttatagaatgatccaacatgtacatcacttgtttgggaatgtttctcataagatatgtgaaaatttcaaaagtttcatggttatggacattaatgtaagtttgaagtggttcaaagccctaaatgatgtaatgtttagaacggtagttgttacaaaaatgacccaacaaattttgtcatgcaagagaatggtaattc

SEQ ID NO: 838 - DNA, 2973 bp, Zea mays
gtagaagaacaaaagacacttctcaatcatgaggtgctctcccaaggttgtgtatgatttaatcaaccctatgtctgagcattacaagcagaggttgagaaggttgggatttggtgattttttgcggtttggtattagcaggctgttagacagatctttagggatgtttttgatgaagaatgttaagggtgacccactccggatcgaattttctgaaaagtttttacctgtcactccacaagtagtgcacctgatctttggccttccgattggtggaaagccaatcccaaagtttggtgaggacgaaaagataaaagcaagaagcgaccttaaaaacaaatgcgacgacaagggaatgcgacgtatgtatgagatggctaggatggataattacgaccgtttacagacatacgttgttcctaggtggattcttgagaattttgcttccactagtgctgaagaatttgatgattgggctgtccagtgtttcttcatcatcgtttgtagcagctttctttttccaaccagcagctactatcctcttggttcagattacctcatttgcaaggacttgaacgctttaagtgaatttgattggtgtcaagctgtggttaatgacataaaggacaagtctgccatatggaggaagaatcatagaaagaacaagaccccagtcatccaaggctgcactgctctcttgatggtaagaaatgaattttatttactgttcacttcttttttatattttcttaattgttttgtcaatatatattttgattttcacatatattattatgctgttttcagctctactatcttgacaacttggattgcccaggcgttgaacattatactgttacacctcgatggtcacagtactctaatgatcgtattggaaaaataatggatgctgaccgattgacgtcgagagatggcagtgtgtcctatggaaagttgaatgtaagtaataaatttctttcttctgtggttattctgtttttatagtctgttttgttgctaagttattacgtttgttcactcggttattctgtcccttagttagtatgtttgttcactcagttattatataccatgcccactgtcattcccttatttggatcatccctcccccttgctcgcgcagccgccaccgatccctccccctcttctccccgcgttaacacgagctatatgcaagtggttaaatgtagtgcagtgtccattcagtcattgtgtctcttttggcatgatgagatcgattttttggtttttttttatcttggtcactaaattgtttccatgttttagttgttgagcagggatcgtactgtttattccaacatacgggctgacgacgagccacagactagaggacaaaatgtgcagcagcccgctccttctgatgttgtacgggccaggtcaaaaagtgctggatctgaaagtattcaatttggcctcgttcagttggagccgttgttggcgcagtctattgcttcttatgttgttgatagtacccagaaggatgctgtgaaggatgcactgagagaatatgattgcagcgtggaaagagcgtcttgcgagatttcagagggtcagcgtaggtttgctgatgctgagcgcgctattgagaatgcaaagagacaaatccagagagggcagctggatttgcaaaaggcgcagaagaaaatgttggatgaggtgaatgcaattatgaaatttaatgatgagacacaacctcctgcatcctctccatgcgaagaacatgcaaaacggtgttcttctgtgagtttgctggcctcattcattcccttaattttgttgtcatttatttatttattaatgcctttgtcattgttgcaccagataactgcctctaggctgcatgaaaacaacagaaagcgcaaaaaggtgattattgctgaagggcgagatactgctcaagtggaggatacccgccatacaccttcaccttctcctgctcggtcaccgggccgtgattctgacacagctcatgttgtgcgtgatatagaaactgtcagccattcaatctactttgttatgtcacagccacttaatactctggtgtgctgtcagttattgttgttctgccttttgatatataatttttcagaggcaagattcatctcctccagcacagtcgccggatcgtgatgctaacgccgctcgtggcaggggcgattcatcagaacaacctgtcagtcattctgctttactatgtctctgtcatttttatgctagtctttattcttctgccttctgttttatatttttcagatgcaaggtgatcaaaatgttcagcatgatgccggtatcactggagatacagttgctgatactgtaagcaattcttgtctgtgcccccacctcactagagatacctttcattctgttttcactagttcaatgacaatgatgatcagaatcctgagaaggaacctattcatttagttgctcatgcactttttttgaattcactttgttctgttcattcggtttattgcagaatcctgagaaggaacctatgcaaaaaaaacccgtcgaattgtgatgagacacactccccctggacgtcctgtcactcggttccactgtgacaagcagtgttaaaattctgcgtgatattgactcagcgggaagctgtggactgagaagagctaagtagaaggaaacgaagaagaggaaggaagtgaaggagaagaagcaatagggactaaagttgtaaaggttcaaagcaaacccaggagcacaagctgcccttagaaattagtggcccttataaaataaaagggaatgttctcgagcagtcagggcaatacaaggcattgtaaagtagtcatatgtccaggccacccagtggtacactaccagttagatttgtcactagatactaatctcatttgtagaaaaagctttccaatgaagaaaggatgagctaaaagggacaattatggg

SEQ ID NO: 839 - DNA, 2964 bp, Zea mays
tgtaacacccctggtgtttatattctgctcgacaacgagtatgaatttaagcacgtaatatcagtggataaaacggatgctaaattttaaacatcttcgtctctcgcgattttaatatcgcatatgtttcatttatcgcgagttagatattgttttatttttatctattcagactcgtactaaattttcgtgatgtttggaacatcgttgttacaaaaatcggtgcgtccggtggttatttaacatacctcgctcgcgcaaatatgaattcggaagcccgactcactcggatgattttatcccgggcaaattaatttgagctcgacgactagaattattcggggcaaaatatctaggatcgcgtgtcgtctgagtgaaatcgtgcgcgcgaatatgattcaatttatccttcagcttgctgttgtggcgacaaaatcgcgtatacaatagcggatttggtttcggctaattttagtcgaatcccaccgaacaaattaccgaagacgaaatcagtcttattcgggccgtcgtttcttgcccggatctgaattttcggatataagtaattagcgattaaattggttcgctaatccgaagcatgtcatttgtatttttgtgttgaaaaaaaaggactgagaaatatttcctctgttgaatttttgttttctctccaatctttatcctcttcgtaggatatttcctgacgtcgtgctcatcttctctccttcatccgttcagccggcgcaagattttcctgtgtctcactcgttctcatcctctccccagccaccgtacctgactatgtgatatttttgccgccgcccctgttcgttttatatgcgcgtagctcgccagcggaagcccccaaccgagttccagccgtcggtctcatcccgtcgcggaatatttcctgctctctctcctcagccgctcggtttcttcctgtggacgcgcgctccctcccagccgatttccctgcggctcgctctcttccccaaccgcgccgggtcccctgcaagcttcagccttcctgtgcgcgtcctcccatggggctcagacttcttccgagacattgcctcttctctctgctcctccctgcaccagctcggattttcctcccatggagttcgcccgcgcctgctgctcaccggtgctccagctcgccggccgtgcagctcggccctgccctctgctccagcccgctcagtcggacccctggccgtcgtcaacgaacctcgtggtcgcggctctccgctgctagcacatgctcacattcggtctccagctcgtcgccatagcgcgtctctgtccttgcgcactcctcagtttagccatggtgctcctcctaactcgcccagccgtcgagctcctttgcgcgcgcgtactccctccctgctacatcttctcgtgcgcgtgcgttctcgccgcgccgagcgccgtgaagtctgcgcgcgccgcggctcgactctttcaccccgcgcgcgtcccctgcgtttctctgctcggcctctgttactcctctgcccgcagccgcgtcccactgcttggctacggctcatccgtcgcgctcgggtcaccctggtattccagctcgtcgtcacgttatttgccgtcgacctcgctagatcgccccttgctcgacgccggtgatggccgtcgtggagcaccgctgtgaactcccagcaccttagctctgctccaggaaatatcaagccttgaacagccatcgttttgttttgttgcgacgtgtgtgtgcgctactcgctccacgtcgtcgtctttgtgtttgggcagccccgtcgcggcatctgcaaactttgctccttgtcatcatgttctccctgtctgccaaatcgtcgcgcccgtgctgagttccctggccatcgcctcggtctggccgttggccaggacatctcaatactcggctccgaggcgtgtctccctgctccatagtgcccttcatctttcaccatcgcaacagcaacccccttgcttcttgtcgccaatacccgtcgcgtccgcgacatgcttgtggcccccgacggtttatctttcaattgcgcgttgggatccgaagctctttgtcgtgttcgaccctgcaagtctccaactcatcgtcgttccgtgcgtcatcaagaaatcccaagaatcgggtgaagatgaagatagcagcgtgatattccacaagcgctcgacaaattgcctagatcggaaaatcattaccgatcccgcggattcgagtcagctgttgaaacggtaagctgataaattattcagaatagttcgatcattgaatgaattaatgtgctagtgcgatgctcattaaggtgctcaataaattgcgtaagtcatgaaactctcgtcgacttcacaattcttgcgattatcgagccagattcagctatgacgagctatttcgctattccagtcacttagctgaattagtgtaccgagtaaaatattagtagacctgtgtgttgatgaaatattttaatcacttataaagatgaagtataatttataaagcaagggatacgtttagaatttaattaattaactgataagttgtgattaggctaattgtatttcatgtgtatagtttgttgtttcgtgttgcgttaggttcatttaatttagagaagcgtaattattgtgcgtagtcgtatatcgataactagtatttccgtatgatcttgtacaacacctcgtcgctaggtgtttaaattcgctatcacgtagcactagttagatttgtgctattcctgttttttatgcattcatgtgcataatgtatttcattcaggtacgttaattaatcgcgtaatgcggaagacaagccaagtcgaccccaagcgcgggctactccgcatggcgatgctgatggacgaacctgcctgatcaagagccaggacaaaggatggtcaagtggacgtcacctaacaacactaacctagtgtttattac

SEQ ID NO: 840 - DNA, 2891 bp, Zea mays
agatatatagtgattatctagttactaaataattttacagtctccacttagtaattttgcaccatttatttagtaagttcaatcactcagattgagtagttacatagtaattttacagtaatcactaattaattttgtagcatttgttcaacacttcctcagtcacccagtaatttcattaacacactaagaaaagaacaataaatatgcagtaattttgcagtatttgttcaacactttctcaatcactcattaattttataatgtttgtactataattatcaatcatctagtaattttgcagtattttttcaacactttctcaatcactcattaattttataacgtttgtactataattatcaatcatctagtaattttctttacacgttgagaaaagaacaacatatatgcaatgattgtctagttactcaattgatttacactagtcactcgataaatttacataattcactcagtaatttgacagcttttgttcggtaattccttaatcacacagtaatttcattaactcattgagaaaataacaacaaatgtgtagtgattatctagttactaaataattttacagtctccactcagtaattttgcaccatttattcagtaatttcaatcacccagattgagtagttacatagtaattttacagtaatcactgattaattttgcagcatttgttcaacacttcctcagtcacccagtaatttcattaacacactaagaaaagaacactaaatatgcagtaattttgcggtatttgttcaacactttctcaatcactcattaattttataacgtttgtactataattatcaatcatccaataattttctttacacttgagaaaagaacaacatatatgcaatgattgtctagttactcagttaatttagagtaatcactcgataattttacataaatcactctgtaatttgatagcatttttcggtaattccttagtcacacagtaatttcatttaccccttgagaaaataacaatagatatgtagtgattatctagttactaaataattttagagtctccactcagtaaatttgcaccatttattcagtaatttcaatcacccagattgagtagttacatagtaattttacagtaatcactcattatttttatagcatttgttcaacacttcctcagtcacccagtaatttcattaacacactaagaaaagaacaataaatatgaagtaattttgcagtatttgttcaacactttcttaatcactcattgattatataacgtttgtactataattatcaatcatctagtaattttctttacacgttgagaaaaaacaacatatatgcaatgattgtctagttacttacttgatttacagtaatcactcgataaatttacataaatcacccagtaatttgacagcatttgttcggtaattccttaaccacacagtaatttcatttacacattgagaaaataacaacatatatgtagtgattatctagttactaaattattttacagactccactcagtaattttgcaccatttattcagtaattttaatcacccagattgagtagttacatagtaattttacagtaaccactgattaattttgcagcatttgttcaacacttcttcagtcacccagtaattgcattaacacactaagaaaaagaacaataaatatgcagtatttattcaacactttttcaatcactcattaattttataatgtttgttctataattatcagtcatccagtaattttctttacacgttgagaaaagaacaacatatatgcaatgattgtctagttactcagttgatttacagtaatcactcgataaatttacaaaaatcactcagtaatttgacagcttttgttcggtaattccttaatcacacagtaatttcatttacccattgagaaaataacaacaaatgtgtagtgattatctagttactaaataattttacagtctccactcagtaattttgcaccatttattcagtaatttcaatcacccagattgagtagttgcatagtaattttacagtaatcactgattaattttacagcatttgttcaacatttactcagtcacccagtaatttcattaacacactaaaaaaagaataataaatatgaagtaattttgtagtatttgttcaacactttctcaatcactcattacttatataacgtttgtactataattatcaatcatccagtaattttctttacacattgagaaaagaacaacatatatataatgattgtctagttactcagttgatttacagtaatcactcgataattttacataaatcactcagtaatttgatagcatttgttcggtaattccttaatcacacagtaatttcattaactcattgagaaaataacaacagatatgtagtgattatctagttgctaaataattttacagtctccactcagtaattttgcaccatttattcagtaatttcaatcacccagattgagtagttacttagtaattttacagtaatcactgattaattttgcagcatttgttcaacacttcctcagtcacccagtaatttcattaacacactaagaaaagaacagtaaatattttgcagtatttgttcaacactttctcaatcactcattaattttataacgtttgtactataattatcaatcatccagtaattttctttacatgttgagaacagaacaacatatatgcaatgattgtctagttactcagttgatttacagtaatcactcgataaatttacataaatcactcagtaatttgacagcttttgttcggtaattctttaatcacacagtaatttcatttacccattgagaaaataacaacagatg

SEQ ID NO: 841 - DNA, 2858 bp, Zea mays
gtgcgacggaccaacgcgtagtggcaccgacaagctctaatttgccgtagaggagaagaaccgggcgggtcgagggtactatatagagaaatcctagccacggagtgggtcgatcgagcgcaccgaggacagcgcgggctctccagtgaggagtttgggacatctagggccacaacttggcaaggggtggagctgcatcggccggacgctgtggaggtgcggcggaccgacgtgcagaggcaccggcaagctctaattcgccatagaggagaagaactgggcgggtcggggctactctagcgagcaatcccatccacggagtggggcgatcgagcgcagcgaggccagctcgggctccggtgacgggtttgagacatctagggcctcaacttaggcaaggggtggagctacattggccggacgtcgaggaggtgctacggaccgacgtgcagcggcactggctagctctaattcaccgcagaggagaagaactaggcgggtcgggggtactctagcaagcaaacccaaccacaaagtggggcgatcgagcgcactgagacagtgcgggctccggtgaggggtttgggacatctagggcgtcaacttgggcaaggggtggagttgcatcggccggacgccgtggaggtgcggcggaccgatgcgtagtggcatcggcaagatataattcgcctaagaggagaagaaccgggcgggtcgggggtactctagcgagcaatcccatccacatagtgggcgatcgagcgcaccgaggacagcgcgggctctggtgagggatttgggacatctagggccacaacttgggcaaggggtggagctgcatcagtccaacgctgtggaggtgcggcggaccgacgcgcagcggcaccagcaagctctaatttgtcacagaggagaagaaccatgtgggtcgggggtactctggcgagcaatcccagtcacggagtggggcgatggagcgcaccgaggacaacgcgggctccggtgagggggttgggacaactagggccacaacttgggcaaggggtggagctacatcggccggacgctgtggaggtgcgtccgaccgatgcgcagcggcactgtaagctctcattcaccgcagaggagaagaaccgggtggatcgggggtgctctggcgataaatccaagccatggagtggggcgatcaagcgcaccgaggacagtgggagcttcggtgaggggtttgggacatctagggccacaacttgggcaaggggtggagctgcatcagttggacaacgtgtaggtgcggcagaccgacgcgcagcggcaccaacaagctctaattcgccgcaaaggagaagaaccgggcggtcgagggtactctggcgagcaatctagccacggagtggggtgatcgagcgcaccgaggatatcgcgggctcccgtgacgggtttgggacatctagggtcacaacttgggcaaggggtggagctgcatcgaccggaggccgtggaggtgctacggaccgatgtgcagcggcactggcaagctctaattcaccaagaggagaagaaccaggtgggttgggtgtacaattgcgagcaatcctagccacggagtggggcgatcgagcacaccgaggaaagcgtgggctccagtgcggggtttgggacatctagggccacaacttgggcaaggggtggagctgcatcggccattcatcgtgaaggtgcggcggaccaacgcgtagaggcaccggcaagctctaattcaccgtagagaagaaccgggtggatcgggggtactctgacgagcaatcccagccacggaatgggagatcgagcgcactaaggacaaggcgggttccgatgaggggtttgggacatctagggccacaacttgggcaaggggtggagctgcatcgtccggacacaatggaggtgtggcggaccgacacgcagcggcaccggcaagctctaattcgccgcagtggacaagaaccgggcgggtcgggggtactctagcgagcaatcccagccactgagtgggaagatcgagcgcaccgaggatagcgcgggatcaggtgagggctctgggatatctagggccactacatgggcaagggatggagctgcatcggccgcacgtcgtggtggtgcggcagaccgacgcgcagtggcaccggcaagctctaattcgacgcagaggagaagaaccaagcgggtcagggctactggcgagcaatcccagccacggagtggggtgatcgagcgcaccgaggatagcgcgggctccggtgaggggtttgggacatctagggccacaacttgggaaaggggtggagctgcatcggccgcacaccgtggaggtgcggcggaccgacgcgcagcggcactggcaagctctaatttaccgtagaggagaagaaccaggcgggtagggggtactctggcgagcaaccccagccacggagtggggcgatcgagcgcaccgtggacaacgtgggctccggtgaggggtttgggatatctagggccacaacttgggcaaggggtggagttgcatcggtcggacgccatggaggtgcggcgaaccgacgcgcagtggcaccgacaagctctaattcgccgtagtgtacaagaaccttgtgggtcgggggtactctggtgagcaatccgagcaacaaagtggggcgatcgagcgcaccgaagaagcgcgggctccggtgaggggtttgttacatctagggccacaacttgggcaaggagtggagctgtatcggccgcacgtcgtggaggtgcggcggactgacacgcagcggcactggcaagctctaattcgccgtagtggaaaagaacctagcgggtcgggg

SEQ ID NO: 842 - DNA, 2854 bp, Zea mays
gcatatatgttgttcttttctcaacgtgtaaagaaaattactggatgattgataattatagtacaaatgttataaaattaatgagtgattgagaaagtgttgaacaaatactgcaaaattacttcatatttattgttcttctcttagtgtgttaatgaaattactgggtgactgaggaagtgttgaacaaatgctgtaaaattaatccatgcttactgtaaaattactatgtaactactcaatctgggtgattgaaattactaaataaatggtgcaaaactactgagtggagactgtaaaattatttagtaactagataatcactacacatctgttgttattttctcaatgggtaaatgaaaattactgtgtgattaaggaattaccgaacaaaagctgtcaaattactgagtgatttatgtaaatatatcgagtgattactgtaaatcaactaagtaactagacaatcattgcatatatgtgtttgttctcaacgtgtaaagaaaattactagatgattgataattatagtacaaacgttataaaattaatgagtgattgagaaagtgttgaacaaatactgcaaaattactgcatatttactgttcttttcttagtgtgttaatgaaattactgggtgactaaggaagtgttgaacaaatgctgcaaaattaatcagtgattactgtaaaattactaagtaactactcaatctgggtgattgaaattactgaataaatggtgcaaaattactgagtggagactgtaaaattatttagtaactagataatcactacatatctgttgtattttctcaatggataaatgaaattactgtgtgattaaggaattatcgaacaaatgctgtcaaattactgagtgatttatgtaaaattatcgagtgattactgtaaatcaactgagtaactagacaatcattacatatatgttgttcttttctcaatgtgtaaagaaaattactggatgattgataattatagtacaaacattatataattaatgagtgattgagaaagtgttgaacaaatactgcaaaattacttcatatttattgttcttttttagtgtgttaatgaaattactgcgtgactgagtaaattgaacaaatgctgtaaaattaatcagtgattactgtaaaattactatgcaactactcaatctgggtgattgaaattactgaaaaaaaattactgagtggagactgtaaaatttagttaaacactacacatttgttgtattttctcaatgggtaaatgaaattactgtgtgataaggaattactgaacaaatgctgtaaaattaatcagtgattactgtaaattactatgtaactactcaatctgggtgattgactgaataaatggtgcaaaattactgagtggagagtgtaaaattatttagtaactagataatcactacatatctgttgttattttctcaatgggtaaatgaaattactgtgtgactaaggaaataccgaaaaatgctatcaaattacagagtgatttatgtaaaattatcgagtgattactgtaaattaattgagtaactagacaatcattgcatatatgttgttctttctcaatgtgtaaaaaaattactggatgattgataattatagtacaaacgttataaaattaatgagtgattgagaaagtgttgaacaaataatgcaaaattactgcatatttactgttcttttcttagtgtgttaatgaaattactgggtgactgaggaagtgttgaacaaatgttgcaaaattaattagtgattaatgtaaaattactatgtaactactcaatctggatgattgaaattactgaataaatggtgcaaattactgagtggagactgtaaaattatttagtaaatagataatcactacacatccgttgttattttctcaatgagtaaatgaaattactgtgtgattaaggaattaccgaacaaaagctgtcaaattactgagtgatttatgtaaatttatcgagtgactactgtaaatcaactgagtaactagacaaccattgcatatatgttgttcttttctcaacgtgtaaagaaaattactagatgattgataattatagtacaaatgttataaaattaattagtgattgagaaagtgttgaacaaatactgcaaaattactgcatatttattggtcttttcttagtgtgttactgaaattactgggtgactgaggaagtgttgaacaaatgctgcaaaattaattagtgattactgtaaaattactatgtaactactcaaattgagtgattgaaattactgaataaatggtgcaaaattactgagtggagactgtaaaattattagtaactagataatcactacacatctgttgttattttctcaatgggtaaatgaaattactgtgtgattaaggaactaccgaacaaaagctgtcaaatactgagtgatttatgtaaatttatcgagtgattactgtaaatcaactgagtaactagacaatcattgcatatatgttgttcttttctcaacgtgtaaagaaaattactagatgattgataattatagtacaaacattataaaattaatgagtgattgagaaagtgttgaacaaatactgtaaaattactgcatatttattattctttacttagtgtgttaatgaaattactgggtgactgaggaagtgttgaacaaatgctgcaaaattaattagtgattactgtaaaattactatgtaactactcaatctgagtgattgaaattactgaataaatggtgcaaaaattactaagtggagactgtaaaattatttagtaactagataatcactatatatct

SEQ ID NO: 843 - DNA, 2811 bp, Zea mays
tatgcaatgattgtctagttactcagttgatttacagtaatcactcgataattttacataagtcactcagtaatttgacaacattggttcggtaattccttaaccacacagtaatttcatttacccattgataaaataacaacaaatatgtagtgattatctagttactaaataattttatagtctccactcagtaattttgcgccatttattcagtaatttcaatcacccagattgagtagttacatattaattttacagtaatcattgattaattttgcagcatttgttcaacacttcctcagtcacccagtaatttcattaacacactaagaaaagaacaataaatatgcagtaattttgcagtatttgttcaacactttctcaatcactcattaattttataacgtttgtactataattatcaatcatccaataattttctttacacattgagaaaagaacaacatatatgcaatgattgtctagttactcagttgatttacagtaatcactcgataattttacataaatcacttagtaatttgacagcatttgttcggtaattccttaaccacacagtaatttcatttacccattgacaaaataacaacagatatgtagtgattatctagttactaataaattttacactctccactcagtaattttgcaccatttattcagtaatttcaatcacccagattgagtagttacatagtaattttacagtaaccattgattaattttgcagatttgttcaacacttcctcagtttcccagtaatttcattaacacactaagaaaagaacaatagatatgcagtaattttgtagtatttgttcaacctttctcaatcactcattaattttataacgtttgtactataattatcaatcatccagtaatttttttacgcgttgagaaaagaatagtttagttacttagttgatttacagtaatcactcgataattttacataaatcactgagtaatttgacagcatttgttcggtaattccttaaccacacagtaatttcatttacccattgagaaaataacaacagatttttagtgattatctagttactaaataattttacagtctccactcagtaattttgcaccatttattcagtaatttctatcacccagattgagtagttacatagtaattttagagtaatcactgattaattttgcagcatttgttcaacacttcctcagtcacccagtaatttcattaacacactaagaaaagaacaataaatatgcagtaattttgtagtatttgttcaacactttctcaatcactcattaattttataacgtttgtactataattatcaatcatgcactaattttctttacacgttgagagaagaacaacatatttgcaatgattgtctagttactcagttgatttacagtaatcactcgataattttacataaatcactcagtaatttgacagcatttgttcggtaattccttaaccacacagtaatttcatttacccattgagaaaataacaacagatatgtagtgattatatagttactaaataattttacagtctccactaagtaattttgcaccatttattcagtaatttaaatcacccagattgagtagttacatagtaattttacagtaatcactgattaattttgcagcatttgttcaacacttcctcagtcacctagtaatttcattaacacactacgaaaagaacaataaatatgcagtaattttgtagtatttgttcaacactttctcaatcactcattaattttataacgtttgtactataattatcaatcatcgagtaattttctttacacattgagaaaagaacaacatatatgcaatgattgtctagttacttagttgatttacagtaatcactcgataattttacataaatcacttagtaatttgacagcatttgttcggtaattccttaaccacacaacaatttcatttacccattgagaaaataacaacatatatgtagtgattatctagttactaaataattttacagactccaatcagtaattttgcaccatttattcagtaatttcaatcacccaaattgagtagttacatagtaatttttcagtaatcactaattaattttgcagcatttgttcaacacttactcttgtctcccagtaatttcgttaacacacttagaaaggaacaataaatatgcagtaatttggcagtatttgttcaacactttctcaatcactcattaattttataacgtttgtactataattatcaatcatccagtaattttctttacacgttgagaaaagaacaacatatatgcaatgtttgtctagttacttagttgatttacagtaatcactcgataattttacataaatcgctcaataatttgatagcatttgttcggtaattccttaaccacacagtaatttcatttacccattgagaaaataacaacatatatgtagtgattatctagttactaaataattttacagtctccactcagaaattttgcaccatttattcagtaatttcaatcacccagattgagtagttacatagtaattttacagtaatcactgattaattttgcagcatttgttcaacacttctcagtcacccagtaatttcattaacacactaagaaaagagcaataaatatgcagtaattttgcagtatttgttcaacactttctcaatcactcattaattttataacgtttgtactataattatcaatcatccagtaattttctttactcgttgagaaaagaacaacatatatgc

SEQ ID NO: 844 - DNA, 2703 bp, Zea mays
gccgcagtcgagtttagctgatcaaatgaggcctaactatatcaactttatgacaggtggttagcaagtctaaaaaatatagtgtcgcttgtttacatcgtcggagcaggcctgaaaatttatctcgcattaatatgtgatcagaaacttgacttaattttctcccttaaggtgtattgtgttctatgggttagctcatccctcatagtttgagtcattgttgggttaatttataggcccaattaggtgcgctggagttggaaaatttaggatccgtctcctctaggtgtcaacaaaatcttatgcatgaatttctacttcaaattgggtcgcgtgggttaggaactgtcgtgcgctcttgctgcaatcgggtctaagtggtcagtttgacaaacatgcatgttattgattgctactctcttatggagctgtaggtaacttgttatttgacttttggggcctgctagagtaaattgcccacgagggcactaaacttgtgtaaaaagaccaagttagtccacatttttaagagaggaaacaccatttctattaataggaaacaaccgagtcttcttacgaggggatgtgacatgattgaggttctacacataaaaatcaatcagcctcaaaagtttctcacccaataagaccctagtaacctgctaaccatatgtcacaaagttcatatagctgggcctcatttggatcagttaaactaaaccacacctaacacttgtgtttagtctcttgaagtgtggatgtgacatgattcaggtttacccacatagcaaaatccaccggcaacagaagtttctcacctaataagaaccctgcaacctgctaaccacatgttcatatagttaggcctcatttggattagttaatctggactacaactaaatcttgcattttagcctctagttgattttatttttataagtttcaagatctttatccttgacaaaagacgacaatttttgcagttgacatgtgtcgccactttttgtagtttaaaattttcatcaccttgttttgagcacccaattgcagctcatcaacattatgcaaaagctttttagcggcattggtagcctgcatccaagttcttcctcttaatggttccattgtaatcttcttctattgtcttaagctagttccacacaaaattcttttctgtcagtcatgctgaatttttattgtccttctctgatctcatgatcttggaaccatttttagtttccttatatgttacctaatatcttcctcacctttttggcgatccaaattgtcgggactaaactttattatatagattagtattgacattttgggtctccaaaaaatagagaagagattagggaagagattaagaaactaaagaaatcttacgggattctaagattagagaagcacaatgaaatttcagcataacaaatgaaaaataattatgtgtggaaacaacttaagacaatggaagaatgttatggtgtgaccattaagaggaagaacttacaggtaaagcgggctactgaagcagcacaaaaggttttgcataatgttgatgagctgcaactgggagcccaaataaaggatgacgaaattgttagattacaagtagtgacgacgaatgccaaagatattatgccatttgttgaggatgcgctgcgaaaattgttctcttttgttaagcataaagatcttgaaactaataacaatgaagaccaacaaaagactaaaacgcaagtcttagctgcagtcgagtttagctgatccaaatgaggcctaactatatcaactttatgacaggtggttagttggtctaaaaaatatagtgtcgcttgtatacaccgtcggagcaagcctgaaaatattctcgcatttaattgcgatcatacacccaacttaattttctcccttaaggtgaattatgttctatgggatagctcatccctcatagttggagtcattgttgggttcatttatatgcccaattaggtgcgctggagtcgaacaatgtaggatccgtatcctctaggtgtcaacaaaactttatccatgcttttctactacaaattgggtctcgtgggtcaggaactgtcatgcgatcttgctgcaatcgggtcttagtggtcagtttgacaaacatgcatgttattgattgctactttcttatggagaagtaggtaacttgttgtttgacttttggggcctgccagagtaacttgcccatgaggtcactaaacttgtctatagggaccaagttagtccacattttttagagaggaaatacccattctattaataggaatacaaccgaatcttgttaagagtggatgtaacatgattgaggttttacacacataaaaaattgaccagccttagaagtttctcacccaataagaccccagtaacctactaactatatgtcattaagttcatatagttggcctcatttggattagttaaactaaactacacctaactcttgtgtttagtctctagaagattggatgtgacaggattcaggtttacccacgtagcaaaattcaccgacatcagaagtttctcacccaataagaactcagtaacctgctaaccacctgttcatatagttaggcctcatttgaattagttaatctagactacaactaaatcttgcattttagtctctagttgatttattataactttcaagatctttat

SEQ ID NO: 845 - DNA, 2690 bp, Zea mays
aatgacatactatctttggcatttgtcgccactacttgtagtctaacaatttcatcatcctttatttaagctcctacttgcagctcatcaacattatgcaaaatcttttgagctgcttcagtagcccgctttacatatgagttgttactcttaatggtcccaccataacaatcttccattgtcttaaactgtttccacatataatgtttttcgtttgttatgttgaaatttcattgtgattctctaatcttagaatcttgtaagcttaatttagttttttaatctcttccctaatatcttctccaattttttaggtatacggattgtcagtactaatttatgaaataaaatttagtcccgacaattcagatcggtaaaaaagtgagaaggatattaggtaagagataaggaaactaaagaaagcttccaagatcacgatatcaaagaaggacaaagaaaactcagcataactagccgaaaagaattttgtgtggaaacaacttaaaacaattgaagaagtttacaatgtgaccattaaaaataagaacatagaggtaaaacaagctactgaagccactaaaaagttttttcataatgttgatgatctgcaattgggtgccaaaagaagaatgatgaaattgttagactaaaaatattgacgacaaatgccaaaaagaggatgtcgtttcttgaagatgagccacaaaatttatcgtctttgatcaaggataaaaatcttgaaacttataaaaataaaatcaaccagagactaaaatgcaagatttagttttagtcttgattaactaatccaaacgaggcctaactatatatgaacaggtggttagcaggttactgggttcttattaggtgagaaatttctgatgccggtggatttttgctatgtgggtaaaacctgaatcatgtcacatccactcttctatagactaaacataagagttagatgcagtttagtttaactgatccaaatgaggcccatctatatgaactttgtgacatatggttagcagattactggggtcttattgggtacgaaacttctaaggctagtcaatttttatgtgtgtaaaacttcaatcatgtcacatccactcgtaagaacacttagttgtattacacttaatagaaatgggtgtttcctctctaaaaatgctctaacttggtctctatagacaagtttagtgacctcgtgggaaatttactctagtaggcccaaaaagtcaaacaacaagttacctacttctccataagaaagtagcaatctataatgtgcatgtttgtcaaactgaccacagagacccgattactaagagcgcacgacagttcctgacccatgagacccaatttgtagtagaaaagcatgcataagattttgttgacacctagaggagacggatcctacattgcccgactccagcacacctagttgggcctataaatgaacccaacaatgactccaactatgagagatgtctatcccatagaacaaaatacaccttaaagagagaaaattaagtcgggtgtatgatcgcatgtaaatgcgagattaattttcaggcctccctgacgctataaacaagcgacactatatttttagacctgctaaccacctgtcataaatttgatatagttaggcctcatttggattagctaaactcgaatgcagctaactcttgtgttttagtctcttgttgatcttcatttttattaaatttaatatctttatgcttaacaaagaaacaattttcgcagcgcattctcaacaaatgacatttatttttggcatttgttgtcactacttatagtctaacaatttcaccatcctttatttaggctaacacttgcagctcatcaacattatgcaaaagtttttgagctgttttcgtagcccactttacctgtatgttgttccttttaatggtcccaccataacattcttccattgttttaaactgttttcacacataattgtttttcgtttgttaagttgaaattgcatggtgcttctctaatcttaggatcatgtaagctttatttagtttcttaatctctttgctaatatcttctctaattttttgggtatccgaattgtcaatactaatttatgaaataaaatttagtcccgacaattcagatcacaaaaaaagtgaggaagatattagataagagataagaaaactaaagaaagcttccaatgtcatgagatcagagaaggacaaagaaaattttatgtggaaacagtttaagacaatggaataagcttacaatgggaccattaagcgtaagaacatagaggtaaagcaagctactaaagcaagtaaaaagcttttgcatattgttgattagctgcaattgggtgcccaaaataaggatgatgaaattgttacactacaaatagtaccgagaaatgccaaaagaaatgatgtcgttttctttaggatgagctgcaaaaattgtcgtctttggtcaaggataaagatcttgaaacatgtaaaaataaaatcaaccagagactaaaatgcaagatttatttgtagtctagactaactaatccaaatgaggcctaactatatgaacaggtggttagcaggttactgggttcttattgggtgataaacttctgatgccggtggattatttctatgtgggtaaaacctgaatcatgtcacatc

SEQ ID NO: 846 - DNA, 2673 bp, Zea mays
gttatggacgtcaatgtcagtttcaagaagttcgaagtcgtttcttggttatgtacacatcaactcacatttgagaccgctcaaaacatgagtatgggacaaacaatattaattttgaccaaatttgttgcataatatatcgatttctgatgtggatcaacttcgaagcattttgaagccctaaatgttgtattgtttagatacacagtttttacagatagacccaactgtatctaacatttgtttcatatgcttcatcatcaacccaagtcgaagacaatctatagcatgagttcggcgcccaacatattagatgtatgaatgctcgcacttgagtttggacatgcagaacaatctaactttagaaatgtttagagggcaacatatatattatttagattcataatttttcagaagttgagatgtttagaaatgtttagtgggcaacatacatagaaatgtttaaagggcaacatatatatatttatgatattcgacttttatttccatccatgttttaagtttattttttactattctattatggttatatcaatgatatttataacaaaagaattaaataaagaaaaaaatcattccaattttaattacaatttgctcattgcaagaatataaacaataccgatttaggcatgctatctagaaaaatatatagtgtttttttgttatttgttggttatggacaacaatgcatgttttgaggtcacttcaaaaacgagtatgggactcatgatatttatcacaaaatatttaagcaaaggaaaattacattacaatttgctcattgctaaactgtaaacaatacatgtttgggattgttatatcattagatatgtagtgttttttttcaaatgtttcttggttatgaacatcaatgtaagtttgaagaggttcgaagccctaagtgatgtaatgtttataacggtagtttttacaaaagggatcgaacatgttttttcacacgctcggttatccacgtaagtacaagacatatatagtgctatttgtaatgttccttgtatatgtacacaacaatccaagtttgaggccgctcaaaacatgagtacgagactattggtattaattttgtgcaattttgcagcacaatatatcgatttctgatgtgcatcaactttgaaacattttaatgccacaaatgttgtattgtttagatagacagtttttatagatagacccaactctatccaacttttgtttcatatacttcatcgtcaacccaagttcaagacaacctatagcatgagtttggggcccaacatattggatgtttaaaccatgctagtttagacccattaattcagaaggtacgtagtagattttgtaatgtttcttgataatggaaacatcaacctatgtttgaagccactcaaaaaattgtatgggagtaaagggtcttgatttcttgcatgctttctccaaaacattgaggcatgaagcacgacaactttaaattgtttcgaagccccaaatatatatatttttaatcggcagtttttatataatgatccaacatgttatttcacatgttccgacatcaaccaaagttcaacacaatcaatactttagtatgagacccacagaattagatgcatgctgtcattaatgttcagtgatataaagaattaggtaaattgaaaaaccatttgaatcacaatactcagatttttttggggtaaactattttgtagagttacgggctatatttaaggaaaaataattaattaaaggaaatttatattccatctttcaagactcttttctgattgtcgttctgtaaaccatacttgtttaggcttattatttgaaatgtacgtaataatattttccatgttcctcacttatgaacacattaacccaagtttgaggccactcaaaaacatgagtatgggactaatgggtattaacttcgtatatgtttgctacataatatatcaatttctcatgtgcgtcaactttgaagcattttgaaggcgtaaatgttgtattgtttagatagaaagtttttacatatataaccaacttgttatttcgcatgctccctcattaacccaacttcaagacaatcattactattctactatagatataccaataatatttatcccaaagaattaaatatagaaaaacatcattccaactttcattacaattagcacgttgatagactataaaaatactggtttgggcacctcatcttagaagatatgtagtgttgtttcaaatgttccttggttaaggacatcaatgcaagcttgaggccactcaaaaacgagtatgggactaatagtatttatcataaaacaattaaacaaagaaaaattacattacaatttgctctcgttgccaaattgtaaacattacttgtttgtgctagttataacataagatacgtattggtttttcaaatgtttcatggttatggacatcaatgaaagtttgaagtggtttgaagctctaattgacataatgttctgaatggttgtttttacagaagtatccaacatgttgtttcacgcgctccattatcaacgtatgttcaaaatccatagtatgtgactagtacaattgaatggtctagaggaatgaggtaaatttataaatgtataaagccatcatgtatacttttctaga

SEQ ID NO: 847 - DNA, 2672 bp, Zea mays
cctttccgtcttcatcttttaatacataataatttgtgggaagtgtttttggtgacatccattatatttgggaaaatggggtgttacgacgacatttagaaaaagagtaatgaaagtggaaatataaattttcttccattatctatttttccattaatagaggccgtaacgctgcaaaatagtttatcttgaaaaatctacatattgcaattcaaatactttaaacttacctcattcttaaaaacaataaaattgaatcggcatgtgaccatctaaatatgtgggtcccaaactcaagttattgattgtgttgaattttagttgatggtggagcgtgtgaaacaacatgttggatcattctttaaatctaccacataatttagggtttcgaaaagcttcaaagttttcgcatggttcatgccacaatcttttcgagaaaacatgcacgaaataatgaccctttactcacaaaacttgttgagtcatttttgtaaaaactaccattctaaacattacatcatttagggctttgaaccgcttcaaacttacattaatgtccatcaccatgaaacatttgaaattttttcacatatcttatgagataacatgcccaaacaagtgatgtttatgatttggcaatgaaaaattgtaatgtaattttccttggttaaattgttttgtgataaatatcataagtcccatacttgttttttgagtggccccaaaatatgcattgttgtccataaccaagaatcattaaaaatagcgctacatatggtttaagatagcatgcctaaactattattgtttatagtctagcatagagcaaattgtaattaaaattggaatgaatttttttctatacttaattttttgtaataaatatcattgatataactttaatagaataataacaaggaatcttaaaacatggatcgaaataaaagcagaattgcataaatatagctctgaactctagaaaattaccgatctaaaaaatatacatgttgcactttaaacatttctaaagttacctcattcttcatatctacaaactacagtgccagcattcaaacatccaataacttggtccccaaactcatgctataggttgtcttgcacttgggttgatgatgaagcatgtgaaacaacatgttgcataactcacgcctatagtaaattgatgatctgaaaaaaatctacatgttgtgcttctagcgcttttagagtcacctcattcttcatatgaccaaatctagtgctagcatgcaacaatctagggtctcatactcatgttatggatgtcttgaacatgggttaatgatggtgtatgagaacaacacgttggttccatccttaaaaactgtctgtttaaacaatacaacatttagggcttcaaaatgcatcgaagttgacgcacataagaaatcgatatatcacgcaacaaactgtatgaatataataccaatcagtcccatactcatgttttgatcggccttaaacttgggttgatctgttcacaactgaggaacgttgcaaatagcacaatatatgttttaaggtaacatgcctaaacaagtatatcttacagtacgacatttagaaaagagtaatgaaagtagaaatataaattttcttccattaactatttttccattaatagaggtcgtaactctgcaaaatagtttatcttgaaaaatctgcatattgcaattcaaatacttttgaagttacctcgttcttgaaaacactcaactttaatcggcatgcgaccatctaattatgtgcgtcccatactcaagttattgattgtgtttaattttagttgatggtggagcgtgtgaaacaacgtgttggatcattctgtaaatctaccacataatttagggttttgaaaagctttagagttttcgtatggttcatgccacaatcttttcgagaaaacatgcacgaaatcatgacccttttactcacaaatcagtgtattgcgaaaactttgatgacaaaccttgttggatcctttttgtaaaaactaccattctaaacattacattatttagggctttgaactgattcaaacttacattaatgtccatatccatgaaacatttcaaaattttccacttatcttatgagataacatgccaaaacaagtgatgtttaaattttggcaatgagcaaattataatgtaattttccttggttaaattgttttatgataaatatcaggagtcccatacttgttttttgagtggcctcaaaacatgcattgttgtccataaccaagaatcatttaaaatagcactacataaagtttaagatagcatgcctaaactattattgtttatggtcaggcataatgcaaattgaaattaaaattggaatgattttcttctatatttaattcttttgttataaatatcattgatataactgtaatagaataataacaaagaatcttaaaacatggatcaaaataaaagcagaattgcataaatatagatgtcaactctggaaaattaccgatctaaaaaatatacactattcatgtggtgtcatccctagatatggtgtttttcgtatttgtttcttaactcgtgcacgctatgtttttcgtgaactgaacactttaacttatctcgttgttcctatttgaaatgtttgtgtaaact

SEQ ID NO: 848 - DNA, 2665 bp, Zea mays
tgatttcgttcatgttttttcgaaaagattgtggcacgaaccctgcaaaaaactttgaagcttttcgaagccctaaattatttggtagatttacagaatgatccaacatgttgtctcacacgctccaccaacaactaaaattcaacacactcaataacttcagtatgggacccacataattagatggtcgcatgccgattaaagtttagtgttttaaaggatgaggtaactttagaagtatatgaattgcaatatgcagatttttcaagataaactattttgtagagttatggaaaaatagttaatggaagaaaatttatatttacactttcattactcttttctaaatgtcgtactataagacatacttgtttaagcatgttaccttaaaaacatatatagtgctatttgcaatgttccttagttatgaacacatcaacccaagtttaaggccgatcaaaacatgtgtataggacaaatgggtattatattcgtacaagtttgctgcatgatatatcgatttctgttgtgcgtcaacttcgaagaattttgaagccctaaatgttgtattgtttagacaggcagtttttacagatgggcccaacgtgttgtttcgcatgcaccatcattaacccatgttcaagacaaccataacatgagtatgcgaccctagattgtcgcatgcaagcaatagatttggtcagataaaggatgaggtgactctaaaagcgcttgaagcacaacatgtagatttttttttcaaatcatcaatttactacaggcatgagctatgcaacatgttgtttcacatgcttcatcatcaacctaagtgaaagacaacctatagcatgagtttggggcccaagatattggatgttcgaatgctgccactatagtttgtagatatgaagaatgaggtaactttagaaatgtttaaagtgcaacatgtatattttttagatcggtaattttccggagttgagagctatatttatgcaattctgcttttatttcgatccatgttttacgattctttgttattattctattacagttatatcaatgatatttataacgaaagaattaatatagaaaaattttcattccaattttaattacaatttgctctatgctagactataaacaacaatagtttaggcatgctatcttaaaccatatgtagtgctattttaaatgattcttggttatggacaacaatgcatgttttgaggccactcaaaaaacaattatgtgactcatgacatttataacaaaacaatttaaccaaggaaaattacattacaatttgcttattgccaaactgtaaacatcacttgtttgggcatgttatctcataagatatgtggaaaatttttaaatgtttcatggttatggacattaatgtaagtttgaagcggttcaaagccctaaatgatgtaatgtttagaggacccaacaaggtttgtcataaaatttttgcaatacactgatttgtgagtaaagggtcatgatttcatgcatgttttctcgaaaacattgtggcatgaaccatgcgaaaactttgaagcttttcaaagccctaaattatgtggtagatttacagaatgatctaacatgttgtttcacacgctccaccatcaactaaaattcaacacaatcaataacttgagtatgggacccacataattagatggtcgcatgtcgattaaagttcaatgttttaaagaatgaggtaactttaaaagtatttgaattgcaatatgcagatttttcaagataaactattttgcaaagttacgacatctattaatggaaaaaaatatatttccactttcattactcttttctaaaagacatacttgtttaggcatgttaccttgtaacatatattgtgctatttgcaacgttccttagttgtgaacacttcaacccaagtttaagaccgatcaaaacatgagtatgggtctaatgggtattatattcgtacaagtttgctgcatgatatatcaatttctgatgtgcgccaacttcgatgcattttgaagccctaaatgttgtattgtttagacagacagtttttacggatggacccaacgtgttgtttcgcatataccatcattaacccatgttcaagaaaaccaaaacatgagtatgcaaccctagattgtcgcatgttagcactagatttggtcatatgaaggatgatgtgactctaaaagcgattgaagcacaacatgtagattttttcagatcttcaatttaatataggcgtgagctatgcaacatgttgtttcaattgcttcatcatcaacccaagtgcaagacaacctatagcatgagtttggggcccaagatattggatgttccaatgctggcactagagtttgtagatatgaagaatgaggtaactttagaaatgtttaaagtgcaacatgtatattttttatatcgataattttccggagttgagagctatatttatgcaattctgcttttatttcgttccatgttttaagattctttgttattattctattacagttatatcagtgatatttataacaaaagaattaaatatagaaaaattttcattccatttaattacaatttgctctatgctagactataaacaacaataatttaggcatgctaacttaaaccatat

SEQ ID NO: 849 - DNA, 2655 bp, Zea mays
acttaagcacgggatgtcgatgaggatagcaatctctatatcctaatcatattcgcctattagaagatatcaccttcatctatgtctatctggactatccaaaatatttcgcgaagtttaggcttctagtgctgttcagattggtcgagcacgtgaatgcaaatatggaatttaactcagccttgtaattttgcctcaaataaatttattacaattcaacaactaaaatgttcggtgcaaaatattctgtaccgccccttgtccaagagaaaccatgcgcgaggatgataatcaagtatttgggttcttagcagatgagatttatctcgtttcaattaaattcgacatagtatggaatatccatccaatcttgtttggtctggtccatatgtttcttgtctcgatctaaatcttcaaatataaataacgagtagaaattcatctgactacggagtattcactaaatcaaattctatccaaattttgtttctaatactgttctaatccaacttgtctatgtatctttttaaccctaatctaaaaattgtgtatatctgtattgcttgtgtaaaaataataaaaaaactgaggaatatctcctctgctgattttttctctccagtccttatcctcttcacgggatatttcctggcgtcgtcctcatcttctctccttcatctactcacactactgtgcatggccattgaccttatctccaagccgcgctctagtctctggctcccatgcgctcgccccctgtgcacgagtcgccttctccgacaacgtgtgcctcatcggctgccatgccgcatacgcctcatccgcccatgcccccttctccagcgtcaaacgcctcctcctaggcgccacggggaggaacccagactcctccctcccgtgcgaccttccccacctccctttctccatctcccacgccgccgttggcggcgccgtcgtccccattgaccacatcggccgcctcatcgcgcctctccctagagctgggcccttcaccggaccgcctctccatacgctcgcccttggccatggcgcccaggctctgctcggccctcatctcgtcttggtctggctcggctgcgtccctctagttctggtggccaaccaccacgcccctgctgtctcaaccaccagccaagtgccgcacctttgtgctcgtatctggagctcacccgacctccagctcgcctgtagcatgatcgtcgcgctgtctttgctcgttgggctgtgcgttgccgtgcccacacgtccgacacccctgctcctcggcagaccttcccctgctcgaatgccgcgcccagtggccagacaccccaaaacttgataggtttggcttggtcatgtgcttgtggtggagctatgtgtaaatgagtggaagtcttggaggtgttgatagataagaaagtaaagctcggtttgacactcgtcatatgttcgacaaaaaccccgaaccaaaaatcatcagcgttcttgcaaatttgagccgggtatagttctggagaaatctaaggatgtcaattactgaagaagcgaggctcgtgcacatcgctcgtcaagtgttcagtcgaagacttcaatcaaaggtcgtcgtcgttcatgtgatgattgagccaaattgcaatatggtgagttgattcgttatttctgttattagttcgatgatgggattaacatatatattgttgatggaaaagtcatgtttgaattgcagatttatgggaatattgtattggtttgtatatatgtgaggagtgcgtgatgagtaggataggttcagggttctaagtaactggctgatatggggtgtcgatattaatcgcactaaaggtgtgtttggtggagtcggtgacatgctatagtaaccattatattttatatttaatgataacaatcaatgtaatttgctgaatgatatataggaatatatctagattattatgtcgttattacgatcggcttatgtctagggttggtaggaatgtttgtggcaaaatcgataatcttgcagcttatgcgcttgctcctgctagtttatcctcacacgtgggtgtgtagtgtctggctagcaaatgctttatgtttgtatgttgggaattagttttaaatcacttgttatgtaaagagtgcagttgcattagttatatgaaagatgaattagtaagttcggtgagtgccacttgtgcttatattaggttttatttatgtgatgaaatgaggttacacctgctagatcaaacaaataaatattgtatttaactcatattctatacaagttaatcagatgaaatggcttagaaagctagttatagagtttctattcatatttggatgtttagatgtccaaggttaatgagttaagttttaataaccaattagtgcattctctagctaaggaaggtatagtgtctgtgcgtagttgaatgctttgtgatgtttgaactagatccgaccaagttggacaagcatggtagtatacttattcttatgtctacaactagtgtgttactcataagtgttgtagagtgtgtgtttagttttgtcttttggcatgtgaattggatcctgttatgttagaataacgtggatgttgtacgtagtgttgtttcgacatctagtgtttgtttatgagtgttgtaa

SEQ ID NO: 850 - DNA, 2654 bp, Zea mays
aatacttttaaagttacctcattctttaaacagtgaactctaatcggcatgcgaccatctaattatgtgggtcccatactcatgttttgattgtgttgaattttagttgctggtggagcatgtgaaacaacatgctggatcattctataaatctacagcataatttagggcttcgaaaagtttcaaagtttttgcatggttcctgacacaatcttttcgagaaaacatgcacgaagtcatgacccttcactctcaaatcagtgtattgcgaaaactttgatgagaaaccttgtttggtcgttttgtaaaaactaccattctaaacattacatcatttagggctttgaaccgcttcagacttacattaatgtccataaccatgaaacatttgaaatctttccacatatcttatgagataacatgcccaaacaagtaatgtttacagtttggcaaagagcaaattgtaatataatttgccttggttaaattgttttgtaataaatatcatgagtcccatacttgttttttgagtggcctcaaaacatgcattgttgtccataaccaagaaatatataaaatagcactacataatgtttaagatagcatgcctaaactagtattgtttatagtctcccatagagcaaattgtaattaaaattggaacgaaattttttctatatttaattcttttattataaattaatataaatgtaatagaataataacaaagaatcttaaaacatggatcaaaataaaagcagaattgcataaatattgctcacaattccagaaaattaccgatctaaataatatacatgttgcactttaaacatttctaaagttacctaattcttcatacctacaaactctagtgccaccattcgaacatccaatatcttgggccccaaactcatgcgataggttgtctatgttttaaggtaacatgcctaaacatgcatgtcttacagtacgacatttggaaaagagtaatgaaagtggaaatataatttttcttccattaactatttgtactttaatagaggtcgtaactctgcaaaattgtttatcttgaaaaaactgcatattacaattcaaataattttaaagttacctcattcttcaaaacactgaactttaatcggcatgcaaccatctaattatgtgggtcccacactcaagttttgattatgttgaattttagttgctggtggagcgtgtgaaacaacattttggatcattctataaatctaccacataatttagggctttgaaaagcttcaaagttttcgcatggttcatgccacaatgttttcgagaaaacatgcaggaaatcatgacccttgttgcgaaaatcataacatcattgtattgcgaaaactttgatgacaaaccttgttgggtcgtttttgtaaaaactttcattctaaacataacatcatttattgctttgaacgtcttcaaacttacattaatgtccataaccatgaaaaatttgaaatctttccacatatcttatggtttaagatagcatgcctaaactagtattgtttatagtctcgcatagagcaaattgtaattaaaattggaatgaaattttttctaaatttaattcttttgttataaatatcattgatataactataatagaataataacaaagtatcttcaaacatggatcaaaataaaagcagaattgcaaaaatatagctctcaactccagaaaattacagatctaaaaaatatacataattcactttaaacatttctaaagttaactcattcttcatatctataaactatagtgccagcattcgaacgtctaatatattgggcccaaactcatgctataggttgtcttgcacttgggttgatgatgaagtatgtgaaacaacatgttggatagctcacgtctatagtaaagtgatgatctgaaaaaaatctacatgttatgctttaagcgcttctagagtcacctcctccttcatatgaccaaatctagtgcaagcatgctgcaatctagggtcgcatactcatgttatggttgtcttgaacattggttaatgatggtgcatgcgaaacaataagttgggtccatccgtaaaactgtatgtctaaacaatacaacatttagggcttcaaaatgcatcaaagttgacacacactagaaatcgatacatcatgcaataaacttatatgaaattaatactcattagtcccatactcatgttttgattggccttaaacttgggttgatgtgttcacaactgaggaacattgcaaatatcattatatatgttttaaaacatgcctaaacaagtatgtcttgcagtacgacatttagaaaagagtaatgaaagtggaaatataatttttcttccattaactatttttccattaaaagaggtcgtaactctgcaaaatagtttatcttgaaaaatctgcatatagcaattcaaatacttttaaagttatctcactctttaaaacactgaactttaatcggcttgcgaccatctaattatgtgggtcccatactcaagttattcattttgttgaattttagttgacggtggagcgtgtgaaacaacatgttggatcgttctgtaaatctaccacataatttagggcttcgaaaagcttcaaagttttcgcta

SEQ ID NO: 851 - DNA, 2652 bp, Zea mays
agaagaaggcatcacgacctttcataagcaaatgctagctatcgccatatgaccaagcgcaataatcacgcttctctagattaaccaaatctaacgcgaacattccgaaacagcaaaccatacacactaagtacaacactcacgttcccgctttctaatcggatctaattctgaaattaagcaagaataaattatttaacccacactatcatccttagtaaaatatatttcagaagtctaataaaacctggactcgctattattaaatgctaacgacttaaaattgctatagggacaatctaattaactctttaaaccgtgcgtcttaattaacctgaattaccgacttaactagatcgatcatcacaatatacgtaggctaaattaataacaattatcgcgaccaacaattttatttaatctatttatatacctagttgactggaacaacaaatcaacttactatcattaaatccgacttgaaaccacgaaattgaaggtgctatccggtccgcgcacaacaccgaacacctgacaagtgttgcacatagctgcttttagacttcgctttcttcaaccataactccatccacaattaacctggctcgagattcgcgagaacgcccataattcttgatttgggtttttcgtcaagcatccaacgagcgtcaatctggggctttgcccttacaccatccacagctctgtcttcaccaacccaccacacacatacaatcaccgactcaaggttcatgtcgatgttgaagtcctgagccgccattgacagcacgaggcgtacggtagggctgaaggacagctaggacgatatgtcgcaggctcgtgcagacaccgaagcagttgcacgaagcgagtcgtcagctgagcataatggctaaaggaggcgatggcgcgtgcgcacaaaggacatgcatgactggaggagcaccaggtccatagttgaagcgaggaaccgagctggcggcaggcgcgctgaagaaaccgagcaaggacgcggcgaagatacataggcttgcgacctaggcgaactcggcgtctgcgagaccgggcaggaagggcgcgacgtagagggagctctgcatgggcgtggctggggaaaacggcgtgagctggagcaagatgcagggacgcggtccaacgagtggcagcggataaagaccactagagctcgacgccgaccaaacttgctagagagagggactaggcgagcgtagcagcaacgcaaagtcgcggccgggcgaacactatggcgcggactgttccacggccaggacggctgccgggacgcgcacgatgtcgccacgccacaacatcaccacggccaggaaccacgggagcagcgcgctgtccgccgaggtcgacggggctaccagagcacccgcaaggaagcagagaggagcaggcaaggcgggcgcgcgtcccatgagcgagcgcaggggcacgcagaccgagtagagggagctggggggggggggggtcgtgatgagcttggggagatgggtgtgctggagctgggcgccgggaagaagagaccgccaggcaccaggagggagtcgctcggcgcgtgcagggaagacggaggacgcgcggcgtgcgggagctcgacggcggccatgagaacgagcttgaaggagcgccagccatgggggagagagaaaagcagggggcgagcagggcgcggcagaggagcgaggcgagcaccagggagcagcgcgcgtggcgcagaggcgagcagggcgcaatggatcggcgccatgggcaaccagggaaaaagcagggggctggaagtcgcgtgggagagagaagcaggggctaggggcgcacaggcacttgggcgcgcggcacggaggaagatggagcagggagggcgcggctacgaaggagaccagggacagggagtgggacgacggataaggctgcttgcggtgaaaaaatctgaggagaacggcggtggagatatttgaggatttttcatttttcttttctctctctttttttaaggaaaatcgtagatattttggatcacgatttttagcgatgtatactgggtcgacacgctatatggttacacatttcattctccaaatttagcgaaccaaattatttaccaattactcgctttcaattctagttacactggtctggtttgtttcggacaggatgtaaatggaccggactaaacggatttcggcttcgatattttaatctgcatttgattcagttgactttagacgaattccgtttgctactcgaaaactcaactacagaacaattcaattgaaaatccgtagacgcgatgtcacggatgtcaaaaggggactaaattattttacactgaaaacttagtcgtcgagttctacttaatctgtttgagatgaaatcggaggactggactgaatttccaaattcgtatttgcgcgagcgatgaattttaaataatcaccggacgcactaatttttggaacaactatgttccgaacatcacaaaaatttatgaagagcccggataataaaaataaaaacgatgttgaactcacgacagacgaaacagattaatacagagagactattatccttattaatattctcgtacttacgttcatattcgctgtttacgaacagtaacacttgggg

SEQ ID NO: 852 - DNA, 2634 bp, Zea mays
aacaaaagaattaaatatagaaaaaatttcattccaattttaattacaattttctctatgcgagactataaacaatactagtttaggcatgctatcttaaaccatatgtattgctattttatatatttcttggttatggacaatagtgcatgttttgaggccagtcaaaaaacaagtatgggactcatgatatttactacaaaacaatttaaccaaggaaaattacattacaatttgcttttgccaaactgtaaacattacttgtttgagcatgttatctcataagatatgtggaaagatttcaaatgtttcatggttatggacattgatgtaagtttgaagacgttcaaagccctaaatgatgtaatgtttagaatgaaagtttttacaaaaataacccaacaaggtttgtcatcaaagttttcgcaatacaatgatttgggagtaaagggtcatgatttcgtgcatgttttctcgaaaagattgtggcatgaaccatgcgaaaactttgaagcttttcgacaccctaaattatgtggtagatttatagaacgatcaactacgttgtttcacatgctccaccagcaactaaaattcaacacaatcaaaacttgaatgtgggacccacataattagatggtcgcatgccgattaaagttcagtgttttgaagaatgaggtaagtttaaaagtatttgaattgtaatatgcagatttttcaagataaaagattttgcagagttacgacctctattaaaggaaaaatagttaatggaagaaaaattgtattttcactttcaatacttgtttaggcatgttaccttaaaacatagacaacctatcgcatgagttaggggcccaagatattggatgttcgaatgctagcactagagtttgtaggtatgaagaatgaggtaactttagaaatgtttaaagtgcaacatgtatattatttagatcggtaattttctggaattgagagaaatatttatgcaattctgcttttattttgatccatattttaagattctttgttattattctattacatttatatcaatttataataaaagaattaaatatagaaaaaatttcattcgaattttaattacaatttgctctatgagagactattaacaatactagtttaggcatgctattttaaaccatatgtagtgctattttatatatttcttggttatggtcaacagtgcatgttttgaggccactcaaaaaacaagtatgggactcatgatatttattacaaaacaatttaaccaaggaaaattatattacaatttgctctttgccaaactgtaaacatcacttgtttgggcttgttatctcatagaatatgtggaaagatttcaaatgtttcatggttatggacattaatgtaagtttgaagcagttcgaagccctaaatgatgtaatgtttagaatggtagtttttacaaaacgacccaacaaggtttctcgtcaatgttttcgcagtacactaatttgggagtgaagggtcttgatttcgtgcatgttttctcgaaaagattgtgtcatgaaccatgcgaaaactttgaagcttttcgaagcactaaattatgtggtagatttatagaatgatccaacatgttgtttcacatgctccaccaacaactaaaattcaacacaatcaaaacatgagtatggggcccacataattagatggtcgcatgccgattaaagttcagtattttaaagaatgaggtaactttaaaagtatttgaattgcaatatgcagatttttcaagataaactattttgcagagtaacgacatctattaatggaaaaatagttaatggaagaaaaattatatttccactttcattactcttttccaaatgtcgtactgtaagacatacttgttttggcatgttaccttaaaacatatatagtgctatttgcaatgttccaagtttatggcagatcaaaacatgagtatgggactaatgggaattaattttgtgcaagtttactgcatgatatatcgatttctgatgtgcgtcaacttcgatgcattttgatgccctaaatattgtattgtttagacagacagtttttacggatggacccaacttgttgtttcgcatgcaccatcattaacccatgttcaagacagccataacatgagtatgcgaccctagattgtcgcatgctagcactagatttggtcatatgaatgatgaggtgactctagaagcgcttgaagcataacatgtagatctttttttagatcatcaatctactataggcgtgagctatccaacatgttgttttacatgcttcatcatcaacccaagtgcaagacaacctatagcatgagtttggggcccaagatattagatgttcgaatgctggcactagagtttgtagatatgaagaatgaggtaactttataaatgtttaaagtgcaacatttatattttttagatcagtaattttctagagctgacagctatatttttgtaattttgcttttatgtcgatccatgttttaatatactttgttattattctattacagttatatcaatgatatttataacaaaagaattaaatagggaaaaaaattattccaattttaattacaatttgctt

SEQ ID NO: 853 - DNA, 2633 bp, Zea mays
agttcccgcctaaaaattcgggtgtgacatttaggtgccgtttagtttaactgatccaaatgaggcccaactatatgaactttgtgacatatagttagcaggttactggggtcttattgggtgagaaacatcttaggctggtcaattttttatgtgtgtaaaacctcaatcatgtaacatccactcgtaagaagactcggttgtattcctgttaatagaaatggttgtttcctctctaaaaatatgttgactaacttggtctctatagacatgtttagtgacctcgtgggcaatttactctagtaggccccaaagtcaaacaacaagttacctacttctccataagaatgtagcaatcaataacatgcataagattttgttgacacctagaggagacggttcctacattgttcgactacagtgcacctaattgggcctataaataaaccaacaatacaccttaagggagaaaattaagttgggtatatgatcgcatgtaaatgcgacattaattttaggcatgctctgacgatgtatacaagcaaaactatatttttcagacctgctaaccacctgacacaaagttgatatagttaggcctcatttggattagctaaacacgactacagctaactcttgcattttagtcttctgttgatcttcatttttattagtttcaagatcttcattcttaacaaaagagaacaaatttcccagcgcatcctcaagagatagcatactatctttggcatttatcgccactacatatcatctaacaatttcagaagaaaatagaggtaaagcaggctactgaagccgctaaaaagtttttgcataatgttgatgagttgcaattgggtgcccaaaagaaggatgatgaaattgttagactacaaatagtggcgacaaatgccaaaaagaggatgttgtttcttgaggatgagctgcaaaaaatgttgtctttggtcaaggataaagatcttgaaactttataaaaataatatcaaccagagactaaaatgcaagatttagttgttgtccagattaactaatccaaacaaggcctaactatatgaataggtggttagcaggttactaggttcttattgggtgagaaacatttgatgccggtggattttgctatgtgggtaaaccctgaatcatgtcacatccactcttctcaagactaaacagaagagttaggtgcagattagtttaactgtggtctatataaaataatgtggactaacttgttctctatagacaattttttagtgatctcgtgggccaaaagttagacgaaaagttacctacttctccacgagaaagttgcaattaataacatgcatgttggtcaaactgaccactcagacccaattgcatcaagatttggcacacggacgaactacaaacataaatgaacagtcaggactcacaaaatcaataggcttgtgctattgctcactctctcactcaccgagaagacatgtacacaactctctatcttgtgagtatcaggagcatcgtcttgctagctttctcctaccagagcaccgcactttctcatagcactagatggcacatcattgattgatccctacatacagcgttagcacccattaaataaatagaagtagacaacaacatgtctagaaactacacctctcgtctcgtctggtccacatgatgcatgcatcttaccatgagaagcggtcactactgcaggccaaccgtatgtgtctctccaaacataggccgcactagagtgcgttcttcaactagtggacgcaagactcgcactaaatgtaggcatggtctgcatgcacaaggcgccagcccgcacgcctcctccgttgcttcatgcaaatggggcgcgtcctttggctctgcgatccacctgaaccgctccactttttcatgtactcatcgttaaactccagcaggtttcatataaactcatgcatagttctagtatatggcatggcactccggtcgaaatccaggactgatggtctgatgtgctgcacgcatgttaggtaggcttcacacatcagtcgtgcttgcttgttcgtggagctagcttggtagcctttccatttctggtgttcttgctcctagctatagcagatcacgagagctttcaagctcgttgttcatgctagaggccagaggctctccctagctccatctgaaaaaggctgcagcaggaaatgacttttgatcgagccgctactgctggtgcttcatctcttaggctctctattgatccatatccatgtttggtactagtacggcgcggtcgtcagcaccacacacaacactcttcggtcctagtgcaatggtggcaccttgattgtctttctacgtctccgtaaaaaatgaactaataataatattcaagaaaaacaaactttatatacggtcggtcgtacttacttaaagctaatagttaatgtaataaataaagcaacaaattcaaaaaagggattacattatttgagtatttagttcgtgaataagttggtccccatcaagtcggccttgatcttgttatcaatgacgactgtctaaacgataatggactccaacgtggtcgagtatgtcattttatttcacggaatttattagggtac

SEQ ID NO: 854 - DNA, 2600 bp, Zea mays
gaaaagaacaacatatatgcaatgattgtctaattactaagttaatttacagttatcactcgataattttacataaatcactcagtaatttgactacatttgttcgataattccttaatcacacagtaatttcatttacccattgagaaaataacaacatatatgtagtgattatctagttactaaataattttacagtcttcactcagtaattttgcgccatttattcagtaatttcaatcacccagattgagtagttacatagtaattttacagtaattactgattaattttgtggcatttgttcaacagttcctcattcacccagtaatttcattaacacactaataaaataataataaatatgcagtaattttgcagtatttgttcaacactttctcaatcactcattaattttataacgtttgtactataattatcaatcatccagtaatttccgttacacattgagaaaagaacaacatatatgcaatgattgtctaattactaagttaatttacagtaatcacacgataattttacataaatcactcagtatattgacagcatttgttcggtaattccttaatcacacagtaatttcatttacccattgagaaaataataacatatatgcagtgattatctagttactaaataattttacagtctccactcagtaattttgcaccatttgttcaactcttccacaggcacccagtaatttcattaacacacaaagaaaaataacaataaatatgctaattttgcagtatttgttcaacactttctcaatcactcattaattttataacgtttttactataattatcaatcatccagtaattttctttacacgttgagaaaaagaacaacatatatgcaatgattatccagttactcagttaatttacattaatcgctcgataattttacataaatcacgcagtaacttgacagcatttgttcggtaattccttaatcacacagtaatttcatttacccattaagaaaataacaacatatatgtagtgattatctagttactaaataattttacattcttcactcagtaattttgcaccatttattcagtaatttcaatcatccagattgagtagttacatagtaattttacagtaatcactaattaattttgcagcatttgttcaacacttcctcattcacccagtaatttcattaacacactaagaaaatatcaataaatatgaagtaattttgtagtatttgttcaacactgtctcaatcactcattaattttataacgtttttactataattatcaatcatccagtaattttctttacacgttgagaaaagaacaacatatatgcaatgattgtccagttactcagttaatttacagtaatcactcgataattttacataaatcactctgtaatttgacagcatttgttcgataattccttactcacacagaaatttcatttacccattgagaaaataacaacagatatgtagtgattatctataaatatttttacagtctccactcagtaattttgcaccatttattcagtaatttcaatcacctagattaagtagttacacagtaattttatagtaatcactgattaattttgcagcatttgttcaacgcttcctgagtcaaccagtaatttcattaaaacactaagaaaataacaataaatatgtagtaattttgcagtatttgttcaacactttctcaatcactcattaattttataacgtttgtactataattatcaatcacctggtaattttgtttacacgttgagaaaagatcacatatatgcaatgatggtctagttactcagttaatttacagtaatcactcgataattttacataaatcactcagtaatttgatagcatttgttcagtaattccttaatcacacagtaatttcatttacccattgagaaaataacaaccgatatgtattggttatctagttactaaataattttacagtctccactcattaattttgcaccatttattcagtaatttcaatcacccagattgagtagttacatagtaattttacagtaatcacggattaattttgcagcatttgttcaacacttcctcagtcacccagtaatttcattaacacactaagaaaataaaaaaaatacgcaataattttgcagtatttgttcaacactttctcaatcactcattaattttataacgtttctactataattatcaatcatccagtaatgttctttatacgttgagaaaagaacaacatatatgcaatgattgtctagttactaagttattttacagtaatcactcgataatttacataaatcactctgtagtttgacatcatttgttcggtaattccttaatcacacagtaatttcattcacccattgagaaaataactacagatatgtagtgattatctagttactaaataattttacagtctccactcagtaatattgcatcatttgttcagtaatttcaatcacccagattaagtagttacatagtaattttacagtaatcactgattaattttgtagcatttgttcaacacttactcagtcacctagtaa

SEQ ID NO: 855 - DNA, 2543 bp, Zea mays
ggcctcaaaacatgcattattgtctataaccaagaatcatttaaagtagcactacagatggattaagatagcgtgcctaaactactattgtttatagtctggcataaagcaaattgtaattcaaattggaataaatttttttctatatttaatttttttgttataaatatcattgatataactgtaatagaataataactaagtatcttaaaacatggatcgaaataaaagcagaattacataaatatagctgtcaactccggaaaattaccgatctaaaaaatatacatgttgcactttaaacatttataaagttacctcattcttcatatctacaaactctagtgccatcattcgaacatctaatatcttgggccccatactcaagctataggttgtcttgcacttggttgatgatgaagcatgtaaaacaacatgttagatagctcacgcctatagtagagtgatgatctgaaaaagatctacatgttatgcttcaagcgcttctagagtcacctcatcattcatatgaccaaatctagtgctagcatgcgacaatctagagtcgcatactcatgttatggttgtcttgaacatgggttaatgatggtgcatgcgaaacaacaagttgggtccatccataaaaactgtctgtctaaacaatacaatatttagggcatcaaaatgcatcgaagttgacgcacatcagaaatcgatatatcatgcagtaaacttgcacgaaattaatacccattagtcccatactaatgttttgatcggccttaaacttggtttgatgtgttcccaactgaggaacattgcaaataacactatatatgttttaaggtaacatgcctaaacaagtatgtcttacattacgacatttagaaaagagtaatgaaagtgaaaatataatctttcgtccattaactatttttctgttaatagaggtcgtaactcggcaaaacattttatcttgaaaaatctgcatatttcaattcaaatacttttaaagttacctcattctttaaaacattgaactttaatcgtcatgcgaccatctaattatgtgggtcccatactcaagttattgattgtgttgaattttaggtgatggaggagtgtatgaaacatgttggatcatactataaatctaccacataattttgggcttcgaaaagcttcaaagttttcgcatggttcatgccacaatcttttcgagaaaacatgcacgaaatcatgaccctttactaccaaattagtgcattgcggaaactttgatgacaaatcttgttgggacatttttgtaaaaactaccgttctaaacattacatcgtttagggctttgaacgtattcaaacttacattaatgtccatagccataaaatatttgaaatctttccacatatcttatgagataacttgcctaaacaagtgatgtttatagtttggcaatgagcaaattgtaatgtaattttccttgcttaaattgttttgtgataaatgtcatgagtcccgtacttgttttttgagtggtctcaaaacatgcattgttgtccataaccaaaaattatttaaaatagcactacatatggtttaatatagcatgcctaagctagtattgtttatagtctggcataaagaaaattgtaattaaaattggaatgaatttttttctatatttaattcttttgttataaatatcattgatataactgtaatagaataataacaaagtatcttaaaacatggactgaaataaaagcttgattgcataaatatagctcttaactccggaaaattacagatctaaaaaatatacatgttgcactttaaacatttccaaagttacctcattcttcatatctacaaactctagttccaccattcgaacatctaatatcttgggccccaaactcatgctataggttgtctttcaattgggtcgatgatgaagcatgtgaaacaacatgttggatagctcacgcaaataatgaattgatgatctgaaaaaaaatctacatgttatgcttcaagtgcttctagagtgatctcatccttcatatgaccaaatctagttctagcatgcgacaatctagggtcgcatactcatgttatggttgtcttgaacatgggttaattatggtgcatgcgaaacaacaagttgggtccatccgtaaaaactgtctgtctaaacaatacaatatttagggcatcaaaatgcatcgaagttgacgcacatcagaaatcgatatatcatgcatgaatcctgcacaaaattaatacccattagtcccatactcatgttttgatctgccctaaacttggatagatgtgttcacaactaaggaacattgcaaatagcactatatatgttttaaggaaacatgcctaaacaagtatgtcttatagtaccacatttggaaaagagtaatgaaagtggaaatatattttttcttccattaactatttttacattaatagaggtcgtaactctgcaaaatagtttatcttgaaaaatctgcttatttcaattcaaatac

SEQ ID NO: 856 - DNA, 2523 bp, Zea mays
gtttgtactataattatcaatcgtccagtaattttctttacacgttgagaaaagaacaacatataagcaatgattgtctagttactcagttgatttacagtaatcactcgataattttacataaatcactcagtaatttgatagcatttgttcggtaattccttaatcacacagtaatttcatttacccattgagaaaataacaacagatatgtagtgattatctagttactaaataattttacagtctccattcagtaattttgcaccatttattcagtaatttcaatcactcagattgagtagttacatagtaattttacagtattcactgactaattttgcagcatttgttcaacacttcctcagtcacccagtaatttcattaacacactaagaaatgaacaataaatatgtagcaattttgcagtatttgttcaacactttttcaatcacttattaattttataacgtttgtactataattatcaatcatccagtaattttctgtacatgttgagaaaaaaacaacatatatgcaatgattgtctagttacttagttgatttacagtaatcactcgataattttacataaatcactcagtaatttgacggcatctgttcggtaattccttaatcacacagtaatttcatttacccattgagaaaataacaacagatatgtagtgattatctagttactaaataattttacagtctccactcaataattttgcaccatttattcagtaatttcaatcactgagattgagtagttacatagtaattttacagtaatcactgactaattttgcagcatttgttaaacacttcctgagtcacccagtaatttcattaacacactaagaaaagaagaataaatatgcagcaattctgcagtatttgttcaacactttctcagtcactcattaattttataacgtttgtactataattatcaatcatccagtaattttctttacacgttgagaaaagaacaacatatatgcaatgattgtctagttacttagttgatttacagtaatcactcgataattttacataaatcactcagtaatttgacaacatttgttcggtaattccttaatcacacagtaatttcatttacccattgagaaaataacgacagatatgtagtgattatctagttactaaataattttacggtctccattcagtaattttgcaccatttattcagtaatttcaatcactcagattgagtagttacatagtaattttacagtattcactgactaattttgcagcatttgttcaacacttcctcagtcacccagtaatttcattaacacactaagaaaagaacaataaatatgtagcaattttgcagtatttgttcaacactttctcaatcactcattaattttataacgtttgtagtataattatcaatcatccagtaattttctttacacgttgagaaaagaacaacataaatgcaatgattgtctagttacttagttgatttacagtaatcactcgataattttacataaatcactcagtaatttgacagcatttgttcggtaattccttaatcacacagtaatttcattcccattgagaaaataaaaacagatatgtagtgattatctagttactaaataatttgacagtctccactcagtaattttgcaccatttattcagtaattttaatcgcccagattgagtagttacatagtaattttacagtaatcactgattaattttgcagcatttgttcaacatttcctcattgacctagtagttttattaacagactaagaaaagaacaataactatacatcattatctagttactcagtaaaattttcagcaatctctctgtaattttataacatttgtaatataatttattaatcatacagtaatttcatttacactgcgaaaataacaacaaatatgttgtgattgtctagtttatcaattgttttacagcgatcactcgataattttacataaatcactcagtttgtccagtaatttgacaaccacctagattgtcttgtaactcaatgattatatagtaatcacttagtagtttacatcatttgtttagtaatttctcagtcatccagtaatttcgtttacacaacgagaaaaaacaaaagttatgaagtgattgtctagataattttagagtaatctctacttatataaagaatgaaaggggtaggttgcctgttctaccttccaacaatatggaccacccattctatccactccaagcatcctccctcccaaacgcgcgcgctcagcagggcgcatgccgcgatcgctccccacatcctctctcaacgctcccctcctctctcgagcttgatttctctggtactaaactccctcacgtggaatcgcgtcacgcagccgcgccggcaggtggcaagacgaccgtcggcagccaccgacgtccgggatgaagcggaagcccgagttgtcggtgtcgacgatgttcaaactttcgttcctgacctgagggg

SEQ ID NO: 857 - DNA, 2505 bp, Zea mays
gagtatattaggcgtatattaggcaactcctgatatggttggtttagaattgattgtaatgccaagatacctcccttatatctaggataaccttccttatctttaggataggcttctttccctccgaatcatgtactcctatatattcttcctagaggctcaatgcaatacatcccacacattatatgcattctctcctttctttcatggtatcacgagtttaggttttagatccaacaggtgtcttctgctgccaccgccgcgccacccttggggagatcgtcctccgtcgggggcaacaccctcgtaggatgcgcgaccggtcccgctgatctgctgtgcccatcgtcgtcatcgcgtcaagtcgaagtagcgacagatcgaaaaactcaccgtcgatgctccttggatcgccccccgtcgacctgcactggctagatccggcacctccacacgccgtcatggtgacggttgtggtcgggtcgaatccacccgccggctgggtcgtgcgccgccatggtggaagctccgactctcgctgccagctgcgccagagccgcacgccaggcttgcacgctggcacgggagtcgcgtgcctgcgccggggacgttgtgcccacgtcgtggctgcaacctcgcctggccgcgtcgtgctgtggccacgcccgcttgctgccggggctagggctgccacgcccgagctgagccgccagggttgcgccaacgagccgggtccgtgtggtcgcgccgtcgggccgcacgcccgcaggggacgcgcttaggtactgccagtgaattcccaggtctgttgttgttgcgtcttttttttgttttcccagtcattgatcgggtttgcatctccatcacccaccgccagtcgactcgcgcaccctcgacatcggcttcaacaacaccggcttcttcatcttcttcgacggtgcaactggcatggcatgcagcgtaatcggaacgcctgcctatgttgcgcctctttgtctgcacgtccatctatgccggctcatcgtcgccaccaccgatcgggaggctccaccatcgacatcaccatcatcgtttccgactcgcacgccatcggcctgatcaaccgatcgcgggcgaaccatcctcccgagacgtttgtcgtccatcgcgcgatgcttcgccaagcaagaagatcgtcgatgtgtcgcctcctcgaaaacaccatcgtcgtctgtcgtcaaccaacaccattgcatctacatcgctgtcaacttcgtcggcgcgtctcatgcgaatgaacaagttgttcgacacatttgagttgcgtcgacacaaccgttgtctgcgttgcgggtcctcctacatgctacgtcaacaccttgcgctggtgttgtgcctatcctaggcgtgctagccaccgtcgctggtctgcaccgcatttgtcatcgagtttttcgccgacaaacactgccatcgtgctccactggcaccattgaggctcgtttcctatgtgtcgtggctctcgctgtcgtgactctaggaacctcgatgtgtcgccacgcctatctcttctactttgtgtcaccacgcctatctcttcgcttcgtccagcacaacctcgttgccagcatcatcgtcttgtcctcaactaattcgtctactccgctttaacaaccatgcgttgggccggcactcccgtcgtgctgcatcacaaccatcgcgaaggccttctctgctggtcccttgagatgcaggcacatatggttggggccctctacctagtacattcggtactggcaccaccggcacatgcattcatccacgacacgtttctaggcttggcaaacctggaacatccatcgtccatggttgcttgacgcgtcgctcccggcatcgacaccctcatctacctcgacgcattgtgccttcgtctacggctgcttcacagcaccaccatcagcacgacgtcctctggcgcgatttggaccttcccgcgtgccgcagcaacgcccgcaacttgtgcggcatgtcttctatgacgtcctcgacagcttcctcgaccacggctacctacgcacggcacttcgacaacggctccacgtcctcttccttggctatctcaacattatcatcacacagggctatcatctgcatgggctactctagtcgcagcattcgcaccgcattccgactgtgggggtatatctccattattcttcagtctgtccgttcgtgttgctaacgctacgactatgggggtatatccccattattcttcagtctgtccgttcatgttgctaacgctacgactgaggggatgttagagtatattaggcatgttagagtatattaggcaactcctgatatggttggtttaagattgatagtaatcccgggataccttatatctaggataacattccttatccctaggataggcttcttaccctccaagtcatgtactcctatatattctccctagaggctcaatgcattacatcccacacattatatgcaatctctcct

SEQ ID NO: 858 - DNA, 2449 bp, Zea mays
acgacatttagaaaagagtaatgaaagtggaaatataaattttcttccattatctattttttaattaatagaggccgtaactctgcaaaatagtttatcttgaaaaatctgcatattgcaattcaaatactttaaagttacctcattcttaaaaacactgaaattgaatcagcatgcgaccatctaaaaatgtgggtcccaaactcaagttattgagtgcgttgaattttagttgatggtggagcgtgtgaaacaacatgttggatcattctttaaatctacctcataatttagggtttcgaaaagcttcaaagtttttgcatggttcatgccacaatcttttcgaaaaaacatgcacgaaataatgaccctttactcacaaaacttgttgagtcatttttgtaaaaactactgttctaaacattacatcatttagggctttgaaccgcttcaaacttacattaatgtccatcaccatgaaacatttgaaaattttccacatatcttatgagataacatgcccaaacaagtgatgtttatggtttggcaatgaaaaaattgtaatgtaattttccttggttaaattcttttgtgataaatatcatgagtcccatacttgttttttgagtggccccaaaatatgcgttgttgtccataaccaagaatcattaaaaatagcgctacatatggtttaagatagcatgcctaaactgttattgtttatagtctagcatagcaaattgtaattaaaattggaatgaaattttttctttacttaattcttttgttataaatatcattgatataactgtaatagaataataacaaggaatcttaaaacatggatcaaaataaaagcagaattgcataaatatagctctgaactctggaaaattaccgatctaaaaaatatacatgttgcactttaaacatttctaaagttacctcattcttcatatctacaaactatagtgccagcattcgaacatccaataacttgatccccaaactcatgctataggttgtcttgcacttgggttgatgatgaagcatgtgaaacaacatgttacataactcacgcctatagtaaattgatgatctgaaaaaaatctacatgttgtgcttcaagcgcttttagagtcacctcatccttcatatgaccaaatctagtgctagcatgcaacaatctagggtctcatactcatgttatggttgtcttgaacatgggttaatgatggtgtatgagaacaacacgttgggtccatccgtaaaaactgtctctttaaacaatacaacatttagggcttcaaaatgcatcaaagttgacgcacatcagaaatcaatatatcatgcaacaaattgtacgaatataataccaattagtcccatactcatgttttgatcagccttaaacttgggttgatctgttcacaaccgaggaacgttgcaaatagcacaatatatgttttaaggtaacatgcctaaacaagtatatcttacagtacgacatttagaaaagagtaatgaaagtagaaacataaattttcttccattaactatttttccattaatagaggtcgtaactctccaaaatagtttatcttgaaaaatctgcatattgcaattcaaatacttttgaagtttcctcgttcttgaaaacactcaactttaatcggcatgcgaccatctaattatgtgggtcccatactcaagttattgattgtgttgaattttagtttatggtggagcatgtgaaacaacatgttggatcattctgtaaatctaccacataatttagggttttgaaaagctttagagttttcgtatggttcatgccacaatcttttcgagaaaacatgcacgaaatcatgacccttttactcacaaatcagtgtattgcgaaaactttgatgacaaaccttgttggatcctttttgtgaaaactaccattctaaacattacatcatttagggctttgaaccgattcaaacttacattaatgtccatatccatgaaacatttcaaaattttccacttatcttatgagataacttgccaaaacaagtgatgtttacattttggcaatgagcaaattgtaatgtaattttccttggttaaattgttttatgataaatatcacgagtcccatacttgttttttgagtggccttaaaacatgcattgttgtccataaccaagaatcatttaaaatatcactacataaattttaagatagcatgcctaaactattattgtttatggtctggcataatgcaaattgaaattaaaattggaatgatttttttctatatttaattcttttgttataaatatcattgatataactgtaatagaataataacaaagaatcttaaaacatggatcaaaataaaagcagaattgcataaatatagatgtcaactctggaaaattaccgatctaaaaaatac

SEQ ID NO: 859 - DNA, 2416 bp, Zea mays
atacgccttgtgcatgcagaccatgcctgcatatagtgcgagtcttgcatccaccagttggggaacgcgctccagtgcggcctatgtttgaagagacacgtgtggttggcctgcagttgtgaccgcttctcatggtaagacgtgtgcatcatgtggcccggacgagacgagaggtgcagtgtctaggcatgtcgtcgtctacttctgtttatttaatgggtgctagcgctgtatgtagggatccatcaatgatgtgccatctagtgctatgcgaaattgtggtgctctggtaggagaaagctagcaagacgatgctcctaatagtcacaagacagagagttgtgtatgtgtcttctcggtgagtcaaagagagagagcaagagaacaagcctattgattttgtgagtcctgacagttcatttatgtttgcagttcgtccgtgtgctagatcttgctgcaatcgggtctcaatggtcagtttgactaacatgcatgttattaattgcaactttctcatggagaagtagctaacttttcgtctaacttttggcccacgagaccactaaaaattgtctatagagaacaaattagtccacattattttatatacgccaaagttaaactaatctgcacctaactcttgtgtttagtctcgagatgagtggatgttatgattcagggtttacccatgtagcaaaatccaccggcattataagtttctcacccaataagaacctagtaaccagctaaccacctattcatatagttaggcctcatttggattagttaatctggactgcaactaaatcttgcattttagtctctggttgattttatttttataaagtttcaagatctttatccttgaccaaagacaacaacttttgcagctcatcctcaagaaacgacatcctctttttggcatttgtcgccactatttgtagtctaacaatttcatcatccttcttttgggcacccaatttcaactcatcaacattatgcgaaaactttttagcggcttcagtagcctgctttacctctattttcttcctcttaatggtcttagtgtaatcttcttccattttcttaagctggttccacacaaaattcttttttgcctgttatgctgagttttcactgtcctctgatctcatgatcttggaagctttctttagttttattatttcttacctaatatcttcctcacttttttggtgatccgaattgttgggactaaactttatttcatatattagtattgacaattcggatcccaaaaaattggagaagatattagggaagagattaaaaactaaagaaagcttactggatcctaagatgagagatgcacaatgaaatttcagcataacaaacgaaaaagaattatatgtggaaacatcttaagacaatggaagaatgttacagtgggaccattaagaggaagaacttacaggtaaagcaggctactgaagcagctcaaaagcttttgcataatgttgaggagttgcaagtgggagcacaaataaaggtgttgaaactgttagatgacatgtagtggcgataaatgccaaagatagtatgctatttcttgaggatgcgctgggaaatttgttctcttttgttaagcatgaaggtcttgaaactaataaaaatgaagatcaacaaaagactaaaacaaaagagttagctgtagtcgagtttagctgatccaaatgaggcctaactatatcaactttatgtcaggtggttagcaggtctgaaaaatatagtttcgcttgtttacaccgtaggagcaggcttgaaaattaatctcgcgtttacatgcgatcatgacttaatttttctcccttaaggtgtattgtgttctatgggatagctcatccctcataattggagtcattgttggtttatttataggcacaattgggtgcactggaatcgaacaatgtaggatacgtctcctcttgtgtaaacaaaatcttatgcatgcttttctactacaaattgggtctcgtgggtcaggaactgtcgcgcgcttttgctgcaatcgggtctcagttctcagtttgacaaacaagcatgttattgattgctacattcttatggagaagtaggtaacttgttgtttgacttttggggcttgctagagtaaattgcccacgaggtcaccaaacttgtctatagagaccaagttagtcaacatatttttagagaggaaacaaccatttctatcaataggaatataacagagtcttcttacgagtggatgtgacatgattgaggttttacacacgtaaaaattgactagcctctgaagtttctcacccaattagaccccagtaatctgctgaccatatgtcacaaagttcatatagttgggtctcattcggatcagttaaactaaactgcacctaac

SEQ ID NO: 860 - DNA, 2377 bp, Zea mays
tagcattcgaacatccaatatcttgggccccaaactcatgctataggttgtcttgcacttgggttgatgatgaagcatgtgaaacaacttgttggatagctcacttctatagtaaattgatgatctaaaaaatatacatgttgggcttcaagcgcttctagagtcacctcattcttcatatgaccaaatctagtgctagcatgcgacagtccaattctatggatcgcatactcatgttatggttgtcttgaacatgatttaatgatggcgcatgcaaaacaacaagttgggtccatccgtaaaaactgtttgtctaaacaatacaacatttagggtttccaaatgtagcgaagttgacggacatcataaatcgatatatcatgcaacaaactttacgaaattaatacccattagttttgattggccttaaacttgggttgatgttttcacaactgagaaatattgcaaatagcactattaacatgcctaaacaactatgtcttatagtacgacatttagaaaagagtaatgaaagtggaaatagaactatttttccattaatagaggtcgtaactctgcaaaatagtttatcttgaaaaattttcatattgcaattcaaatacttttaaagttacctcattctttaaaacactgaactttaattggcatgcgagcatctaattatttggtttccatactcaagttattgattgtgttgaattttagttgatggtggaccgtgtgaaacaacatgttggatcattctgtaaatctaccacataatttagggctttgaaaagcttcaaagttttcgcatggttcatgccacaatgtttttgagaaaacatgcacgaaatcatgaccctttactcccaaatcagtgtattgcgaaaactttgatgacaaaccttgttgggtcctttttgtcaaaactaccgttctaaacattacataatttagggctttgaaccgcttcaaacttacattaatgttcataaccatgaaacatttaaacattttccatatatcttatgagataacatgctcaaacaagtgatgtttatggtttggcaatgagcaaattgtaatgtaattttccttggttaaattttttttgataaatatcaagagtccacattattgttttttgagtggcctcaaatcatgcattgttgtccataaccaataatcatttaaaatagcactacatatagtttaagatagcatgcccaaacaattatcatttatagttcgacatagagcaaattgtaataaattggaatgaatttttttatatttaattattttgctataaatatcattgatataactataatacaataataacaaagaatcttaaaacatggatcaaaataaaagcagaattgcgtaaatatagctctcaactcctgaaaattatcgaactataaaatataaatgttgcactttaaacttttctaaaattacctcattcttcatatctacaaactatagtgccagcaatcgaacatccaatatcttgagccccaaactcatgctatatgttgtcttgcacttaggttggtgatgaatcatgtgaaacaactgttgcatagctcgcgcctatagtaaattgatgatctgaaaaaatctacatgttgtgcttcaagcgcttttagagtcacctcatccttcatatgaccaaatctagtgctagcatgcgacatagagcaaaacaacacgttggatccatccgtaaaaactgtctgtctaaacaatacaacatttatggcttcaaaatgcatcgaagttgatgcacatcagaaatcgatatatcatgcaacaaacttgtacgaatataatacccattagtcccatactcatgttttgatcagccttaaacttgggttgatgtgttcaaaactgaggaacgttgcaaatagcacaatatatgttttaaggtaacatacctaaacaagtatgtcttacagtacgacatttagaaaagagtaatgaaagtggaaatataaatcttctttcattaactatttttctattaatagaggtcgtaactctgcaaaatagtttatcttgaaaaatctgcatattgcaattcaaatacttttaaagttacctcattcttgaaaacaccgaactttaatcggcatgcgaccatctaattatgtgggtcccatactcaagttattgattgtgttgaattttagttgatggtggagcgtgtgaaacaacatgttggatcattctgtaaatctaccacataatttagggtttcgaaaagctttagagttttcgtatggttcatgccacaaagaacatgcacgaaatcatgacccttttactgacaaatcagtgtattgtgaaaactttgatgacatac

SEQ ID NO: 861 - DNA, 2355 bp, Zea mays
accatcatcatcggcgcctgaggtcaggaggtgttacgcaatgcacgatcaccggcatcatcggctccgagaggggctgcgtaggcggaggcctgtggcttcttcctcctttctccatttctaccgcttaattttttcttcctcctccttactcatcattttctcctttttttcttcttattccacttccctcttttctttctttttttgcccctttctctatctctattatcatggtcgattgtaaaaagatgcaagctagacacataaaggaatcataagaaacaacactgaaaaagttccttgaacctatatatcatggtgatcgatgacaaaatttattaatggataatctgaacacacaaaagtgaataattattaattccactactcggctgcaaatagcccagcatatcaaaaactcatctgtcacgacattgagaatattttgacttgctaacgccatccatttggtctttcagggcatccatacttttgcccaaagcgtttagttgtttgtggatgacataaatgtctaccttggagggagacatgtcatgccacggcgatgctggcggggacggcgatggtgtccttgatggcgcacgtgttgggggcgtcggcggtggctggaatggcgcatgtcgtggcggtgtcgcttcatcttgttcgtgaaacaatctctcaagtagatccaaattcttaggtggttcatttatcatatgcttgaaatcattgccacatttctaaaaatgaaacaaacgtacaattagaatatatataatctggattcaatcaaagagagacagagaatacccttgtttttttaatatgcatcttgcgacttttcgtctcccccatgtttgaagagtggatacgatgcagaacatggtcatcatacaactgtttcatacggttccatctgtttatgagtgttttatttgaaattgttattgttgtcaccttataaagtttttccgacaaatattccagagctgtatcatccaaggtggattgcctctgctttatgatgtcgttgtcaagcaagtcgacacagcccctgcagaacacagtgtctatatcaggataccagcggaacctaccctcatattgggtcatattttccatctacaagaaaaaatgaaagaaatcacaaaaaaaacatatacatatacatataagctagcacatttactggtaagagaggggtacgtacgtaagaaaactcacataaaactgcgggtcacgactgaggtgtgactgtttggaagcaaacttaagcgcaatgataataagctataacagtagggatgctttttagatctatcacgctgaaggccatgggaagtatattaatagaagccccccggtggcaatatgcatggcacacgtccgccactccgcttcctctccctaatttgttccattcttatccaagcgaacaacaacgatcgatcgagtcttgagatcgctcgcgcggggaagcgcgcgtcgctggcgactggcgagtgcgtcgactgcatgcatgctccatctgtgtgcatgcaagggaagtatattaatagaagcccccggtggcaatatgcatggcacacgtacgccactctgctttctgtccctaatttgttcggttcttatccatgcgaacaacaacgatccatcgagtcttgagattgctcgcgggggaagtgcgcgtcggtggcgactgtcgactgcgtcgactgcatgcatgctccatctgtgtgcatgcagccgctgattgtttttatttacgtgagtttgtttagtgctgatgctgcaaggaggcagcctagatagtgcgtgtgtgcacgtcgtgtgcgtggccaggtcgtaagccggcgcgccaagtctcctgcatgcatgcgcgctgcagcacaatgctgacggatctgttggtcgcgtcgctcgtaccgccatgatgacgggtccggcacatctgctaagcgccgctcgggcaccgcacagagggtcttgtcattgcgaccgatggattttgggctggcggaccgggccagcccctcctctctctctctcgatgccattgtgcgctgcgcatatgccgacttgggcctgaagcggtgagaatacacatgctgcatttccctaattcaaaatttggatactaactgcgggaatagttcaagatgtagcaacataaacattctgctaattcaaaaacagacagagttgtgtattctttcttctttgtaaactgtagcaaggataattagacagagttcgtggaatcgtggctgttgtatattaagttaggatctctatttgtatggagtttgtggagtatgtagtctaatttattttttgttgatgcttctg

SEQ ID NO: 862 - DNA, 2326 bp, Zea mays
gtgtaccacttgttcatcaagctgttacaaacttacttcatttaaacttttcctttttggattatttatccttttatatggtttaaatgcctttcctagccgcaaaaaataaatgaatagcaaatgtggtaaaaaatagtgaaatttggcatgaagtcataatttggtcctaattgattgggataaaaaatcagaggattatacaagagtatggatataggtggttcccaaatggacacatctctcgctaactttcgtggcattcaactacaacttcacatttgaagctataagtcttgcttttgtttatgtttttttgcttcaaaagtgtaccacttgttcatctagatgttacaaacttacttcatgtaaagttttccttttttggattatttacccttttatagcataaatgcctttcctagccgcaaaaaataaatgaatagcaaatgtggtaaaaagtagtgaaatttggcatgaagtcataatttggtcctaattgattgagataaaaaatcagaggattatacaagagtatggatataggtggttcccaaatggacacatctctcgctaactttcgtggcattcaactacaagttcacatttgaagctataagtcttgcttttgtttatgtttttttgcttcaaaagtgtaccacttgttcatctagatgttacaaacttacttcatgtaaagttttccttttttggattatttacccttttatagcataaatgcctttcctagccgcaaaaaataaatgaatagcaaatgtggtaaaaaatagtgaaatttggcatgaagtcataatttggtcctaattgattgagataaaaaatcagaggattatacaagagtatggatataggtggttcccaaatggacacatctctcgctaactttcgtggcattcaactacaacttcacatttgaagctataagtcttgcttttgtttatgtttttttgcttcaaaagtgtaccacttgttcatctagctgttacaaacttacttcatgtaaagttttccttttttggattatttacccttttatagcataaatgcctttcctagccgcaaaaaataaatgaatagcaaatgtggtaaaaaatagtgaaatttggcatgaagtcataatttggtcctaattgattgagataaaaaatcagaggattatacaagagtatggatataggtggttcccaaatggacacatctctcgctaactttcgtggcattcaactacaagttcacatttgaagctataagtcttgcttttgtttatgtttttttgcttcaaaagtgtaccacttgttcatctagatgttacaaacttacttcatgtaaagttttccttttttggattatttacccttttatagcataaatgcctttcctagccgcaaaaaataaatgaatagcaaatgtggtaaaaaatagtgaaatttggcatgaaatcataatttggtcctaattgattgagataaaaaatcagaggattatacaagagtatggatataggtggttcccaaatggacacatctctcgctaactttcgtggcattcaactacaagttcacatttgaagctataagtcttgcttttgtttatgtttttttgcttcaaaagtgtaccacttgttcatctagatgttacaaacttacttcatgtaaagttttcctttttggattatttacccttttatagcataaatgcctttcctagccgcaaaaaataaatgaatagcaaatgtggtaaaaaatagtgaaatttggcatgaagtcataatttggtcctaattgattgagataaaaaatcagaggattatacaaaagtatggatataggtggttcccaaatggacacgtctctcgctaactttcgtggcattcaactacaacttcacatttgaagctataagtcttgcttttgtttatgtttttttgcttcaaaagtgtaccacttgttcatctagatgttacaaacttacttcatgtaaagttttccttttttggattatttacccttttatagcataaatgcctttcctagccgcaaaaaataaatgaatagcaaatgtggtaaaaaatagtgaaatttggcatgaagtcataatttggtcctaattgattgagataaaaaattagagaattatacaaaagtatggatataggtggttcccaaatggacacgtctcttgctaactttcgtggcattcaactacaacttcacatttgaagctataagtcctgcttttgtttatgtttttgcttcaaaagtgtcagttgctcatctagctgttgttggagacttgttctcaaatg

SEQ ID NO: 863 - DNA, 2313 bp, Zea mays
gttgtgatagttaccgacatcttacaagtgttttctaccttgattaattcatccaccatgcttcttcattcacttctttagaacttgaggaagaatgagcagtgaagaatataacatagtgcatgtttttatgattccttgcatgcagcctcttgatccattgtgcggtgttgtacataatttctggagtaacatgcttacttctgtacattgtaagtttgttttgcatttgaattctgaaaggctccatctccttgtagttggaaggttttctgctgatctgttttttccttcaatgcaggaggggaagcacattgccacgttgatgtcccttcatctcagaagagcaaagctaaatccaagcaaatttgcactccttgttcgtgaaataccaaagacatctacagaatcatacaatgatgtagttggaaatttcttcacaaagtatcactcgtctagttatctcttccatcaaattgtcttcaaagttgggcatgtccacaagataatggtatctacctagtactcaatgcatgcatttagaatcatacagtgatgatgttggaaatttcttcacaaagtaccactcgtgtagttatctcttccatcaaattgtcttcaaagttgggcatgtccaccagataatgatatctacctagtactcaatgcatgcatttctattttacaaacgaagaacatttactattatatattctaaaggaagtataattaagacttcttcatcttatgaaaagctagttttctcataattttttttgtctttttgacatgaacatgtgaacaaatgtccagttccttcattattgaatggtttttctttatttatgcgtgtttgtttttcacctcttggttatggtgtatttaacttatctgacagactggcgcaaagaaggcacataagaagtttaaacatttcatagctgaaatcggcagtcggggatgtaggacgacaactaccaaaagttgttgttttgcgggaccacgctctccaaattcttcgaagttcaactctaaatgcgagcaaaacaagaggaaccctgacaatgaagaatccaccctaaacttagatcatgaggttaaaattcttgcatgcatgcatttgttaattgcttaatttaacaataataatatggattaaattagtaatttctatgtggaattatatacagcaggaatgcacaactgcttttgtatttttcaaaactcgctatgatgtagttactgcatcgaatatggtccagacatctaacctaatgaaatgggttactagtccggctccagaaccagaagacatgtattggtccaatctttggcaatctaataagtggcgtaaatcaacactagttctaggctgtattatttttgcattcttacttttgatgctgatggtgtgtatacaagcattatctgacctagagcagttgcaacagttgattcctgcttccttaaaagaaaggttggagaagtaagtactgaaacttcagttgggctatctctatagatgtgtgatcttatgtcgctacaaatatatatactatccatttgacatgtctccatattgcacctattgaatatatattacctggcctatttgcaggaaaaactacatgagtaacctagtaatgggataccttcctagtgtaatcacacaaattattctgtatattgttgggacattgatgataaaagtttctaaactggaagattccacttctcacagtgcaaggaagaggagtacttgctttaaattgttgtgcttcatagtttggaacatactctttgttaatgtactatctggtacattcatgtgtcaattggatttgttattaagctcaaaggacattcatgtcaagcttgctatcgctttaactagatatgtttagcacaccttcccttttctatatggaaagataatatattggttttgtgtatttatttttcatctaacatttatgtttcttttctgtgattttatttttattgcaggctaccttcttcatcacctatgttatgacctcgggatgggctagtttatcatccaaacctttgcagttctttaatctgataatgagctttataaggaaatatattttgagaaagggagaatatagagaagatacagaatttgttcccacattcccctatcagcatgaattgccaaaagttctattgtttggactattgggcttcacatgctttgtggtggctcctatgattttaccttttctgccagtatactttcaccttggtcgtgttgtataccacaatcaagtgagaagctagaaacttttt

SEQ ID NO: 864 - DNA, 2298 bp, Zea mays
atcactcagtaatttgacaacatttgttcggtaattccttaatcacacagtaatttcatttacccattgagaaaataacaacaaatatgtagtgattatctagttactaaataattttacagtctccactcagtaattttgcaccatttatttagtaatttcaatcacccagattgagtagttacatagtaattttacattaatcactgattcattttgcagcatttgttcaacatttccttagtcacccagtaatttcattaacacactaagaaaagaacaataaatatgaagtaatattgcagtatttgttcaacactttctcaatcactcattaattatataatgtttgtactataattatcaatcatccaataattttctttacacgttgagaaaagaacaacatatatgcaatgattgtctagttacttagttgatttctagtaatcactccataattttacataaatcactcagtaatttgacatcatttgttcggtaattccttaaccacacagtaatttcatttacccattgagaaaataacaacagatatgtagtgattatctagttactaaataattttacagtctccactctgtaattttgcaccatttattcagtaatttcaatcacccagattgagtagttacatagtaattttagagtaatcactgattaattttgcaacatttgttcaacacttcctcagtcactcagtaatttcattaacacaataagaaaagaataatagatatgcagtaattttgtagtatttgttcaacactttctcaatcactcattaagtttataactttggtactataattatcaatcatgcagtaattttctttacacgttgagaaaagaacaacatatatgtaatgattgtctagttaattagttgatttacagtaatcactcgataattttacataaatcactcagtaatttgacaacatttgttcggtaattccttaaccacacagtaatttcatttacccattgagaaaataacaacagatatgtagtgattatctagttactaaataattttacagtctccactcagtaattttgcaccatttatttagtaatttaaatcacccagattgagtagttacatagtaattttacagtaatcactgattaattttgcaacatttgttcaacacttcctcaatcacctagtaatttcattaacatactacgaaaagaacaataaatatacagtaattttgcagtatttgttcaacactttctcaatcactcattaattttataatgtttgtactataattatcaatcatccagtaattttctttacacgttgagaaaagaacaacatatatgcaatgattgtctagttactcagttgatttacagtaatcactcgataattttacataaatcactcagtaatttgacaacatttgttcggtaattccttaaccacacagtaatttcatttacccattgagaaaataacaacatatatgtagtgattatctagttactaaataattttacagactccactcagtaactttgcaccatttattcagtaatttcaatcacccaaattgagtagttacatagtaattttacagtaatcactgattaattttgcagcatttgttcaacacttactcagtcacccagtaatttcattaacacactaagaaaagaacaataaatatgtagtaattttgcagtatttgttcaacactttctcaatcactcattaattttataacgtttgtactataattatcaatcatccagtaattttctttacacgttgagaaaagaacaacatatatgcaatgtttgtctagttacttagttgatttacagtaatcactcgataattttacataaatcgctcaataatttgacaccatttgttcggtaattccttaaccacacagtaaattcatttacctattgagaaaataacaacatatatgtagtgattatctagttactaaataattttacagtctccactcagaaatttggcaccatttattcagtaatttcaatcacccagattggtagttacatcgtaattttacagtaatcactgattaattttgcagcatttgttcaacacttcctcagtcacccagtaatttcattaacacactaagaaaagagcaataaatatgcagtaattttgcagtatttgttcaacactttctcaatcactcattaattttataacgtttgtactataattatcaatcatccagtaattttctttactcgttgagaaaagaacaacatatattc

SEQ ID NO: 865 - DNA, 2297 bp, Zea mays
tcatgtatgttgttcttttctcaacgagtaaagaaaattactggatgattgataattatagtacaaacgttataaaattaatgagtgattgagaaagtgttgaacaaatactgcaaaattactgcatatttattgctcttttcttagtgtgttaatgaaattactgggtgactgaggaagtgttgaacaaatgctgcaaaattaattagtgattactttaaaattacgatgtaactaccaatctgggtggttgaaattactgaataaatggtgcaaaatttctgagtggagactgtaaaattatttagtaactagataatcactacatatatgttgttattttctcaatgggtaaatgaaattactgtgtggttaaggaattaccgaacaaatgttgtcaaattattgagcgatttatgtaaaattatcgagtgattactgtaaataaactaagtaactagacaaacattgcatatatgttgttcttttgtcaacgtctaaagaaaattactggatgattgataattatagtacaaatgttataaaattaatgagtgattgagaaagtgttgaacaaatactgcaaaattactacatatttattgttcttttcttagtgtgttaatgaaattactgggtgactgagtaattgttgaacaaatgctgcaaaattaatcagtgattactgtaaaattactatgtaactactcaaattgggtgattgaaattactgaataaatggtgcaaaattactgagtggagtctgtaaaattatttagtaactagataatcactacatatatgttgttattttctcaatgggtaaatgaaattactgtgtggttaaggaattaccgaacaaatgctgtcaaattactgagtgatttatgtaaaattatcgagtgattactttaaatcaactgagtaactagacaatcattgcatatatgttgttcttttctcaacgtgtaaagaaaattactcgatgattgataattatagtacaaacgttataaaattaatgagtgattgagaaagtgttgaacaaatactgcaaaagtactgcatatttattgttctttttgtagtgtgttaatgaaattactaggtgactgaggaagtgttgaacaaatattgcaaaattaattagtgattactgtaaaattactatgtaactactcaatctgggtgatttaaattactaaataaatggtgcaaaattactgagtggagactgtaaaattatttagtaactagataatcacccatatctgttgttattttctcaatgggtaaatgaaattactgtgtggttaaggaattaccgaacaaatgttgtcaaattactgagtgatttatgtaaaattatcgagtgattactgtaaatcaactaagtaactagacaatctttgcatatatgttgttcttttctcaacgtgtaaagaaaattactgcatgattgataattgtagtacaaacgttataaaattaatgagtgattaagaaagtgttgaacaaatactacaaaattactgcatatctattgttcttttcttagtgtgttaatgaaattactgggtgactgaggaagtgttgaacaaatgttgcaaaattaatcagtgattactctaaaattactatgtaactactcaatctgggtgattgaaattactaaataaatggtgcaaaattactgagtggagactgtaaaattatttagtaactagataatcactacatatctgttgttattttctcaatgggtaaatgaaattactgtgtggttaaggaattaccgaacaaatgatgtcaaattactgagtgatttatttaaaattatggagtgattactagaaatcaactaagtaactagacaatcattgcatatatgttgttcttttctcaacgtgtaaagaaaattactggatgattgataattatagtacaaacgttatataattaatgagtgattgagaaagtgttgaacaaatactgcaatattacttcatatttattgttcttttcttagtgtgttaatgaaattactggttgactgaggaaatgttgaacaaatgctgcaaaatgaatcagtgattactgtaaaattactatgtaactactcaatctgggtgattgaaattactaaataaatgatgcaaaattactgagtggagactgtaaaattatttagtaactagataatcactacatatctgttgttattttctcaatgggtaaatgaaattactttgtgattaaggaattaccgaacaaatgttatcaaattactgagtgat

SEQ ID NO: 866 - DNA, 2221 bp, Zea mays
catatgtagtgttattttaaatgattcttggttatggacaacaatgcatgttttgaggccactcaaaaaacaattatgtgactcatgatatttatcacaaaacaattaaatgatgtattgtttagagcggtagttttcgcaaaaaggacccaacaaggtttgacatgaaagttttcgcaatacactgattgtgagtaaagggtcatgatttcgtgcatgttatctcgaaaagattgtggcatgaaccatgcgaaaactttgaagcttttcaaagctataaattatgtggtagatttacagaatgatccaacatgatgtttcacatgctccaccatcaactaaaattcaacacaatcaataacttgagtatgggacccacataattagatggtcgcatgccaattaaagttcagtgttttaaagaaagaggtaactttaaaagtatttgaattgcaatatgcagatttttcaagataaactattttgcagagttacgacctctattaatggaaaaatagttaatggaagaaaatttatatttccgctttcattactcttttctaaaagacatacttgtttaggcatgttaccttgtaacatatattgtgctatttgaaacgttcctcagttgtgaacacttcaacccaagtttaaggctgatcatgagtatgggactaatgggtattaaatttgtacaagtttgctgcatgatatattgttttctaatgtgcgtcaacttcgatgcattttgaagccctaaatgttgtattgtttagacagacagtttttatggatggacccaacgtgttgtttcacatacaccatcattaacccatgttcaagacaaccataacatgagtatgcgaccttagattgtcgcatgttagcactagttttggtcatatgaaggatgaggagactctaaaagcgattgaagcacaacatgtagattttttcagatcatcaatttactataagcgtgagctatgcaacatgttgtttcaattgcttcatcatcaacccaagtgcaagacaacctatagcatgagtttggggcccaagatattggatgttcgaatgctggcactatagtttgaagatatgaagaatgaggtaactttagaaatgtttaaagtgcaacatgtatattttttagatcggtaatttccagagttgagagctatatttatgcatttctgcttttattttgatccatgttttaagattctttgttattattcttttacagttatatcaatgatatttgtaacaaaataattaaatatagaaaaaaattcataccaattttaatttcaatttgctctatgccagactataaacaataatggtttaggcatgctatcttaaactttatgtagtgttattttacatgattcttggttatggttaacaatgcatgttttgaggccactaaaaaaagtatgggactcatgatatttatcacaaaacaatttaaccaaggaaaattacattacaatttgctcattgccaaaatgtaaacatcacttctttggcatgttatctcgtaagataagtggaaaattttcaaatgtttcatggttatggacattaatgtaagtctgaattggttcaaagccctaaatgatgtaatgtttagaatggtagtttttacaaaaaggacccaacaaggtttgtcatcaaagttttcgcaatacactaatttgtgagtaaaagagtcatgatttcgtgcatgttttctcgaaaagattgtggcatgaaccatacgaaaactttgaagcttttcgaagccttaaattatgtggtagatttatagaatgatccaacatgttgtttcacacgctccaccatcaactaaaattcaacacaatcaataacttgagtatgggacccacataattatatggtcgcatgccgattaaagttcagtgttttcaagaatgagataactttaaaagtacttgaattgcaatatgcagatttttcaagataaactattttgtagagttacgacatctattaatggaaaaatagttaatggaagaaaatttatatttccactttcattattcttttctaaatgttgtactgtaagacataattgtttacgcaagttaccttaaaacatatattgtgctatttgcaacgttcctcagttgtgaacacatcaacccaatttaaggcagatcaaaacatgagtatcggactaatgggtattata

SEQ ID NO: 867 - DNA, 2218 bp, Zea mays
tataagcatcaacaaaaaaattagactacatactccacaaactccatacaaatagagatcctaacttacaaagaattagcagaatgtttatgttgcacgaactctatctaattatccttgctaattatccatatacaacaaccacaattccacgaactctatctaattatccttgctacaatttacaaagaagaaagaatacacaactctgtctatttttgaattagcagaatgtttatgttgctacatcttggactattcacgcagttagtatccaaattttgaattagggaaatgtagcatgtgtattctcaccgcgtcaggcccaggtcggcatatgcgcagcgcacaatggcatcgagagagagagaggaggggccggccccgtccgccagcccaaaatccatctgtcgcaatgacaagaccctcggtgtggtgcccaagcggcgcgcagcagatgcgccggacccgtcatcatggcggtacgagcgacgtgaccaacagagccgtcggcattgtgctgcagctcgcatgcatgcaggagacttggcgtgccggcttacgacctggccacgcacacgacgtgcacacacgcactagctaggcggcctccttgcagcattggcgctaaacaaactcacataaataaaaacaaccaacggctgcatgcacacagatggagcatgcatgtagtcgacgcagtcggcagtcgccaccgacgcacacttccccacgagcgatctcaagactcgatggatcattgttgttcgcttggataagaaccgaacaaattagggacagaaagcagagtggtgtacgtgtgccatgcatattgccaccgggggcttctattaatatacttcccttgcatgcacactgatggagcatgcatgcagtcgacgcactcgccagtcgccagcaacgcgcgcttcccccgcgcgagcgatctcaagactcgatcgatcgttgttgttcgcttggataagaacggaacaaattagggagaggaagcggagtggcgttctcaagactcgatcgatcgttgcatattgccacctggggcttctattaatatacttcccatggccttcaacgcgatagatctaaaaagaatccctgctgttaaagcttagtataattgcgcttaagcttgcttccagatagtcacacctcagtcgtgacccgcagttttatgtgagttttcttacgtacgtacccctctcttaccagtaaatgtgctagcttatatgtatatgtatatgtttttttgtgatttctttcatttttttcttatagatggaaaatatgacccaagatgagggtaggttctgttggtatccggatatagacaatgtgttctgccggggctgcgtcgacttgcttgatagaggcatcataaagcagaggcaatccaccttggatgatacagctctggaatatttgttggaaaaactttataaggtgacaacaataacaatttcaaataaaacactcataaacagatggaaccgtatgaaacagttgtatgatgaccatgttctgcatcgtatccactcttcaaacatgggggagacgaaaagccgcaagatgcatattaaaaaaacaagggtattctctgtctctctttgattgaatccagattatatatattctaattatacgtttgtttcatttttagaaatgtggcaatgatttcaagcatatgataaataaaccacctaagaatttggatgtacttgagagattgtttcacgaacaagatgaagcaaaactgccacgacatgcgccattccaaccaccgccgatgcccccaacacgtgcgccattaaggacaccatcaccgtccccgccagcgtcgtcgtggcatgacatgtctccctccaaggtagacgtttatgtcatccacaaacaactaaacgctttgggcaaaaggatggatgccctaaaagaccaaatggatggcgttagcaagtcaaaatcttctcagtgtcgtgacagatgagtttttgatatgttgggctatttgcagccgagtagtggaatcaataattattcacttttgtgtgttcagattatccattaataaattttgtcatcgatcaccatgatatataggttcaaggaactttttcagtgttgtctcttatgattcctttatgtgtctagcttgcatcttttttacaatcggccatgataatagagatagagaaaggggcaa

SEQ ID NO: 868 - DNA, 2217 bp, Zea mays
tagataggatcagggttcatctaacaacgagaaggtcatcgtcgtgtcggcgccgcgaagggtgcccccttgctcgtgctgggtcggaatcggatacgccgtgctgctcatctgccagcccctgggccgcctcgcctcgccgtggcgcgggcccgggacgcggattgggcgctgctccacgacgctgacgcgcacggccggtgctgggtcgacgccgtgcgcggacgggagccggcgtgaccatcagccggtgtacacgatggacgccgcggggcgcgtcgacgcgtgggacacggacgctgccacgacgcccagcagagcggtcgcgccgccgtgcggctgctctcggcccgctcctgcgccatgtcagccgcgtgccgtcaagtaccaggagcgccatgtcagccgcgtgccgcaagtaccaggagcgacatgtcagccgcgtgccgcaagtaccctcatggagctctcgcacgggaggctgctgcaggtgcaccacctccgcgaggcggcgcacgcgcgatacgcgtgggagccccgaccggagagcacatggagtacaccaccaccggcgtcgagctcttggagtggacggccgccaccggcctgtgggcgcgggcggacggtaaattagagtcctttctcgctcagtaaattagagtacgcgcgctagctagggcttacgcagaggatcttcgggcaacctccgatcaacaacttggatggaggtatggctgagtggcttaaggcattggtttgctaaatcgacatgcaagaagattgtatcatgggttcgaatcccatatcctccaatccccctttcaaatcggcgaggtaatagtactttattaaagtaggacagcaacacaagactgacttgctgtctacttggcgagctttcactgccccctctgtaacttcccttcttttttcaaatcggcgaggtaatagtaccttattgaagtaggacagcaacacaagactgacttgctgtctacttggcgagctttcactgccccctctgtaacttcccttcttttttcaaatcggcgaggtaatagtaccttattgaagtaggacagcaacacaagactgacttgctgtctacttggcgagctttcactgccccttctgtaacttcccttctttcgtccgtccacgaggcatatccccaattcaaatctgggtgtcgcaaaatactttttatttcttattgtactgattgaactatacaaattcttgccctgcataaggaccgtgacagagagcatgccttataagaagtgattatatattacggaacccgcccttcttatttttcacaccaagagaagtatgaaaatctcctaagttcatagaaatgatccttgcaccagaagatgaattccaatatatgcggatgaggtctcttcaaagccccaatccttgggtgagcttgctttccttttcatcacccctttcaacaggccaagaaattcagaaccgaactgggccactggggaggatcaaactcacatatttgttgacgaggacatttgttcaaattctcgaaaaaacgtttcggtttttagattctcgaaaaaagaagaaacgtataaataaaataaaaaaagaaggaatcaccagacacgtttatttcagcagcccacggcttgtcgttccggagggtgagagagacatatttggcggggggatctggagatttctctactgtgcaatactaccaggtaggtagatgcatgtacttgaggaaacttgagattttgcgcacaggaatgggagttgttggacgtgatgaaatgggggaaaagaagtatgcggtgaaaatgaccgcgagtcgcgcctcttctcccccctccacacatggaagcccgggagttgtcgtgacggtgacggggggacacgagcacgaaagagaacgatatgtgctgggttgttgagatttgacatgttattatctaaaattagagagttcgttggatgcacttatccacaggagcttgtctatcttctaaaacaaccctctaaactctaaatttagctaggatttatacttgtggagttgctctcagtgtataccggtaaaacaaacccatctctaattgattattggatggtgaatttgtcattttcataacatggaccccccataacagcgaggtgtgtaattagcttggtttcacataacagcgaggtgtgcagcgatctccgcacggg

SEQ ID NO: 869 - DNA, 2206 bp, Zea mays
gcatatatgttgttcttttctcaacatgtaaagaaaattactggatgattgataattatagtccaaatgttataaaattaatgagtgattgagaaagtgttgaacaaatactgcaaaattactgcatatttattgttcttttcttagtgtgttaatgaaattactgggtgactgaggaagtgttgaacaaatgctgcaaaattaatcagtgattactgtaaaattactatgtaactactcaatctgggtgattgaaattactgaataaatggtgcaaaattactgaatggagtctgtaaaattatttagtaactagaaaatcactacatatattttgttattttctcaatgtgtaaatgaaattactgtgtggttaaggaattatcgaacaaatgctgtcaaattactgagtgatttatgtaaaattatcaagtgattactgtaaatcaacttagtaactagacaatcattacatatatgttgttcttttctcaacgtgtaaagaaaattactcgatgattgataattatagtgcaaacgttataaaattaatgagtgattgagaaggtgttgaacaaatactacaaaattactgcatatttactgttcttttcttagtgtgttaatgaaattactgggtcactgaggaagtgttgaacaaatgctacaaaattaattagtgattactgtaaaattactatgtaactacgcaatctgggtgattgaaattacagaataaatggtgcaaaattactgagtggagaatataaaattatttagtaactagataatcactacatatctattgttaatttctcaatgggtaaatgaaattactatgtgattaaggaattaccaaaaaatgctatcaaattatagagtgatttatgtaaaattatcgagtgattactctaaattaactgagtaactaggcaatcattgcatatatgttgttcttttctcaacatgtaaagaaaattactggatgattgataattatagtacaaacgttataaaattaatgagtgattgagaaagtgttgaacaaatattgttgcatatttactgttcttttcttagtgtgttaataaaattactaggtgactggggaagtgttgaacaaatctgcaaaagtaatcaatgattactgtaaaattactaagtaactactcaatctgggtgattgaaattactgaataaatggtgcaaaattactgagtggagagtgtaaaaatatttagtaactagataatcactacatatttgttgttctttctctatgggtaaatgaaattactgtgtgattaaggaattaccaaacaaatgttatcaaattactgagtcatttatgtaaaacaatcgagtgattactgtaaattaactgagtaactagacaatcattgcatatatgttgttctattctcaacgtgtaaacaaaattactggatgttttataattatagtgcaaacgttataaaattaatgagtgattgaggaagagttgaacaaatactgcaaaattattgcatatttactgttcttttcttagtgtgttaatgaaattactgggtgactgaggaaatgttgaacaaattctacaaaattaatcagtgattactgtaaaattactatgtaactactcaatctgggtgattgaaattactgaataaatgttgcaaaattactaagtggagactgtaaaattatttagtaactagataatcactacatatctgttgttattttctcaatgggtaaatgaaattactgtgtgattaaggaattaccaaacaaatgctatcaaattactgagtgatttatgtaaaattatcgagtgattgctgtaaattaactgagcaactagacaatcattgcatatatgttgttcttttctcaacgtgtaaagaacattactggatgattgataattatagtacaaacgttataaaattaatgagtgattgagaaagtgttgaacaaatactgcaaaattactgcatatttactgttcttttcttagtgtgttaatgaaattactgggtgattgaggaagtgttgaacaaattctgcaaaattaatcagtgattactgtaaaattactatgtaactactcaatctgggtgattgaaattactgaataaatgttgccaaattactgagtggagactgtaaaattatttagtaactagataatcactatatatct

SEQ ID NO: 870 - DNA, 2204 bp, Zea mays
cacgtattgctcttgctaaaaatacgagaatcgtcacaacctacatatctatcaatccattcattaaaacaaaataatagaagtagggaatcagctcactatgatcaactcgactcaatatttgcaagaacaacgacagacttcgattgaagtcttcgatcgaacacctggctaggattgaactgagcttcacttccttctcaatccacaactagtggaatctctcgtagcagccacagtcaacaacaggaaaaaggggatcaccactgcagtgttgtcgagctggagatggcgagagttgagcacagtcgacgacgcaaggaaggtggccacaagacggcacgcgcaacagtgaacgcggcgtcggcgaggcctagaacaagggccaggcgagctgcagggtggagctagggacggccggtgcgacgcagatcgatggacagctatgggagatgaaggcgagcacatgaacggcggaatcgatggcgtggttcgagacggctgggcatgcagtggagagtgttcgagacagcgcagtgaggaagagatgtagacggccagagtgttggcgagctcggcggacgcgaccatggatgcgtgctggcattgcaggcagggcagagacgttgtgagggagctcgggatgagttcgtcgcacttgacagccagaggcaggggatgacgacgctcatccatcggagctccaagaccaaggcgcggtggtgaggtttctaggagccgatctttggagctggcgtgaggaaattagttccaaaaaatatctacgtagaggagatatttccagagattagtcgtcagttggaaaacgaggtgagacgcctggttgcgaggaggacgctgggctcaggtggaatcaaggctgagcagagcctaggcgcgaccatgggagtgagatggggatgaggagctgggcaccatggccagaggcgagcgcgcccatgacctgggtgatgctgaaattgaggtagtcgacgagggatggatgcagtgcacgcgtaggagataaagttgatggcggcttcaaaaaaattccgtggcggtgggagataaggctatagcatcgtacgagcataagaactaagtaccggagacaagggaaatgttttggacgtgcggacaaggaagagaagagaaacgtccaacacatgtatatataaggagaagatattttattttcctttagaaaaaacaaaatatgaatataaatataattatatttggagttctatggttactatttggacgagatatagatgggctggacaaaaacgatcttggttatgatattttaatctgtgattaactcatctaacctgacaaatctcatccgctaatcaaacactggacttctatgccatggataatctcaggttcagatgagatgtaaataggccagaccaattaatattggcttaaaaatcgcaatgaggtttaatttagttaaaactagacgaacatatgtttgacatccgaacacctttgatatttttagggcagcgcaccggaaaaataagtctaattattacacttgcgcacgtttgtctcggcaacgtgcacagtccagatcacacaaatcaagcgcatctgaaattcatctttgcataaccgagtggcttaacgactcaggacctgacgtcttatacgacaacttaatttctagttatgagaaatcttttcacttcagacaaaagtcgcgaggtcgagcgtccaaattcgtatttgtttaactgattaattttaaataggagtaagactcgatagctcacataataaatgcgttctgaatctcgcaaactatttagattaatccaaatgcatagagatgaagacagtatcaaaatcatgataggtaaagatgattagggtagagacaccaatattctcatcgacatctcacgcttaagtccatattcattggtaaatgtacagtaacacctagggtgttacaatgtcacctgaatccgcgctgagccctcacccgagcctgtcaacatcgtttgcgcctcgcccgagcccatcgacctcatctacgccctcgcccgcacccctaatgcagggcacgtccagccagccaaccccgccctagtgccgctgacgcccctggcccgcctgtcagcgcacgctcgccctcggggctgatctcgttcgtcgatctatgatcggatggttgagaacaccccgta

SEQ ID NO: 871 - DNA, 2197 bp, Zea mays
agatatatagtgattatctagttactaaataattttacagtctccactcagtttggcaacatttattcagtaatttcaatcacccagattgagtagttacatagtaattttaaagtaatcactgattaattttgcagaatttgttcaacacttcaatcacccagtaatttcattaacacactaagaaaagaacagtaaaatgcagtaattttgcagtatttgttcaacactttcaatcactcattaattttataacgtttgtactataattatcaatcatctagtaatgttcttacacgttgagaaaagaacaacatatatgcaatgattgtctagttgctcggttaatttacaacaatcactcgataattttacataaatcactcagtaatttgatagcatttgttcgtaattccttaatcacagtaatttcatttaccattgagaaaataacaacagatatgtagtgattatctagttactaaataatttacatctccactcagtaattttgcaacatttattcagtaatttcaatcacccagattgagtagttacatagtaattttacagtaaacactgattaattttgcagaatttgttcaacacttcctcaatcaccaagtaatttcattaacacactaagaaaagaacagtaaatatgcaataattttgcagtatttgttcaacactttctcaatcactcattaattttataacgtttacactataattataaatcatccagtaattttctttacatgttgagaatagaacaacatatatgcaatgattgtctagttactcagttaatttacagtaatcacttgataattttacataaattactcagtaatttgatagcatttgtttggtaatttcttaatcacacaacaatttcatttacccattgagaaaataacaacagatatgtagtgattatctagttactaaataattttacagtctccactcagtaattttgcaacatttattcagtaatttcaatcacccagattgagtagttacatagtaattttacagtaaacactgattaattttgcagaatttgttcaacacttcctcagtcacctagtaatttcattaacgctctacgaaaagaacaaaaaatatgcagtaattttgcagtatttgttcaacactttctcaatcactcattaattttataacgtttgtactataattatcaatcatccattaatttttttacacgttgagaaaagaacaacatatatgcaatgattgtctagttactcagttaatttacagtaatcactcgataattttacataaatcactctgtaatttgatagcatttttggtaattccttagtcacacagtaatttcatttacccattgagaaaataacaacagatatgtagtgattatctagttactaaataattttatagtctccactcagtaattttgcaccatttattcagtaattcaatcacccagattgcgtagttacatagtaattttacagtaatcactaattaattttgcatcatttgttcaacacttcctcagtcacccagtaatttcattaacacactatgaaaagaacagtaaatatgcagtaattttgcagtatttgttcaacactttctcaatcactcattaattttataacgtttgcactataattatcaatcatccagtaattttctttacacgttgagaaaagaacaacatatattcaatgattgtctaggtactaagttgatttacagtaatcactcgataattttacataaatcactcagtaatttgacagcatttgttcggtaattccttaaccacactgtaatttcatttacacattgagaaaataacaacatatatgtagtgattttctagttactaaataattttacagactccactcagtaatttcgcaccatttattcagtaatttcaatcatccagattgagtagttacatagtaattttacagtaatcactgattaattttgcagcatttgttcaaaacttcctcagtcacccagtaatttcattaacacactaagaaaagaacaataaatatgcagtaattttgcagtatttgttcaacactttctcaatcactcattaattttataacatttggactataattatcaatcatccagtaattttctttacacgttgagaaaagaacaacatatatgc

SEQ ID NO: 872 - DNA, 2193 bp, Zea mays
gctgtcgctcgcgccgctgtttctgctgccgcctccggccgttcccgccctcggtccgccttggccgcccttccgccgccgccgccccccccccccccgcctccgctgcctccgctgcccgcgccccgcgtgctgccttcctgcgcggtcctccccccgttcgctcctcttctgccccctggctgctgccgcttggctgcgccctgtggcgcgggcgttgcctcccgctccgtgcgctgcccgggcgcccgtctgtctggtcccgtctgttgcgcggcgccgccccgtcctggtgggcgtcttccctcgcccccctgcccccgccctcccctgggccgccttccgcggtcgctttcgtccgtcccctgtgcctgccggtctgctgcccgtgccgccggcggcgttcctggccctccgcccgggtcctcgtctgtccgtgcgtccgcccggtttctgcccttgtctcgctctgctcctgccgctgtccccccgccccgcgcccgtcccgtttcctgcgcggcttggttgcccctctccgtcccccgctgcctcccccttcccgccttcccgccctgcttgcccgccctcctgcccgcgcggccgcgtccggcgctggccgctcgtccgcgcccgctccgtggccccgcctggccgccgccgtccccgtttctccggccctcccctccgccgttccggccgcccccgcgtccccgccgcctccgccgtccgccggtcccccggccgtccctccgcctccgtcccgccccgtccgcgccctcgtccggcggtccgtttccgccccccccccgcccccccgtcttcctgccccgccccgccgccccgcccccccgctccggttggccccgggcctgtttcccctgtggcgcgcccggcccctgggtgctgccctgtccgccgccggccgcccgccgccgtccggcccctgccccccccgccgcctgtgctccgcctggcgccggcccgctctccgccgctccctcctggccgcctgcccccttggcggctgccgccgttccggcgccccccgccctgctcgtcggtctgttccccgtcgcctcccctcttgccgtgttctttgctcctggcgcccccttctttccttcctgcctcctgggtcgccgcccctcctcttccccttcctcccctgtcccccccccttgcctccgccggtggtcgccttcgcgccgctcgcctttgtttgcctctccgtgtggccctccgggggctcgcgtttcccgcccccttctcgtcctgggtcctccgggcctcgctgtcctcctcgggctgccttggctcgctccgtctccggccgttctccgttgtgctccccggcccctcccgttggtgtccccctcggcgcggccgtggtgcccgcgttcgtcccgcctgcgccccgcccggccgttgttctccgctggctgtcgctcgccgtgccgccgcccccttgcgcgtctcccggttgtgtccgcgttccccgctgtgtttcccccggccttcccgggtctgcccccgcgcggcccgttgcctttgccctcgcgcttcttcctggccccgcccctcttccgcgcgcttcccgcctctctggccccgcgttggttgccttccgccgcccttgctgcgctgtccgcgcccggttccctccggccccgcccctcgccttgggccgcccctgtcttcttgtggcgccgcccgctggccccgcggctgtgtctcgcttctcgcgctttgcctgcggtcccgctcccgccccgtctccttgccccgcctcgccgctctgttcgccccgttgcgcggcgcccgtgtgttctccccgcttgctctgcggtccggttctcctccgctccggctccgcccttcggcccttccgccgccggccttccttccccgtctggtttgtctgcgttcccgtgctgtcttttggtttgccccctgcgcccgccttcttcctgcccttgctgcccgtgtcttcctggcttccttgctccgtttgtggtggtcttccttgctgcccttctggtttcttctccccgcgccgccgcgcctgccgctcctttgcggctggtcttgccgcgcttgcgcgcgcccccgttgtctgccccgttgcgcccgtgtgcgttctggctccgtgccgtcctgttcttgggtcccctcctcccccgccggcttggctgt

SEQ ID NO: 873 - DNA, 2180 bp, Zea mays
caaagaatcttaaaacatggatcgaaataaaagcataattgcataaatatagctctcaactccggaaaattaccgatctaaaaaatataaatgttgcactttaaacatttctaaaattacctcattcttcatatctacaaactatagtgccagcaatcgaacatccaatatcttgagccccaaactcatgctatttgttgtcttgcacttggcttgatgatgattcttgtgaaacaacatgttgcatagctcacgcctatagtaaattgatgatccgaaaaatctacatgttgtgcttcaagcacttttagagtcacctcatccttcatatgaccaaatctagtgctagcatgcgacaatctagggtcgcatactcatgttatggctgtcttgaacatgggtaatgatggtgcacgcgaaacaacacgttggatccatcagtaaaaactgtctgtaaacaatacaacatttagggcttcaaaatgcatcgaagttgacacacatcacaaatcgatatatcatgcagcaaacttgtacaaatataatacccattagtcccatactcatgttttgatcggccttaaacttgggttaatgtgttcacaactgaggaacattgcaaatagcacaatatatgttttaaggtaacatgcctaaacaagtatgtcttacagtacgacatttagtaaagagtaatgaaagtggaaatataaatcttcttccattaactatttttccactaatagaggtcgtaactctgcaaaatagtttatcttgaaaaagcttcaaactttccgcatggttcatgccacaatcttttcgagaaaacatgcacgaaatcatgaccctttactcacaaattagtgtattcgaaaactttgatgacaaaccttgttgggtcctttttgtaaaaactaccgttctaaacattacaacatttagggctttgaaccgcttcaaacatacattaatgtccataaccatgaaactttctaacatttttcacatatcttgtgagataacatgctcaaacaagtgatgtttccggtttgacaaaccttgttgggtcctttttgtaaaaacaaccattctaaacattacatcatttagggctttgaaccaattcaaacttacattaatctccataagcatgaaacgtttgaaattttttcacttatcttatgagataacatgccaaaacaagtgatgtttacagtttggcaatgagcaaattgtaatgtaattttccttggttaaattgttttgtgataaatatcaggagtcccatacttgttttttgagtggcctcaaaacatgcattgttgtccataaccaagaattatttaaaatagcactacatatagtttaagatagcatgcataaactattattgtttatagtctggcatagagcaaattgtaattaaaattggaatgaattttttctatattcaattcttttgttataaatatcattgatataactgtaatagaataataacaaagaatcttaaaatatgaatcgaaataaaagcagaattgcataaatatagctctcgacttgggttgatgatcaagcatgtgaaacaacatgttgcatagctcacgcctatagtaaattgatgatcttaaaaaatctacatgttgcgcttcaagtgcttttagagtcaccacatccttcatatgaccaaatctagtgatagcatgcaacagtctagggtcgcatactcatattatggttgtcttgaacatggatggtgcatgcgaaacaacacgttgggtcaatccgtaaaaattgtctgtctaaacaatacaacatttatggcttcaaaatgcattgaagttgacgcacatcagaaattgatatatcatgcagcaaatttatacaaatataataccgattagtcccatactcctattttgattggccataaacttgggttgatgtgttcacaattgaggaacgttgcaaataacacaatatacgttttaaggtaacatgcctaaacaagtatgtcttacagtacgactgtgatacccgaatttttatgaaaagaagttaaatttcttttccctcttctttcgcgctctgtgtctctggagtttgtagttcggggaggcgaatacctccgttgcactgtagtttttcaggccttatttgctgggaccgggagctcaatg

SEQ ID NO: 874 - DNA, 2173 bp, Zea mays
gttggagctaaggctttaacaaaacatacctatgtatcaatcaattgattgcacactacttttcatacgctatgtctgcatgaagagatctaaagtaagaagggaaaatgggagaaaatctgggaaaactaaaaataaaaaacagaaaccatcctctgaccagatcagctagaaacgaaatggggtagcaagactcttttttttggcgaaattccgaatacaacacaaactcaccaaatcagttgcttggagagctgccgtgatccacaaagggattccagagaggctgaagaaaccagaagagaagagggaaatgtgtggaagcgtaaacaaacaaagcgaatgggtacactgcaaactggagaagacaaaggtaggcgtcgccgtcgcagcatctatctggcgaaggagacaccaacaggctactagaaaaaaataaaacgatgaagcacataaaaatacgaacaaacataggaaggataccagcttttgtaatggcgagcccattcccctttcttatcaaatcttactgcatcccagataacagacaacgacactaaaaaagcagagggcaaatattaataatgaaaaaccaacacactacttatacgagaggtttgtagtctgtaccagtactaccatgctatggccatggccttgcaaccaaactatgaactgaagaagatgctgccgccgcggcggtcgcctgtccctgcgcgaacaccgagagccctgagacggcgccggctactgcatttagcacgcgggggagtgtgtgccggtgagtgctaagcccgccgtcgtcctgcacgtacgccaggcagcttggaacccaagtggtcgtcaacccgcgcggatccgcttctttgggcaacagggcatggaacacggtggagaggtcgcgcacgacggggaagaaggcgcagcgtgctgacgccaacggtgcagcgggagacgggagcctgcgcatggtgggcgtcatcttcgtctgcggccgcggaggcgcccacgccggcttccgcggcaccgacgttcactcggtcggcgcccctggacgaaaacacatatgcatcagagaggaagagggggagcacggcaagaaggaaccgcgcgactgcaggaaacgatgtataactcaaaaaaatatatcaaaagggactcgtaagcgaaagaaaccagatctgccccacaaggaaagattttggtgcaataggcaaacaaacctctttccgagcaacaatcggagcgggcgatgaaggcgacaatacaggaggcggcggagccgacaatgaaagggatttgaagtaaaaagtgctgggaaaaggatgacacagaaaagatgaatgaaagcacgcaaagcgactgggagagtgacgacgtgaatcgagtgagaaggaagaaagatggggcggaaagagcgaagataggcatccaccggccaagcatatcaaacggaagtatccagagacagaaatatcgagagacggagggagcagaggagcgatttgagccgtccaccgatgatcggacggctaaaatttttttaaatgacgtggatagcacaccgttttggaccagcttttataggtagctgcttcctagtcgcgacgattggagcccgctgccctggcgataggcacatgctctaggcaacaacaaatggtggcgcacaaaggtgaacagcgatagaaacgggcatgtacggtggcaaataaaattcacgtgaaatgtggcctggcaggaacttttgtagaccctcaccgacagactgattaggtatttgagaatatattgggagctgttggaatcgtaccattttttaggaattaaataatggtttttagagagatcctaatatccatatttggagagatttattttatggtactcttggagatgctctaacaaagaaaagaaaatctgtacagagccttgaattataccggcttggccctgcataggactactcccatcctgtgagcccgcgggccgcggctgtagaaactgtcgtgtgtgtgaccagttagttacctgcgtacggtgccacaatcaccgtcaccagaagcacgaatagagaactcggaccgtcggtcgacgaggcatcggccatcgacgtatcctctcctccgcttcccttctcagtcgcggctcaccccctcccccttgccgatct

SEQ ID NO: 875 - DNA, 2159 bp, Zea mays
atttgttatgctgaaatttcattgtgcttctctcatcttaggatctagtaagctttctttagtttttaatctcttctccaattttttgcgatccgaattgtcaatactaatatatgaagtaaagtttagttccaacaattcggatcaccaaaaaagtgaggaagatattaggtaagagataagaaaactaaagtaagcttccaagatcatgagattagaggacagtgaaaattcagcacaacaggcaaaaaagaattttgtgtggaaccagcttaagacaatggaagaagaatacacttggaccattaagaggaagaaagtagaggtaaagcaggctactgaagccgctaaaaagtttttgcataatgttgatgagttgcaattgggtgcccaaaagaaggatgatgaaattgttagactacaaatagtggcgacaaatgccaaaaagaggatgttgtttgttgaggatgagctgcaaaaattgttgtctttggtcaaggataaagatcttgaaattttataaaaataaaatcaaccagagactaaaatgcaagatttagttgttgtccaaattaactaatccaaacgaggcctaactatatgaataggtggttagcagcttactaggttctttttgggtgagaaacttttgatgctggtggatttttctatgtgggtaaaccctgaatcatgtcacatccactcttctcaagactaaacacaagagttaggtgcagattagtttaactgtggcctatataaaataatgtggactaacttgttctctatagacaattttttagtgatctcgtgggccaaaagttagacgaaaaattacctacttctccatgagaaagttgcaattaataacatgcatgttggtcaaactgaccactcagatccaattgcagcaagatttggcacacggacgaactgcaaacataaatgaacagtcaggactcacaaaatcaataggcttgtgttattgctctctctcactcatcgagaagacagatacacaactctctatcttgtgagtatcaggagcatcgtcttgctagctttctcctaccagagcaccacactttcttatagcactagatggcacatcattgatagatccctacatacagcgctagcacccattaaataaatagaagtagacgacgacatgcctagaaaccacacctctcgtctcgtctgggccacatgatgcacgcgtcttaccatgagaagcggtcactacagtaggccaatcatacgtgtctctccaaacataggccgcactagagcgtgttcttcaactagtggacgcaagcctcgcactaaatgcaggcatggtctgcatgcacaaggcgccagcccgcacgcctcctccgttgctccatgcatatggggcgcgtcctttggctctgcgatccaccttaaccgctccactttttcatgtattcatcgttaaactctagcaggtttcatataaactcatgcatagtactagtatatggcatggcactccggtcgaaatccaggactgatggtatgatgtgttgcacgcatgttaggtaggcttcacacatcagtcgtgcttgctttttcgtggagctagcttgctagcctttccctttctggtgttcttgcacctagctacagcagatcacgagagccttcaagccgttgtacgtgctagaggctagaggctctccctagctccatctgaaaaaggctgcagcaggaaatgacttttgatcgagccgctactgctggtgcttcatctcttaggctctctattgatccatatccatgttttcgtactagaacggcacggtcgtcagcaccacacacaatattgttcggtcctagtgcaatgatggcaccttgatcgtctttctacgtctctgtcaaaaatgaactaataataatattcaagaaaaacaaactttatatacagtcggtcgtacttacttaaagctaatagttaatgtaataaataaagcaacaaattcaaaaaaaggattaaattatttgagtatttaattcgtgaataagttggtccccatcaagtcagccttgatcttgttatcaatgacgactgtctaaacgataatggactccaacgtggtcgagtatgtcattttatttcacggaatttattaagagat

SEQ ID NO: 876 - DNA, 2153 bp, Zea mays
cagaagcatcaacaaaaaaaattagactacataccccacaaactccatacaaatagagatcctaacttaatatacaacagccacaattccatgaactctgtctaattatccttgctacagtttacaaagaagaaagaatacacaactctatctgtttttgaattagcagaatgtttattttgctacattttggactattcccattgttagtatccaaattttgaattagggaaatgcagcatgtgtattctcaccgtatcaggcccaggtcggcatatgcgtagcgcacaatggcatcgagagagagagaaagaggaggggccggccccgtccgccagcccgaaatccatcggtcgcaataaaaagaccctcggtgtggtgcccgagcggcgcacagcagatgcgccgtacccgtcatcatggtgttacgagcgatgtgaccaacagagtcgccgacattgtgttgcagcacgcatgcatgcaggagacttggcgcgccggcttacgacctggccacgcacacgacgtgcacacacgcactagctaagcggcctccttgcagcatcggcgccaaacaaactcacgtaaataaaaacaaccagcaactgcatgcacacagatggagaatgcatgcagtcgacgcagtcgacagtcgccaccgacacgcacttccccgcgagcgatctcaagactcaatggatcgttgttgttcacttcgataagaaccgaacaaattagagacagaaagcagagtggtgtacgtgtgccatgcatattgccaccaggagcttctattaatatacttcccttgcatgcacacaaatggagcatgcatgcagtcgacgcactcgccaatcaccagcgacgcgcgcttcccccgcacgagcgatctcaagactcgatcgattgttgttgttcgcttgtataagaacggaacaaattagggagaggaagcggagtggcgtacttgtgccatgcatattgccaccgggggcttctattaatatacttgtcatggccttcagcgcgatagatctaaaaagaatccctactgttatagcttattatcattgcgcttaagtttgcttccagacagtcacacctcagtcgtgacccgcagttttatgtgagttttcttacgtacgtacccctctcttaccagtaaatgtgctagcttatgtgtatatatatatatatgttttttgtgatttctttcattttttttcttgtagatggaaaatatgacccaagatgagggtaggttccgctggtatccgtatatagacactgtgttctgcaggggttgcgtcgacttgcttgacagtgacatcataaagcagaggcaatccaccttggatgatacagctctggaatatttgttggaaaaactttataaggtgacaacaataacaatttcaaaaaaaacactcataaatagatggaaccatatgaaacagttgtatgatgacaatgttctgcatcgtatccactcttcaaacatgggggagacgaaaagccgcaagatgcatattaaaaaaacaagggtattctctatctctctttgattgaatccagattatatatattctaattatacgtttgtttcatttttagaaatgtggcaatgatttcaagcatatgataaatgaaccacctaagaatttggatctacttgagagattgtttcacgaacaagatgaagcgacaccgccatgacatgcgccattccagccaccgccgaccccccgaacacgtgcgccatcaaggacaccatcgccgtccccgccagcgtcgccgtggcatgacatgtctccctccaaggtagacgtttatgtcatccacaaacaactaaatgctttgggcaaaaggatggatgccctgaaagaccaaatggatggcgttagcaagtcaaaatcttctcaatgtcgtgacagatgagtttttgatatgttgggctatttgcagccgagtagtggaatcaataattattcacttttgtgtgttcagattatccattaataaattttttgtcatcgatcaccatgatatataggttcaaggaactttttcagttttgtttcttatgattcctttgtgtctagcttgcatctttttacaatcggccatgataatagagatagagaaaggggcaa

SEQ ID NO: 877 - DNA, 2142 bp, Zea mays
cagaagcatcaacaaaaaaaattagactacatactccacaaactccatacaaatagagatcctaacttaatatacaacagccacaattccatgaactctgtctaattatccttgctacagtttacaaagaagaaagaatacacaactctatctgtttttgaattagcagaatgtttattttgctacattttggactattcccgcatttagtatccaaattttgaattagggaaatgcagcatgtgtattctcaccgcgtcaggcccaggtcggcatatgcgtagcgcacaatggcatcgagagagagagaggaggggccggccccgtccgccagcccgaaatccatcggtggcaataaaaagaccctcggtgcggtgctcgagtggcgcacagcagatgcgccggacccgtcatcatggcggtacgagcgacgcgaccaacagagccgccgacattgtgctgcagcacgcatgcatgctggagacttggcgcgccggtttacgacctggccatgcacacgacgtgcacacacgcactagctaggcggcctccttgcagcatcggcgctaaacaaagttacgtaaataaaaacaaccagcggccgcatgcacacagaaggagaatgcatgtagtcgacgcagtcgacagtcgccaccgacacgcacttcccccgtgagcgatctcaagactcgatggatcgttgttgttcacttggataagaaccgaacaaattagggacagaaagcagagtggcgtacgtgtgccatgcatattgccaccgggagcttctattaatatacttcccttgcatgcacacagatggagcatgcatacagtcgacgcactcgccagtcgccagcgacgcgtgcttcccccgcgcgagcgatctcaagactcgatcgatcgttattgttcgcttggataagaacggaacaaattagggagaggaagcggagtggcgtacttgtgccatacatattgccaccaggggcttctattaatatacttctaatggccttcagcgcgatagatctaaaaagactccctgttgttatagcttattatcagtgcgcttaagtttgcttccagacagtcacacctcagtcgtgacccacaattttatgtgagttttcttacgtacgtacccctctcttaccagtaaatgtgctagcttatatgtatatgtatattgttttttgtgatttctttaatttttttcttgtagatggaaaatatgacccaagatgagggtaggttccgctggtatccggatatagacaatgtgttctgcaggggctgcgtcgacttgcttgacaatggcatcataaagcagagacaatccaccttggatgattcagctctagaatatttgtcgaaaaaactttataaggtgacaacaataacaatttcaaataaaacactcataaatagatggaaccgtatgaaacagttgtatgatgaccatgttctgcatcgtatccactcttcaaacatgggggagacgaaaagccgcaagatgcatattaaaaaaacaagggtattctctgtctctctttgattgaatccagattatatatattctaattatacgtttgtttcatttttagaaatgtggcaatgatttcaagcatatgataaatgaaccacctaagaatttggatctacttgagagattgtttcacaaacaagatgaagcgacaccgccatgatatgcgccattccagccgccgccgatgccccgaacacgtgcgccatcaaggacaccatcgccatccccgccagcgtcgctgtggcatgacatgtctccctccaaggtagacgtttatgtcatccacaaacaactaaatgctttgggcaaaaggatggatgccctgaaagaccaaatggatggcgttagcaagtcaaaatcttctcaatgtcgtgacatatgagtttttgatatgttgggctatttgcagcggagtagtggaatcaataattattcacttttgtgtgttcagattatccattaataaattttgtcatcgatcaccatgatatataggttcaaggaactttttcagttttgtttcttatgattccttggtgtctagcttgcatctttttacaatcggccatgataatagagatagagaaaggggc

SEQ ID NO: 878 - DNA, 2138 bp, Zea mays
cagaagtatcaacaaaaaataaattagactacatactccacaaactccatacaaatagagatcctaacttaatatacaacagccacaattccacgaactctgtctaattatccttgctacagtttacaaagaagaaagaatacacaactctgtctgtttttgaattagcagattgtttatgttgctacatcttgaactattcccacaattagtatccaaattttgaattagggaaatgcagcatgtgtattctcaccgcttcaggcccaagtcggcatatgcgcagcgcacaatggcatcgagagagagaggaggggctggcccggtccgccagcccgaaatccaacggtcgcaatgacaataccctctgtgtggtgcccgagcggtgcgcagcagatgcgccggacccgtcatcatggcagtacgagcgacgcaaccaacagagccgtcagcattgtgctgcagcgcgcatgcatgcaggagacttggcgcaccagcttacgacctggccacgcacacgacgtgcacacacgcactatctaggcggcctccttgcagcatcggcactaaacaaactcacgtaaataaaaacaatcagcggctgcatgcacacagattgagcatgcatgcagtcgacgcagtcgatagtcgccaccgacgcgcacttcccccgcgagcgatctcaagactcgatggatcgttgttgttcgcatggataagaaccaaacaaattagggacagaaagcagagtggcgtacatgtgccatgcatattgccaccgagggcttctattaatatacttcccttgcatgcacacagatggagcatgcatgaagtcgacgcactcaccagtcgccagcgacacgcacttcccccgcgcgagcgatctcaagactcgatcgatcgttgttgttcgcttggataagaacggaacaaattagggagaggaagcggagtggcggatgtgtgccatgcatattgccaccgggggcttctattaatatacttcccatggccttcagcgtgatagatataaaaagaatccctactgttatagcttattatcattgcgcttaagtttgcttccaaacagtcacacctcagtacccgcagttttatgtgagttttcttacgtacgtacccctctcttaccagtaaatgtgctagcttatatgtatatgtatatgtttctttgtgatttctttcattttttcttgtagatggaaaatatgacccaatatgagggtaggttccgctggtatccggatatagacactgtgttctgcaggggctgcgtcgacttgcttgacagcgacaacataaagcagaggcaatccaccttggatgatacagctctggaatatttgtcggaaaaactttataaggtgacaacaataacaatttcaaataaaacactcataaacagatggaaccgtatgaaacagttgtatgatgaccatgttctgcatcgtatccactcttcaaacatgggggagacgaaagccgcaagatgcatattaaaaaaacaagggtattctttgtctctctttgattgaatccagattatatatattctaattatacgtttgtttcaattttaaatgtggcaatgatttcaagcatatgataaatgaaccacctaagaatttggatctacttgagatattgtttcacgaacaagatgaagcgacaccgccacgacatgcgccattccagccaccgccggcgcccccaacacgtgcgccatcaaggacaccatcgccgtccctgccagcatcgccgtggcatgacatgtctccctccaaggtagacgtttatgtcatccacaaacaactaaacgctttgggcaaaagtatggatgccctgaaagaccaaatggatggcgttagcaagtcaaaatcttctcagtgtcatgacagatgagtttttgatatgctgggctatttgcagccgagtagtggaatcaataattattcacttttgtgtgttcagattatccattaataaattttgtcatcgatcaccatgatatataggttcaatgaactttttcagtgttgtttcttatgattcctttatgtgtctagcttgcatctttttacaattggccatggtaatagagatagagaaaggggcaa

SEQ ID NO: 879 - DNA, 2122 bp, Zea mays
atctctattatcatggccgattgtaaaaagatgcaagctagacacataaaggaatcattagaaacaacactgataaagttccttgaacatatatatcatggtgatcgatgacaaaatttattaatggataatctgaacacacaaaagtgaacaattattgattccactactcggctgcaaatagcccaacatatcaaaaactcatatgtcacgacactgagaagatttttacttgctaacgccatccatttggtctttcagggcatccatccttttgcccaaagcgtttagttgtttgtggatgacataaacgtctaccttggagggagacatgtcatgccacagcgacgctggcgggaatggcgatggtgtccttgatggcgcacgtgttgggggcgtcggcggtggctggaatggcgcatgtcgtggcagtgtcgcttcatcttgttcgtgaaacaatctctcaagtagatccaaattcttaggtggttcatttatcatatgcttgaaatcattgccacatttctaaaaatgaaacaaacatataattagaatatatataatctggattcaatcaaagagagacagagaatacccttgtttttttaatatggatcttgcgacttttcgtctcccccatgtttgatgagtggatacgatgcagaacatggtcatcatacaactgtttcatacggttccatctatttatgagtgttttatttgaaattgttattgttgtcaccttataaagtttttccgacaaatatttcagagctgtatcatacaaggtggattgcctctgctttatgatgtcgctgtcaagcaagtcgacgcagcccctgcagaacacagtgtctatatccgcataccagcggaacctaccctcatcttgggtcatattttccatctacaagaaaaaatgaaagaaatcacaaaaaaacatatacatataagctagcacatttactagtaagagaggggtacgtacgtaagaaaactcacataaaactgcgggtcacgactgaggtgtgactgtccggaagcaaacttaagagcaatgataataagctacaacagcagggattctttttagatctatcgcgctgaaggccatgggaagtatattaatagaagcccccggtggcaatatgcaaggcacacatatgccactccgcttcctctccctaatttgttccgttcttatccaagcgaacaacaacgatcgatcgagtcttgagatcgctcgcgcggggaagcgcgcgtcgctggcgacttgcgagtgtgttgactacatgcatgctccatctgtgtgcatgcaagggaagtatattaatagaagccagtggtggcaatatgcatggcacacgtacgccactctgctttctgtccctaatttgttcgattcttaaccaagtgaacaacaacgatccatcgagtcttgagatcgctcgcgggggaagtgcgtgtcggtggtgactgtcgactgcgtcgactgcatgcatgctccatctgtgtgcatgcagccgctggttgtttttatttacgtgagtttatttagcgccgatgctgcaaggaggccgcctagctagtgcgtgtgtacacgtcgtgtgcgtggccaggtcgtaggccggcgtgccaagtctcctgcatgcatgcgcgctgcagcacaatgctggcggctctgttggtcgcgtcgctcgtaccgccatgatgacgggttcggcgcatctgctgcgcgccgctcgggcaccgcaccgagggtcttgtcattgcgattgatggattttgggctggcggacggggctggcccctcctctctctctctcgatgccattgtgcgctgcgcatatgccgacctgggcctgacgcggtgagaatatacatgctgcatttccctaattcaaaatttggatactaactgcgggaatagtccaagatgtagcagcataaacattctgctaattcaaaaacagacatagttgtgtattctttcttctttgtaaactgtagcaaggataattagatagagttcgtggaattgtggctgttgtatattaagttaggatctctatttgtatggagtttgtggagtatgtagtctaatttttttgttgatgcttct

SEQ ID NO: 880 - DNA, 2103 bp, Zea mays
gccgtagtcgagtttagctgatcaaatgaggcctaactatatcaactttatgacaggtggttagcaagtctaaaaatatagcgtcgcttgtttacaccgtcggggcaggcctaaaaatttatctcacattaatatgtgatcagaaaccggacttaaatttctcccttaaggtgtattgtgttctatgggatagctcatccctcatagtttgagtgattgttgggttaacttataggcccaattaggtgcgctggagtcggacaatttagtatccatctcctctaggtgtcaacaaaatcttatgcatgcatttctacttcaaattgggtcttgtgggttaggaactgtcgtgcgctcttgctgtaatcgggtgtaagtggtcagtttgacaaacatgcatgttattgattgctactctcttatggagaagtaggtaacatgttatttgacttttggggcctgctagagtaaatttcccatgaggccactaaacttgcctaaaaagaccaaaatagtccacatttttagagaggaaaaacccatttctattaataggaatacaaccgagtcttcttacgaggggatgtgacatgattgaggttctacacacataaaaaatcgaccagcctcaaaagtttctcacccaataagaccctagtaacctgctaaccatatgtcacaaagttcatatagttgggcctcatttggatcagttaaactaaactgcacctaacacttgtgtttagtctcttgaagtgtggatgtgacatgattcaggtttacccacatagcaaaatccaccgacatcagaagtttctcacccaataagaaccctgtaacctactaaccacatgttcatatagctaggcctcatttggattagttaatctggactacaactaaatcttgcattttagtctctagttgattttatttttataagtttcaagatctttatctttgaccaaagatgacaatttttgcagctgacatttgtcaccactttttgtagtttaaaattttcatcatccttgttttgggcacccaattgcagctcatcaacattatgcaaaagctttttagcgtcttcagtagcctgctttacatccaagttctttctcttaatggttccattgtaatcttcttctattgtcttaagctagtttcacacaaaattcttttctgccagttatgctgaattttcattgtccttctctgatctcatgatcttggaaccggttttagtttccttatctgttacctaatatcttcctcacttttttggcgatccaaattgtcgggactaaactttattttatagattagtattgacaatttggatctccaaaaatagagaagatattagggaagagattaagaaactaaagaaatcttacgagatcttaagattagagaagcacaatgaaatttcagcataacaaatgaaaaataattatgtgtggaaacaacttaagacaatggaataatgttatggtgtgaccattaagaggaagaacttacaggtaaagcgggctactaaagcaggacaaaaggttttgcataatgttgatgagctgcaactgggagcccaaataaaggatgacgaaattgttagactacaagtagtgacgacgaatgccaaagatattatgccatttgatgaggatgcgctgcgaaaattgttctcttttgttaagcataaagatcttgaaactaataacaatgaagatcaacaaaagactaaaacacaagtcttagctgaagtcgagtttagctgatccaaatgaggcataactatatcaactttatgaccggtggttagcgggtttaaaaaatatagtatcgcttgtatacaccgtcggagcaggcctgaaagtaatctcgcatttaattgcgatcatacacccaacttaattttctcccttaaggtgatttgtgttctatgggatagctcatccctcatagttggagtcattgttgggttcatttatatgcccaattagtgcgctggagtcgaacaatgtaggatccgtctcctctaggtgtcaacaaaactttatccatgcttttctactacaaattgggtctcgtggatcaggatct

SEQ ID NO: 881 - DNA, 2099 bp, Zea mays
cattgcatatatgttgttcttttctaaacgtgtaaagaaaattactgaatgattgataattatagtacaaacgttataaaattaatgagtgattgagaaagtgttgaacaaatacagcaaaattactgcatatttattgttattttattagtgtgttaatgaaattactaggtgactgagtaagtgttgaacaaatgctgcaaaattaatcagtgattactgtaaaattactatgtaactactcaatctaggtgattgaaattaccgaacaaatggtgcaaaattactgagtgaagactgtaaaattatctagtaactagataatcactacatatctgttgttattttctcaacgggtaaatgaaattactgtgtgattaaggaattactgagcaaatgctgtcaaattactgagtgatttatgtaaaattatcgagtggttactataaattaactgagtaactagacaatcattgcatatatgttgttcttttctcaacgtgtaaagaaaattactggatgattgataattatagtactaacgttataaaattaatgagtgattgagaaagtgttgaacaaatactgcaaaattactaggtgaccgaggaagtgttgaacaaatgctgcaaaattaatcagtgattactgtaaaattactatgtaactactcaatctcggtgattgaaattaccgaacaaatggtgcaaaattactgagtgaagactgtaaaattatctagtaactagataatcactacatatctgttgttattttctcaacgggtaaatgaaattactgtatgattaaggaattaccgaacaaatgctgtcaaattactgaatgaaattactgtgtgattaaggaattaccgaacaaatgctgtgaaattactgagtgatttatgtaaaactatcgagtgattactataaattaactgagtaactagacaatcattgcatatatgttgttcttttctcaacgtgtaaagaaaattactggatgattgatagttatagtacaaacgttataaaattaatgagtgattgagaaagtgttgaacaaatactgcaaaattactgcatatttttttgttattttattagtgtgttaatgaaattactgggtgactgagaaagtgttgaacaaatgctgcaaaattaatcagtcattattgtaaaattactatgtaactactcaatctgggtgatcgaaattaccgaacaaatggtgcaaaattactgagtgaagactgtaaaattatctagtaactagataatcactacatatctgttgttatttcctcaacgggtaaagaaaattactggatgaagtaaaattatatagtaactagacaatcattacatataatcatatatgttgttattttctcaatgggtaaatgaaattactgggtgattaaggaattaccgaacaaatgctgtcaaattactgagtgatttatgtaaaattatcaagtgattactctaaattagctgagtaactagacaatcattacatatatgttgttcttttctaaacgtgtaaagaaaattactggattattgataattatagtacaaacgttataaaattaatgagtgattgagaaagtgttgaacaaatactgcaaaattactgtatatttattgttattttattagtgtgttaatgaaattactgggtgactgaggaagtgttgaacaaatgctgcaaaattaatcagtgattactgtaaaattactatgtaactacttaatctgggtgattgaaattactaagtgaagactgtaaaattatttagtaactagataatcactacatatttgttgttattttctcaatgggtaaatgaaattaccgtgtgattaaggaattagcaaataaatgctgtcaaattactgagttatttatgtaaaattatcgagtgatttcggtaaattaactgagtaactagacaatcattgcatatatgttgttcttttctcaacgtgtaaagaatattactggatgattgataattatagtacaaacgttataaaattaatgattgattgataaagagttgaacaaatacaacaaaattactgcatatttat

SEQ ID NO: 882 - DNA, 2090 bp, Zea mays
gtaatcactgattaattttgcagcatttgttcaacacttgctcagtcacccagtaatttcattaacacactaagaaaagaacaataaatatgcagtatttgttcaacacattctcaatcactcattaattttataacgtttgttctataattatcaatcatccagtaattttctttacacgttgagaaaagaacaacatatatgcaatgattgtctagttacttagttgatttaaagtaatcactcgataattttacataaatcactcagtaatttgacagtatttgtttggtaattccttaaccacacagtaatttcatttacccattgagaaaataacaacagatatgtagtgattatctattactaaaacattttatagtctgcacttagtaattttgcaccatttattcagtaatttcaatcacccatattgagtagttacatagtaattttacagtaatcactgattaattttgcagcatttgttcaacacttcctcagtcacccagtaatttcattaacacactaagaaaagaaaaataaatatgcagtaattttgcagtatttgttcaacacattctcaatcactcattaattttataacgtttgtactataattatcaatcatccagtaattttctttacacgttgagaaaagaacaacatatatgcaatgattgtctagttacttagttgatttaaagtaatcactcgataattttacataaatcactcagtaatttgacagtatttgttcggtaattccttaaccacacagtaatttcatttacccattgagaaaataacaacagatatgtagtgattatctagttactaaaaaattttatagtctccactcagtaattttgcaccatttgttcagtaatttcaatcacccatattgagtagttacatagtaattttacagtaatcactgattaattttgcagcatttgttcaacacttcctgagtcacccagtaatttcattaacacattaagaaaagaacaataaatatgcagtaattttgcagtatttgttcaacactttctcaatcactcattaattttataacgtttgtacaataattatcaatcatccagtaattttcattacacgttgagaaaagaacaacatatatgcaatggttgtctagttacttagttgatttatagtaatcactcgataattttacataaatcactcagtaattggacaacatttgttcggtaattccgtaaccacacagtaatttcatttacgcattgagaaaataacaacagatatgtagtgattatctagttactaaataattttacagtctccactcagtaattttgcaccatttattcagtaatttcaatcacccagattgagtagttacatagtaattttacagtaatcactgattaattttgtagcatttgttcaacacttcctcagtcacccagtaatttcactaacacactaagaaaagaacaataaatatgcattagttttgcagtatttgttcaactctttctgaatcactcattaattttataacgtttgtactataattatcaatcatatagtaattttctttacacgttgagaaaagaacaacatatatgcaacgattgtctagttacttagttgatttacagtaatcactcgataattttacataaatcactcagtaatttgacagcatttgttcggtaattccttaaccacacagtaatttcatttacccattgagaaaataacaacagatatgtagtatattttacagtctccactcagtaattttgcaccatttattcagtaatttcaatcacccagattgagtagttaaatagtaattttacagtaatcactgattaattttgcatcatttgttcaacacttcctcagtcacccagtaatttcattaacacactaagaaaagaacaataaatatgtagtaattttgcagtatttgttcaacactttctcaatcactcattaattttataacgtttgtactataattatcaatcatccagtaattttctttacacgttgagaaaagaacaacatatatgcaatgattgtccatgttttac

SEQ ID NO: 883 - DNA, 2071 bp, Zea mays
ggacatggcgccggcggatgcgcctgatccggccacaaacaccgggatcaccatcatcgtcggcgcctgaggtcaggaggtgttacgtaatgcacgatcaccagcatcatcggctccgagaggggctacggaggcgtaggcctgtggcttcttccaattttctccatttctaccacttaattttttcttcctcctccttactcattattttctcctattttttcttcttattccacttccctcttttctttctttttttgcccctttctctatctctattatcatggccgattgtaaaaagatgcaagctagacacataaaggaatcataagaaacaacactgaaaaagtcccttgaacctatatatcatggtgatcgatgacaaaatttattaatggataatctgaacacacaaaagtgaaaaattattgattccactactcggctgcaaatagcccaacatatcaaaaactcatctgtcacgacactgagaaaattttgacttgctaacgccatccatttggtctttcagggcatccatccttttgccaaagcgtttagttgtttttggatgacataaacgtctaccttggagggagacatgtcatgccacagcgacgctggcggggacagtgatggtgtccttgatagcgcacgtgttgggggcgtcggaggtggctggaatggcgcatgtcgtggcggtgtcgcttcatcttgttcgtgaaacaatctctcaagtagatccaaattcttaggcggttcatttatcatatgcttgaaatcattgccacatttataaaaatgaaacaaatgtataattagaatatatataatctagattcaatcaaagagagacagagaatacctttgtttttttaatatgcatcttgcggcttttcgtctcccccatgtttgaagagtggatacgatgcagaacatggtcatcatacaactgtttcatacggttccatctattaatgagtgttttatttgaaattgttattgttgtcaccttataaagtttttccgacaaatattccacagttgtatcttccaaggtggattgcctctgctttatgatgccgctgtcaagcaagtcgacatagcccctacagaacacagtgtctatatccggataccagcagaacctaccctcatcttgggtcatattttccatctacaagaaaaaaatgaaagaaatcacaaaaaaacatatacatagacatataagctagcacatttactggtaagagaggggtacgtacgtaagaaaactcacataaaactgctggtcacgactgaggtgtgactgtctggaagcaaacttaagcgcaatgataataagctataacaacagggattctttttagatctatcacgctaaaggtcatgggaagtatattaatagaagcccccggtggcaatatgcatggcacacgtacgccacttcgcttcctctccctaatttgtttctttcttatccaagcgaacaacaacgatcgatcgagacttgagatcgctcgcgtgggggaagcgtgcgtcgctggtgactggcgagtgcgtcgactgcatgcatgctccatctgtgtgcatgcaagggaagtatattaatagaagcccccggtggcaatatgcatggcacacatacgccactctgctttcagtccctaatttgttcggttcttatccaagcgaacaacaaggatcaatcgagtcttgagatcgctcgttggggaagtgcatgtcggtggcgactgtcgactgcgtcgactgcatgcatgcagccgctggttgtttttatttacgtgagtttgtttagcgccgatgctgcaaggaggcagcctagctagtgcgtgtgtgcacgtcgtgtgcgtggccaggtcgtaagccggcgcgccaagtctcctgcatgcatgcgcgctgcagcacaatgctggcggctctgttggtcgcgtcgctcgtaccgccatgatgaagggtccggtgcatctactgcgcgccgctcgggcaccgcaccgagggtcttgtcattgcgaccgatggatttcgggctggcgaacggggtcggccc

SEQ ID NO: 884 - DNA, 2067 bp, Zea mays
tattaattatcccatgcatatatgcatgtcaacacttctccatatatggatctcattctaggtctaatcccaaacatttagataaaaacggtcctcataatccggtcctcataatccggacaattgaacgataccatgaaagtataatatacaggttcaaggcataacgcactaacttgtcgaaccggatctgctgataaaagttcaaggcataacgcacgaacttgtcgaaccgggtctgggacgacgctgggggctcagcaatctcaccggagcctgagccagaggcggggacgggccctggcgcaggggcgacgactggagtaggcgcgggggcgaagaccggtggcgcgtaggcggggaggggcccaggcgcgggggcgacgaccggtggcgcgtagacggggggcccaggcgcgggggcgacgaccggctccggcctcggcgcgtaggcaggggcgaccagtgtgacggcatagatgaagagaaccacagtgagcacgtccatggcgaagaggatgtagcgtagagggagagggagaggatcgtgcgcgtggaagtttggaactgcagcgggggatgtggggtggtgggacaggaaccgctaggacgggccacgttttttagcgctactcccctctccctctgcgccgcagtttcgagcgccgcacagctctgcctcctctccctcactatgtattcaatccctatttagagcaactccaaaaggatgttaaacccaaaaactgattattaaaagtaggctaaaaagttttaaaagtgaatcatggtagttactctaaatataatagtggcgcaatctgtacagttatcgggagaatgtggatgatccgatacgttgatgaatggattggggagggatgagacacaccaaaatatgaggaagagaaggctgtggatgtgggacaccaatttttttgggaagaatagagaactgttggagtaagaaaaaccactattcttgactaatatctgttttagagttagtttacacgttcttttggagttgctcttatcccacataatcaacttccatcgctaatcccacgtctctgcaaagttggacccaccagaaccccgttagattccctcctagagatcactaaataaatttgggggagttgttcatgcgtgagttcaccttttgattactaacacaaattttctacaatgcgtacgtgaagcattttctcgtcaaaacatcccaaatgttaccaacttacttgctacttgcttatttgttctagttgccatattcttcctaggcctatatctattgtgttaccagtcaccacacatattcctgggtttcaagataactacttaattcatcaaggtctccgatatattctatgggactatagtcttgcaccggttgctggattcatttatttataatataacatctctaatgtaattgtaaacattattacatgttagatatgtcatgccgatactattgagccttcctgtgtagcacactatgttttctgtttcggtctgcagatgttgtacatgaaatacggtggaaataaactactgaatctgttagccacatggaatagatctggccattcttgacaatcatttttagttggtggcgttttgtactacattctacataacaatgtatgggtaagttgtgtgcaacattcttactttctcctctttccttcatagttctagagtacacatcataattaattcatggcaagaggagcacagagttatcaggcttgctcagcctgactagatcgatatctcgaaatgaattcatcagtcatgcttttagtcatgcttttattaaggtagctcgtttcagagatatttgtgttggtgaattgataattttgggagatttcattggagatattgaatacctagcggttccggtctaaaaaaatcacttatttgtcatgccgcttcatagatttgaccatcgcgagtgcttttgctttgtcatttctatccctataacatcttgcctcgctagagcaatgccaggcacaccagcctcacggggagtgctcagctggttcccaagct

SEQ ID NO: 885 - DNA, 2064 bp, Zea mays
agctactcgaagaatattaaacacctatagcaagatatctcaaatctagtacgaaaatattagatgtcgatatcacattaaaactatagttatggtattctaacttaatcagatttaattttaaccgcatatccaattatcaaactagctaggaggattagcgaatcgattcactagtactaatttgactcagaagtcacgaaaacagtaatgatccctagttcagacaactccccgaatacctagcgtgtgtgtttcatcgagagggattgaaccggactcacatatcaaggaatatataaattataacatgttctatattttccatagctaaagcacgatacataaaaggctaacacaattaggttcactaaaagaggacctctaaaactaagagcgtggatagaaacaagctaatcctttttaactattattttcagaggagcacgccaactaaaattagtttgacgatgctacaattacgatatctactcactatgttcatcagtctaactaatatgaaaattaattcaacttaccaagatcaaaccgatccgaaatcacaagaacgtcggcggttgatggcacacaatagcaaaagagccggagacgatgatgttcgcggttgcaaggcgagcctgagtccgccgcaaaggaactgcccacagccagagcgcccacgccacgaacaggacgaccgatgaattgatgacgagcaccatcatggggcgattcgccgggttgaacacggggtcgattaatccttccatttcttgttgggcatttcatcgagcaactagcaaccgacacaaccaaacttcattgtctgagcatgatggagtgtgttgtggaacttggatgtgctgagcttgaggccgagcagttagagcgcggaaagacacctatcgcacgcggaggtggacgaccagacatccctactgcagacaaatccatgaatgcactacgcggatactggatgcagaggaaaagcagcaagtcacggatttctctagtcgcaccaaccacaagcgtgccgaggacgagtgtcgccagcaccacgggatcagggcttcaccggcggaggactgcgctctatgcgagacgcacggagaggttcaaaagtggcgtgcttacaggagggtgaagaactggggaacgagagggagcagaagtgcggcgaccaggggctacggcgagggagaaactcggcagggcgctactggggaagtcggcgcgccgtggcgagcagaggggcacgacgagcggcggaggacggctccccagcgcacggatcagtcggctccgaccgcgccacccagtggcagcgacgtagtggagcccgtccaaggagctgtgtccagcgagctcgcggtaccaggatcccgccggtgagtagccgagctagagcaccggcgagcagcagagaagaagacgcgcgggagagaggaggagcgatcgagctgggagaagggaggaagcaggagctggggcgcggcatggggaaacgaagctccacgacgagcttgagggagatgagcgaagcttggccaggcgccgttggagatggggcgcgccagggaagaagctgcgcgcggcttgggaagaatcagggggcgcgcagaggagaatccggggaagagcgccggcgagctcgagaacgggagagggccagcgtggagctccagccgtgcgcaggagaggctgggcgctggagagagaagcgcacgtgggagaagcagagggaggagagcagaaggaagcaagcttgaggagggcgcacgcacggtgctggctggcgtacacacggtggaggaacagagggtgccgacacagaggacttcgaccgaggaagcatgtcaaagtggcgaccggtggagcagagagagacgtgcctagaacgaagaggcacggatgagacgaagccaaagcatgatatccatggaaagcgtgtggagcagaccagaccgacgcggctgagaagaagctagagagagaaagagcagtgtggagattacgctgagtgcacgatggggataaggccaccgcctatgcgcgcattccaga

SEQ ID NO: 886 - DNA, 2028 bp, Zea mays
ggtggagcgtgtgaaacaacatgttggatcgttctgtaaatctaccacataatttagggctttgacaagcttcaaagttttcgcatgttcatgccacaatttttcgagaaaacatgcacggaatcatgaccctttactcctaaattagtgtactgtgaaaactttgatggcaaaccttgttgggtcctttttgtaaaaactaccattctaaacattacatcatttagggatttgaaccgcttcaaacttacattaatgtccataaccatgaaacatttgaaaatttcccacatatcttatgagataacatgcttaaacaagtgatgtttacattttgacaatgagcaaatagtaatgtaatttttcctaggttaaacaagtgatgtttacattttgacaatgagcaaatagtcccatacttgttttttgagtggcctcaaaacatgcattgttgtccataaccaagaatcatttaaaatagcactacatatggtttaagatagcatgcctaaactagtattgtttatagtcttgcatagagaaaaatgtaataaaaatgggaatgaatttttttctatatttaattcttttgttgtaaatatcattgatataactgcaatagaataataacaaagaatcttaaaacatggatcgaaataaaagaagaattgcataaatatagctctcaactccgagaaattaccgatctaaaaaatatatatgttgcactttaaacatttctaaagttacctcattcatcatatctacaaactctagtcccagcattggaacatccaatatcttaggccccaaactcatgctataggttatcttgcacttgggatgatgatgaagcatgtgaaacaacatgttggatagctcatgcctatagtaaatttaggatacgaaaaaaatatacatgttatatttcaagcgcttatagagtcacctcatccttcgtatgaccaaatctagtgctagcatgcgacaatctagggtcgcatactcacattatggttgtcttgaacatgggttaatgatggtgcatgcgaaacaagttgggtctatccgcaaaaactgtctatttaaacaatacaacatttcgggcttcaaaatgcaacgaagttgacacacataaaaaatcgatatatcatgaagcaaacttgtacgaaattaatacccattagtcccatactcatgttttgatcggcattaaacttgggttgatgtcttcacaactgaggaacattgcacatagcactatatatatgtgttaatgtaacatgcctaaagaagtatgttttacagtacgacatttagaaaagagtaatgaaagtgaaaatataaattttcttccattaactattttccattaatataggtcgtaactctgcaaaatagtttatcttgaaaaatctgcatattgcaattcaaatacttttaaagttatctcattatttaaaacactgaactttaatcggcatgcgaccatctaactatgtgggtcccacaatcatgttattgattgttttcaatattagttgatggtggagcttgtgaaacagcatgttggatcattctataaatctaccacataatttagggcttcgaaaagcttcaaagttttcgcatggttcatgccacaatctattcgagaaaacatgcacgaaattatgaccctttactcccaaatcagtgtattgcgaaaactttgatgacaaacatttttgggtcctttttgtaaaaattaccgttctaaacattatatcatttagggctttgaaccgctttaaacttacattaatgtccataaccatgaaacatttgaaatctttccacatattttctaagataacatgcccaaactagtgatgtttacagtttggcaatgagcaaattgtaatgtaattttcgttggttaagttgttttgtgataaatatcatgagtcccatacttgttttttgagtggcctcaaaacatgcattattgtccataaccaagaatcatttaaaatagcactacatatg

SEQ ID NO: 887 - DNA, 2019 bp, Zea mays
catacgcgcagccgcccccttccctgccatgcgcgcagctgcccccttccccgccatgcggctgcagcgggacgcgatcgagtgcgccatcagggcgccgctgggcaccgtgctctgcgaccacgcgctcgtgcacctcccgccggccgccacggcgtgcctccgcctcgtgcacccgtcgtgggcgcgggcgctcgcgtcgccgctcttcgccgtcacgcacaccgccaccccgcgtagggcctcggccttcttctctgtgtccgcgtccgcgcccgcgggcttcctcccgctcgacgccggcgacaccgtgcccacgttgagaaaagaacaatatatatgcaatgattgtctagttactcagtcaatttacagtaatcactcgataattttacataaatcactcagtaatttgatagcatttgttcggtaattccttaatcacacagtaatttcatttaccccttgagaaaataacaaagatatgtagtgattatctagttactaaataattttacagtcttcactcagtaattttgcaccatttattcagtaatttcaatcacctagatttagttacatagttaattttgcagcatttgttcaactcttcctcagtcacccagtaatttcattaacacactaataaaataacaataaatatgcagtaattttacagtctttactcagtaattttgcaccatttattcagtaatttcaatcacctagatttagttacatagttaattttgcagcatttgttcaactcttcctcagtcacccagtaatttcattaacacactaataaaataacaataaatatgcagtaattttacagtctttactcagtaattttgcaccatttattcagtaatttcaatcacccaaattgagtagttacatagtaattttatagtaatcactgattaattttgcagcatttgttcaacacttcctcagtcaaccagtaatttcattaacacacaaataaaataacaataaatataaggtaattttgtcgtatttgttcaacactttctgaatcactcattaattttgaaatgtttgtactataattagcaatcatccagtaatttcatttaccgattgagtaaataacaacagatatgtagtgattatcaagttactaaataattttacagtcttcactcagtaatttcaatcacccagattgagtagttacatagtaattttacagtaatcactgattaattttgcagtatttgttcaacacttcctcagtcacccagtaatttcattaacacactaataaaataacaataaatatgcagtaattttgcagtatttgttcaacactttctcaatcactcattaattttataacgtttgtactataattatcaatcatccagtaattttctttacacgttgagaaaagaacaacatatttgcaatgattgtctagttactcagtcaatttacagtaatcactcgataattttacataaatcactcagtaatttgacagcatttattcggtaattccttaatcacacagtaatttcatttaccccttgagaaaataacaacaaatatgtagtgattatctagttactaaataattttacagtcttcactcagtaattttgcactatttattctgtaatttcaatcacccagatttagttacatattaattttacagtaatcactgattaattttgcggcatttgttcaaatcttcctcagtcacccagtaatgtcattaacacactaataaaataacaacaaatatgcagtaattttgcagtatttgttcaaaactttctcaatcactcattaattttataacgtttgtattgtaattatcaatcatccagtaattttctttacacgttgagaaaagaacaacatatatgcaatgattatctaattactaagttaatttacagaaatcactcgataattttacataaatcactcagtaatttgacagcactcgagaacaatttcttagtaatttgacagaaatcactc

SEQ ID NO: 888 - DNA, 2011 bp, Zea mays
gttaggtgcagtttagtttaactgatccaaatgaggcccaactatatgaactttgtgacatatggttagtaggttactagggtcttattgggtgagaaacatcttaggctggttaattttttacgtgtgtaaaacctcaatcatgtcacattcactcgtaagaagactcggttgtattcctgttaatagaaatggttgtttcctctctaaaaatatgttgactaacttggtctctatagacaagtttagtgacctcgtgggcaatttactctagcaggccccaaaagtcaaacaacaagttacctacttctccataagaatgtagcaatcaataacatgcatgtttgtcaaactgacaactaagacccaattgcagcaagagcgtgtgacagttcctaacccacgagacccaatttgcagtagaaaagcatgcataagattttgttgacacctagaggagacggttcctacattgttcgactccagtgcacctaattgggcctataaataaaccaacaatacaccttaagggagaaaattaagttgggtatatgatcgcatgcaaatgcgacattagttttcaggcctgctctgacggtgtaaacaagcgaaactatatttttcagacctgctaaccaactgacacaaagttgatatagttaggcctcatttggatcagctaaactcgacaacagctaactcttgtgttttagtcttttgttgatcttcatttttattagtttcaagatcttcatgcttaacaaaagagaacaaatttcccagcgcatcctcaagaaatagcatactatctttggcatttatcgccactacatgtcatctaagaatttcaacaccttaatttatttgtgctcccacttccacctcctcaacattatgcaaaagcttttgagctgcttcagtagcccgctttacctgtaagttcttcctcttaatggtcccaccgtaacattcttccattgtcttaagttgtttccacacataattctttttcgtttgttatgctgaaatttcattgtgcttctctcatctcaggatctagtaagctttctttagtttttaatctcttccctaatctcttctccaatcttttgggatccgaattgtcaataccaatatatgaagtaaagtttagtcccaacaattcagatcaccaaaaaagtgaggaagatattaggtaagagataagaaaactaaagtaagcttccaagatcatgagattagaggacagtgaaaattcagcacaacaggcaaaaaagaattttgtgtggaaccagcttaagacaatggaaggagattacactgggaccattaagaggaagaaaatagaggtaaagcaggctactgaagccgctaaaaagtttttgcataatgttgatgagttgcaattgggtgccccaaagaaggatgataaattgttagactacaaatagtggcgacaaatgccaaaaagaggatgttgtttcttgaggatgagctgcaaaaattgttgtctttggtcaaggataaagatcttgaaactttataaaaataaaatcaaccagagactaaaatgcaagatttagttgctgtccagattaactaatccaaacgaggcctaactatatgaataggtggttagcaggttactaggttcttattgggtgcgaaacttttgatgcaggtggattttgctatgtgggtaaaccctgaatcatgtcacatccactcttctcaagactaaacacaagagttaggtgcatattagtttaactgtggcctatataaaataatgtggactaacttgttctctatagacaattttttagtgatctcatgggccaaaagttagacgaaaagttacctacttctccacgagaaagttgcaattaataacatgcatgttggtcaaactgaccaatcagactcaattgcagcaagatttggcacacggacgaactgcaaacataaatgaacagtcaagactcacaaaatcaataggcttgtgctattg

SEQ ID NO: 889 - DNA, 20 bp, Artificial Sequence
  synthetic oligonucleotide
acccaaatcaacgctgtctc

SEQ ID NO: 890 - DNA, 20 bp, Artificial Sequence
  synthetic oligonucleotide
aaaaaccccaaacccaaaac

SEQ ID NO: 891 - DNA, 20 bp, Artificial Sequence
  synthetic oligonucleotide
ttaatcgtcatgcgaccatc

SEQ ID NO: 892 - DNA, 20 bp, Artificial Sequence
  synthetic oligonucleotide
atttcgtgcatgttttgtcg

SEQ ID NO: 893 - DNA, 20 bp, Artificial Sequence
  synthetic oligonucleotide
cggttccgttgacttcatct

SEQ ID NO: 894 - DNA, 20 bp, Artificial Sequence
  synthetic oligonucleotide
gaaaccaggccacaagagag

SEQ ID NO: 895 - DNA, 30 bp, Artificial Sequence
  synthetic oligonucleotide
cgaatgcataaatatagctctaaactccgg

SEQ ID NO: 896 - DNA, 28 bp, Artificial Sequence
  synthetic oligonucleotide
gatatctatgtatgtttgaagcggttcg

SEQ ID NO: 897 - DNA, 27 bp, Artificial Sequence
  synthetic oligonucleotide
cacaactgagcaacattgcaataacac

SEQ ID NO: 898 - DNA, 36 bp, Artificial Sequence
  synthetic oligonucleotide
cggaaaaatagttaatggacgaaagattatattttc

SEQ ID NO: 899 - DNA, 28 bp, Artificial Sequence
  synthetic oligonucleotide
ggtaaccattgagttcttgatggacgac

SEQ ID NO: 900 - DNA, 26 bp, Artificial Sequence
  synthetic oligonucleotide
ggacactgggccgcaattataagttg

SEQ ID NO: 901 - DNA, 93 bp, Zea mays
tatcctgacacgcgcccccggcagagctgaggtgaccgccgtcactccaccgctccactggccagtctgacagaaggacagcgccgcctgcgc

SEQ ID NO: 902 - DNA, 93 bp, Zea mays
gcgcaggcggcgctgtccttctgtcagactggccagtggagcggtggagtgacggcggtcacctcagctctgccgggggcgcgtgtcaggata

SEQ ID NO: 903 - DNA, 128 bp, Zea mays
ttctccatattgaccatcatactcattgctgatccatgtagatttcccggacacagtaatttcatttacccattgagtaaataacaacagatatgtagtgattatcaataggtaaatagaattactgt

SEQ ID NO: 904 - DNA, 97 bp, Zea mays
agcaaatcctgtcaaattactgagtgatttatgtaaaattatcgagtgattactgtaaattaacttagtaattagaaaatcattgcatatatgttgt

SEQ ID NO: 905 - DNA, 71 bp, Zea mays
atccttagttacagtctgacagtataaaggtcactctcactacctggtagtagagccatgacccggtgctg

SEQ ID NO: 906 - DNA, 74 bp, Zea mays
atgccagatccaaaacatttcgccagatccacgaactaccactgatcaaaacgcagatccggacatcgacaacc

SEQ ID NO: 907 - DNA, 2496 bp, Zea mays
  misc_feature (996)..(999): n is a, c, g, or t
ccttacacttcacatgatgctaaagttacttggaccaaaacattgaggaaagcaacacctcaaaagaagacattatgaagatcaagtgaagtccaagaaacaaaagaagtgttgcctacggactgtctagtctggcgcaccggactgtccggtggcacaacgggatgtccgctgcaccagggaacactagccccagtggcactttggagagaagaccaccggactgttcggtgtgacatccggagtgtccgttgtaaaaagcatgcgcgccaatggtcggctgcagtgtcaggccaacggctaggcgcaccagacggtgaacagtgcactgtccggtgcaccaccagactgtccggtgtgccgcagagagcacaacttttctccaacggctagttttgtgttgggggctataaatacaccccaaccgaccattccaatgtgtgggagcccaagcaacataccaaggcatatagtagacattcccaagtgctcatacacccaagtgcttaatagaatcactcgatgattagcgtaggtgctttacgaagtgcttaggtgtcacacccgggttttagggacccagacgtggacataaaatcatcaggtgtgctgggaccaagtctcacacatatgatgaatcgtggtatagaaacgaatgtcacatctttactatataataggatttatgtacaaaataaataaataattacatcataaggagacaacgatccagcaacccaaagttgactgggagacgacagcctagacctctcacgaacacatcacaacatcctccatgcgcctcatcctgcggtacctgatcttgacctgtggggggtgtgagacagcaagagtgagctcacatacgttcatcgctcaacaagttgtggagaataatgtgcatgaactcgtcaaaggtgggagctcatgtgaagtgtaaggcttaccaaagagaatggttgaagctgaacattaattttaaagttggtcaaaatnnnnttagcaattactaagtataagtagataccaacccaaataagtagaagatcaaaattgataacaacacccgcgatgtaatgcatatgacaaattgaatttagttctataaattaatcatgcgagagtcctgagctgctcatgaccgtgagcacgactagtataccagttttacactctgcggaggttgtaccttgtccccacaagtcgtgtatcccatatcgccagggtttgcaaggcccttagacacttccgaggtggctagggattcactacgaggcctttacaaagttccactagcttctaaaaacccgctacagtttctaggaagagcaatgtaggaatccctcgtctgaccgccatcgcagcaaaatcaacccgagaacctccctacatgcctactcccctactgcccttgcccctttcgggtaaggtagtcttccactagctttcctaattagtcaaccaagggcgtcacattccacccttgtggtggcacgtgtttctcaagttaagctccatgttccaattaatataatgatcttgccatgaacaatatgtaaaacaacagtataattggaacatgaacataatgtaataataaacccaaatccatatagagcaatagcaaaaactacccaaatagttaaggggtaaacatggtgtaaagataaccaaactagggtgacctattgagttccatcaaaattaagcatatgcatgataaaatgattacagagaacattattgggtaaataaaagtgatcaagggcacaacttacctgggacttgagatttcaggtatcagaatgatattcagatgacttgtaacctcgcgctagtcgtagtaatacaaacaaacagtatatagacaaaattaacatcatatcaaacataagaacaaactgcaaaataataatctaggtgatgatatgagatcgtaggctcgagaatcactgaattcggagctacggtttacaagacatgattttctagaggtttaggagtcacgtacaaaagaaaagaaattaagtatagggctctcaaacacccccgcgaacaggtatggatgctttctaatctacaccgttgatcaccagaccaatggcgcccagcctcgccctctcccccaaccttaccacacgactggcgcgggcggcgcctccaggccccatggcggcgaagcacgccggagttgcgtgatttgcccccggcgcacgttcatttaatccaaagctgcgactcgacgccccgagagcggtgaatcaaattacagtaatattaccagggattagcatgccggggttgatcgtatacggagatcaacggcttggcggcagactaccatctctagcgaaccattgacgttgctttagttgacccccacatctgccagtgccatagcgcgatttagcagctcttcgaggatcctggtcgatgctggaccgatgatgggatcccaaaattcgtgttggtggtactatctcagtgcgatggggt

SEQ ID NO: 908 - DNA, 78 bp, Zea mays
gtaatacgacggatcgtaatttgtcgttttatcaaaatgtactttcattttataataacgctgcggacatctacattt

SEQ ID NO: 909 - DNA, 77 bp, Zea mays
cacctggtcgagggcctccatattgaccatcatactcattactctttctttttctccatattgaccatcatactcat

SEQ ID NO: 910 - DNA, 65 bp, Zea mays
gagtatgatggtcaatatggaggccctcgaccaggtggatgaggattttgggcgtgatatctttg

What is claimed is:

1. A recombinant maize B chromosome comprising at least one transgenic DNA of interest, wherein said at least one transgenic DNA of interest is adjacent to a left flank sequence on one side and a right flank sequence on the other side, and wherein at least one of said left and right flank sequences comprises a nucleic acid sequence having at least 90% sequence identity to at least 0.25 kb of SEQ ID NO: 881, and wherein the at least one transgenic DNA of interest encodes a peptide or an RNAi construct.

2. The recombinant maize B chromosome of claim 1, wherein the transgenic DNA of interest is inserted at a double-strand break generated by one or more site-specific genome modification enzymes.

3. The recombinant maize B chromosome of claim 2, wherein the one or more site-specific genome modification enzyme is selected from an endonuclease, a recombinase, a transposase, a helicase or any combination thereof.

4. The recombinant maize B chromosome of claim 2, wherein the one or more site-specific genome modification enzyme is:
   (a) an endonuclease selected from the group consisting of a meganuclease, a zinc finger nuclease, a transcription activator-like effector nuclease (TALEN), an Argonaute, a DNA-guided recombinase, a DNA-guided endonuclease, an RNA-guided recombinase, an RNA-guided endonuclease, a type I CRISPR-Cas system, type II CRISPR-Cas system and a type III CRISPR-Cas system;
   (b) an endonuclease selected from the group consisting of Cpf1, Cas1, Cas1B, Cas2, Cas3, Cas4, Cas5, Cash, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, and Csf4 nuclease;
   (c) a dCas9-recombinase fusion protein; or
   (d) a tyrosine recombinase, a serine recombinase, a Cre recombinase, a Flp recombinase, a Tnp1 recombinase, a PhiC31 integrase, an R4 integrase, or a TP-901 integrase.

5. The recombinant maize B chromosome of claim 1, wherein the transgenic DNA of interest comprises one or more gene expression cassettes, wherein the gene expression cassettes are selected from the group comprising: an insecticidal resistance gene expression cassette, herbicide tolerance gene expression cassette, nitrogen use efficiency gene expression cassette, a water use efficiency gene expression cassette, a nutritional quality gene expression cassette, a DNA binding gene expression cassette, a selectable marker gene expression cassette, an RNAi construct expression cassette, a site-specific genome modification enzyme gene expression cassette, or an expression cassette encoding one or more of a CRISPR associate protein, a tracr RNA and a guide RNA.

6. A maize plant, maize plant part, or maize plant cell comprising a recombinant maize B chromosome of claim 1.

7. A method of making a transgenic maize cell comprising at least one recombinant maize B chromosome comprising at least one DNA of interest, the method comprising:
   (i) selecting at least one target B chromosome genomic locus, wherein said at least one target B chromosome genomic locus has at least 95% sequence identity to the full length of a sequence selected from the group consisting of SEQ ID NOs: 10-13, 16, 19, 21, 22, 24, 25, 32, 34, 38, 40-45, 17-49, 55, 56, 60, 62, 64, 65, 68, 70, 72, 73, 75-79, 81, 83-86, 88-92, 94, 95, 98, 100, 102, 103, 107, 108, 110-112, 114, 116-118, 121, 123, 124, 126, 129-133, 135, 137, 138, 140-150, 154-159, 162-166, 168, 171-180, 183-197, 200-212, 214, 215, 217, 218, 220, 222-225, 228-232, 234-236, 238-241, 243, 244, 247, 249, 251, 253, 254, 256-258, 260-266, 269, 270, 273, 275-279, 281-295, 299, 301, 302, 304-316, 318-320, 322, 323, 325, 327-329, 331-335, 338-344, 346, 347, 349-354, 357-360, 363, 365, 366-373, 375-379, 381, 383, 384, 386-388, 391, 392, 395-398, 400-404, 406-412, 415, 416, 418-420, 422, 423, 428-433, 435-441, 443-446, 448-450, 452, 456-459, 461-464, 466-475, 478, 479, 481-484, 486, 487, 490-495, 497-499, 501-503, 505-508, 510-513, 517-520, 524, 525, 527-529, 531-543, 545-547, 549-554, 556-560, 563-577, 579-584, 586-593, 595, 596, 598-609, 611-614, 616-619, 621-624, 626, 627, 629-636, 638-640, 643-652, 655, 657-661, 663, 664, 666-668, 670-674, 676-680, 683-688, 690-701, 703, 705-708, 711-717, 719-729, 731-734, 736-738, 740, 741, 743-748, 750, 752-764, 766, 767, 770, 771, 773, 774, 776-785, 787-791, and 793-888;

(ii) selecting a site-specific genome modification enzyme that specifically cleaves a sequence within said at least one target B chromosome genomic locus;

(iii) introducing the site-specific genome modification enzyme into the maize cell, wherein said site-specific genomic modification enzyme cleaves the sequence within said at least one target B chromosome genomic locus;

(iv) introducing the at least one DNA of interest into the maize cell, wherein the at least one DNA of interest encodes a peptide or an RNAi construct;

(v) inserting the at least one DNA of interest into the cleaved sequence within the at least one target B chromosome genomic locus; and (vi) selecting a transgenic maize cell comprising at least one recombinant maize B chromosome comprising the at least one DNA of interest, wherein the at least one DNA of interest is inserted into the sequence cleaved by the site-specific genome modification enzyme.

8. The method of claim 7, wherein the insertion of the at least one DNA of interest into the sequence cleaved by the site-specific genome modification enzyme is mediated by homology directed repair.

9. The method of claim 7, wherein the insertion of the at least one DNA of interest into the sequence cleaved by the site-specific genome modification enzyme is mediated by non-homologous end joining.

10. The method of claim 7, wherein at least two DNAs of interest are inserted into the same B chromosome, and wherein the at least two DNAs of interest each comprise between 1,000 and 5,000 nucleotides.

11. The method of claim 10, wherein the at least two DNAs of interest are inserted into at least two target B chromosome genomic loci, wherein said at least two target B chromosome genomic loci are genetically linked but physically separate.

12. The method of claim 11, wherein each of the at least two target B chromosome genomic loci has at least 95% sequence identity to a sequence selected from the group consisting of SEQ ID NOs: 10-13, 16, 19, 21, 22, 24, 25, 32, 34, 38, 40-45, 17-49, 55, 56, 60, 62, 64, 65, 68, 70, 72, 73, 75-79, 81, 83-86, 88-92, 94, 95, 98, 100, 102, 103, 107, 108, 110-112, 114, 116-118, 121, 123, 124, 126, 129-133, 135, 137, 138, 140-150, 154-159, 162-166, 168, 171-180, 183-197, 200-212, 214, 215, 217, 218, 220, 222-225, 228-232, 234-236, 238-241, 243, 244, 247, 249, 251, 253, 254, 256-258, 260-266, 269, 270, 273, 275-279, 281-295, 299, 301, 302, 304-316, 318-320, 322, 323, 325, 327-329, 331-335, 338-344, 346, 347, 349-354, 357-360, 363, 365, 366-373, 375-379, 381, 383, 384, 386-388, 391, 392, 395-398, 400-404, 406-412, 415, 416, 418-420, 422, 423, 428-433, 435-441, 443-446, 448-450, 452, 456-459, 461-464, 466-475, 478, 479, 481-484, 486, 487, 490-495, 497-499, 501-503, 505-508, 510-513, 517-520, 524, 525, 527-529, 531-543, 545-547, 549-554, 556-560, 563-577, 579-584, 586-593, 595, 596, 598-609, 611-614, 616-619, 621-624, 626, 627, 629-636, 638-640, 643-652, 655, 657-661, 663, 664, 666-668, 670-674, 676-680, 683-688, 690-701, 703, 705-708, 711-717, 719-729, 731-734, 736-738, 740, 741, 743-748, 750, 752-764, 766, 767, 770, 771, 773, 774, 776-785, 787-791, and 793-888.

13. The method of claim 7, wherein at least two DNAs of interest are inserted into different B chromosomes.

14. The method of claim 7, wherein the site-specific genome modification enzyme is selected from an endonuclease, a recombinase, a transposase, a helicase or any combination thereof.

15. The method of claim 14, wherein the site-specific genome modification enzyme is:

(a) an endonuclease selected from a meganuclease, a zinc finger nuclease, a transcription activator-like effector nuclease, an Argonaute, a DNA-guided recombinase, a DNA-guided endonuclease, an RNA-guided recombinase, an RNA-guided endonuclease, a type I CRISPR-Cas system, type II CRISPR-Cas system and a type III CRISPR-Cas system;

(b) an endonuclease selected from the group comprising Cpf1, Cas1, Cas1B, Cas2, Cas3, Cas4, Cas5, Cash, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, and Csf4 nuclease;

(c) a dCas9-recombinase fusion protein; or (d) a tyrosine recombinase, a serine recombinase, a Cre recombinase, a Flp recombinase, a Tnp1 recombinase, a PhiC31 integrase, an R4 integrase, or a TP-901 integrase.

16. The method of claim 7, wherein the at least one DNA of interest comprises one or more gene expression cassettes, wherein the gene expression cassettes are selected from the group comprising: an insecticidal resistance gene expression cassette, herbicide tolerance gene expression cassette, nitrogen use efficiency gene expression cassette, a water use efficiency gene expression cassette, a nutritional quality gene expression cassette, a DNA binding gene expression cassette, a selectable marker gene expression cassette, an RNAi construct expression cassette, a site-specific genome modification enzyme gene expression cassette, or an expression cassette encoding one or more of a CRISPR associate protein, a tracr RNA and a guide RNA.

* * * * *